United States Patent 7,745,391 (HUMAN THROMBOSPONDIN POLYPEPTIDE) - sequence listing, part 203

SEQ ID NO: 481227 - DNA, 797 bp, Homo sapiens
  misc_feature (3)..(3): n is a, c, g, or t
  misc_feature (66)..(67): n is a, c, g, or t
  misc_feature (72)..(72): n is a, c, g, or t
  misc_feature (74)..(74): n is a, c, g, or t
  misc_feature (210)..(211): n is a, c, g, or t
  misc_feature (273)..(273): n is a, c, g, or t
  misc_feature (308)..(308): n is a, c, g, or t
  misc_feature (310)..(310): n is a, c, g, or t
  misc_feature (324)..(324): n is a, c, g, or t
  misc_feature (332)..(332): n is a, c, g, or t
  misc_feature (337)..(338): n is a, c, g, or t
  misc_feature (343)..(343): n is a, c, g, or t
  misc_feature (370)..(370): n is a, c, g, or t
  misc_feature (426)..(426): n is a, c, g, or t
  misc_feature (429)..(429): n is a, c, g, or t
  misc_feature (440)..(440): n is a, c, g, or t
  misc_feature (443)..(443): n is a, c, g, or t
  misc_feature (540)..(540): n is a, c, g, or t
  misc_feature (565)..(565): n is a, c, g, or t
  misc_feature (635)..(635): n is a, c, g, or t
  misc_feature (650)..(650): n is a, c, g, or t
  misc_feature (654)..(654): n is a, c, g, or t
  misc_feature (661)..(661): n is a, c, g, or t
  misc_feature (667)..(667): n is a, c, g, or t
  misc_feature (683)..(683): n is a, c, g, or t
  misc_feature (693)..(693): n is a, c, g, or t
  misc_feature (698)..(698): n is a, c, g, or t
  misc_feature (706)..(707): n is a, c, g, or t
  misc_feature (712)..(713): n is a, c, g, or t
  misc_feature (723)..(723): n is a, c, g, or t
  misc_feature (751)..(751): n is a, c, g, or t
ganaggggttttcaggagttggagattatagaatattaggtaggaatgttggtatcctccactatnnatggntnccctaggtcacaaatgggagactggcagctacgccaatatcaaaacccagtggaatgacacttctatggagtttacttttcttcgctgctatcttccctcatccgcacggaaatgtctgtcaccatgtaaagcccnntagcaggcagctttggctccagtcttcccccttgggtaggaaacggagtgaagggaatgtcnctcctgggtttccatgctttcttcttccgctccgngngggggttcttcggnattccccncctcnncctcnccttccttcttctctggtggcttctcntaagccttttctgaaggccgttactatgcactccatcccaggtagatatttcagangcnagatctagganagnggaaaaggtgatttagacgagtagcccagcataaaagtctttacttacaatgtggaaatattaaaggcatttaagtagtgttacagcgttctctgtnccagattacaatacaaaacccctgncccacagtggtccctcacagctggcatcaccctcctggccaaggatcttcctaaagcccccatgtgagangattcggacgagagnccgngctgtanagcagnccatgtcctggagganagcaaagtgngagtnagcaaggnnaatcnnaggaccttantttgagtaatacccttctgaaaacaganattaagacagctttttaaatctcaggaccaaagtctttctgaatcc

SEQ ID NO: 481228 - DNA, 163 bp, Homo sapiens
  misc_feature (105)..(105): n is a, c, g, or t
tatcctaatactagcacccactcttatcagtggtggagaacggtctcagaactgttgtttccattggcatttaagtttagtagtaaaagatggttaatgataacnatgcatcgtaaacacttcagaaggaaaggagaatgttttgtggaccactttggttttc

SEQ ID NO: 481229 - DNA, 435 bp, Homo sapiens
  misc_feature (294)..(294): n is a, c, g, or t
  misc_feature (321)..(321): n is a, c, g, or t
  misc_feature (344)..(344): n is a, c, g, or t
  misc_feature (376)..(376): n is a, c, g, or t
  misc_feature (380)..(381): n is a, c, g, or t
  misc_feature (384)..(384): n is a, c, g, or t
  misc_feature (386)..(386): n is a, c, g, or t
  misc_feature (405)..(405): n is a, c, g, or t
  misc_feature (408)..(408): n is a, c, g, or t
  misc_feature (412)..(412): n is a, c, g, or t
  misc_feature (416)..(416): n is a, c, g, or t
caacagaaggagaggaggagaattaaaccggcaaaggcctcaggaaaaaagctcttcagaattcaggggcaaaaggaaagaaaaaccaaagtctccctttttaagggggctgagggcccattccagtgagcctttggactggagggactgtccctggatttcggaaggtaaacagtttcaaacacccaggtttgaatgcctgtgaatgacccgtcagtgggaaaaagctcaaaaaatgtctctcctccaactgtgcctgcaggaggaggaacaaaaaagcctgggctgctgggnctgggttcattttcatgacttggggcngtcgaaatttaaagtgatgtaanctggggttatgtggattttcttactttcctcngccnnccncngtttaattattttgtcccncanaaanatcnttaaaatatttttttgtta

SEQ ID NO: 481230 - DNA, 246 bp, Homo sapiens
actacttctgtggctgcttctgtggctcgtgggttaaaattttattaatactgggattatgctaataggtttatttcgaatccgattcagatgagtagtcagtgtgagctgattattactagtatggttccggatattactgttatgataagggtagtgtagatacatgagatttattcagtatgggcaagggtatgaacccaacatttactggggtcatgggcccgcatcagcttagcttcagct

SEQ ID NO: 481231 - DNA, 550 bp, Homo sapiens
cggagtacgagaaaggtcttgagatgaagaacataatcacctagtgggtagtagtttacacaggctgatctacatgatcacccacatcagaatcctctggggtccttgtcacaaatgttaagttaggattttgccccagactcatcaaatgactttctaattgtaaagaataggcattttaaatattatttcctgtaatttcaagcatcctaacatgtgatttctcagataactgtattttgaaaaagttcccaccactggttaagaacaagtgcccaggcagggcacggtggctcatgcctgtaatcccaggactttgggagtgcgaggtgtgtggatcaagagctcaggagtttgagaccagcctgtacaacatggtgaaaacccgttctttattaaaaaatacaaaaattacccggggtgtggtaggcgtgtgcctgtaatcccagctacctcaggagaaggaggctaaggcaggagaattgcttgaacctgagaggtacaggttgagtgagcagagatggcgccactgcactccagcgtgctgata

SEQ ID NO: 481232 - DNA, 184 bp, Homo sapiens
tgcggtgagtggtgacttgtctttcccatctgatgtgctctgtactcagccactgcccccagcatacttcttcatggccatttcagaacccctgctcagagccatgtttctctggaagttgagggcagcaggagagcctggatcaatctccccgatccagacctactctgccctcaacttcctg

SEQ ID NO: 481233 - DNA, 1121 bp, Homo sapiens
tgggctcctaaagggggtaaagggggtgcaatggggtaatatacgggccctatttcaaaaattttaagggaaatttaatttcttaggacgatgtgggcattgaaacgtggtggtttgtgcctccacagatttctcaaagcatttgaccgttagttaataccccgcggttcgttgttagccggttgaaaggtggtttgtggttttaaacgtctccgggaactttgtctctcgtgttttaaagcccttatgtgtgtgggcgcacagtctctcagtaagtgtgcaagaacgttctctcgtgtgacgtgttacattatattatattaccaaatgtggcggcgcttctacaacgcgcggaaagttactataccctcgcattgtgggtacacgcgtctcagagagaagtctccgaagtgtttccgccgtgggttctcatcaggaaacacatacagtgggggcgggacacagtttttcttgtcttcagcgaccagtctgtcggcacaagacaaacttccaagaccttcaacagcccgcgtatccgcaccgcagacgtgtggtgataccctccgcaagcagggcttaacccaagatttacacccccacatgctgagtgtagcgcccctccacattctctagacaacttacagacctaggtagcgactaacaacgcagcggcgaagtgacgacaatcggttgacagcaccctctaccctgcacgtggcatatagttcgtattcaaaatcgtgacaattcgccgtacataaagaggaggacacctcgtgtcacaccgtgcacgtcaaatacgctctaacgctgaggccccacatcaagcgggcactgataacgctgtcgcgccgagcgagctcacaggtcgtcacatatagcactccaaccacgacacactgaggcgtcttcgccgatacacttatccccaccgcttggcctgacaatccttctgtatgaacaaaacatctcgtactactaggctataaatctactcacgacctaagaagagtattggtgtcgtcctacgaataacatctacttgtattagatgaggaacccacaaagggagcacaccattagccgaggcgcaccatcatggtgcaaccatcccactaaca

SEQ ID NO: 481234 - DNA, 138 bp, Homo sapiens
gaatattgcggagatttgatccctttttgaaccttgtgatagatgaatgtgtggagatggcgatagtggacaacagaacaatattggaatggtggtaatacgagaaaatagtatcatcatgttagaagccttggaata

SEQ ID NO: 481235 - DNA, 267 bp, Homo sapiens
tggatccccgtgatcttatcgcccaacacagaaacattccaagcctgtgataaactctctttctcctaaaaccaataaaaactcttagtccataggagcaagcactcctaaccaaaaaaaaaaaaaaaattgtccagaagcccctctcaggtttattctccaaaataaacttgtctttgactgtggagccacttttcatgtttcttttctctttctttacttctaacatttggggctgaaacctgggatgggtgttggggataacat

SEQ ID NO: 481236 - DNA, 257 bp, Homo sapiens
  misc_feature (101)..(101): n is a, c, g, or t
gatgcgaggtgactctaaggatcccggctcccactggtagcgtaggtgagttcttcatcaaatacagatttcttcccctgctattgcttctagggcagganctctcactggctcctcctcgggcatgctcgggcccgctgggtctgcgattcctcttcgctagccgttcagcaaacatctgcgcctagaggatatcaaactgagacctttcctctgctgtcatctccccctttttttgtggcaaccaagtagggagg

SEQ ID NO: 481237 - DNA, 359 bp, Homo sapiens
aacatacaggcttctaggtctagccaggccatctagtttagtcgagacagctgtgtaacaaacgtagccttgaggcctggcacggtggctcatgcctgtaatcccagcacttttgaggctgaggcgggcggattacctgaagtcagaagttagagaccagcctgtccaacgtggtgaaaccccgtctgtactaaaaatacaaaaattagccgggcatggtggcgggcatctgtaatccctgctactcgggaggctgaggcaggagaatcacttgaacccgggaggtggagtttgcagtgagccaagattatgccactgcactccagcctgggtgacagagcaagactccgtctcaaaaa

SEQ ID NO: 481238 - DNA, 458 bp, Homo sapiens
cagagcacgcttcgctcagatctcaggcgtcgcttcatttacaagcataaacatttgtcaatacttatggcgtggtttgaggtacagtttggagtaatattatacataacgaagaaagggttcatttttagcttatctaatggaaatttgtggatatagctcagaagctactgtttattgagcatttactgaacagacttaatgctagttgctgtttacagcattttcttagcttcacagcaatatgtaagtaccttaataatgaggacagtgaggctcaaatatgttaagttacttgcctgggctatgtggctagcatgtaacagccccaatttgaatccaaatctgtctggtgccaaagcctgtgtgtttctactgcatcatgttgctccccaataaactggtaacctgagtttaatgttacagagaataagacttttctaagacaaagatttatg

SEQ ID NO: 481239 - DNA, 423 bp, Homo sapiens
ataaagtggcgcttggtatatatgtggtcaaaacgaattagttcataagtggctcccagcttggctgatggcgtccccactgacatacaaaggtaggctggtaaggaactgggacattctgggtagacctttgggagctccaccaggctggcaggctctggtaaagggcatttgaagcacatgtctgggtccaagttgtccataatgcccaacaggatatcagactctgaatctgaagagtcaataccgccagaatccatcggaagatgttctggaggggtgacaactggtcctgcacctgttgcagaggtgcacgtagtctgagtgttgcgcactcagcagacccgaccgctggcctcacttcattccccttggcttccgcctcctgttcagcatccagggcatccatccccaagctctgtc

SEQ ID NO: 481240 - DNA, 925 bp, Homo sapiens
  misc_feature (18)..(18): n is a, c, g, or t
  misc_feature (306)..(306): n is a, c, g, or t
  misc_feature (377)..(377): n is a, c, g, or t
  misc_feature (388)..(388): n is a, c, g, or t
  misc_feature (412)..(412): n is a, c, g, or t
  misc_feature (426)..(426): n is a, c, g, or t
  misc_feature (429)..(429): n is a, c, g, or t
  misc_feature (451)..(452): n is a, c, g, or t
  misc_feature (468)..(469): n is a, c, g, or t
  misc_feature (508)..(509): n is a, c, g, or t
  misc_feature (538)..(538): n is a, c, g, or t
  misc_feature (541)..(541): n is a, c, g, or t
  misc_feature (573)..(573): n is a, c, g, or t
  misc_feature (581)..(581): n is a, c, g, or t
  misc_feature (589)..(589): n is a, c, g, or t
  misc_feature (607)..(607): n is a, c, g, or t
  misc_feature (742)..(742): n is a, c, g, or t
  misc_feature (753)..(753): n is a, c, g, or t
  misc_feature (759)..(759): n is a, c, g, or t
  misc_feature (793)..(793): n is a, c, g, or t
  misc_feature (803)..(803): n is a, c, g, or t
  misc_feature (849)..(849): n is a, c, g, or t
  misc_feature (854)..(854): n is a, c, g, or t
  misc_feature (860)..(860): n is a, c, g, or t
  misc_feature (920)..(920): n is a, c, g, or t
ataaaaacattgattgtnacagctttacatgtttcattccatacacagtgaaaaaggcaaagtattactaggaaggaaatgagtagttgggtttgtcaaagatttattgatcacataaaagcaatgaataggggatgacatatatctaactcatgattaccaaacttttagagacaactaggttaaatatttcatgttttggctaagggaaaagcattcctgttctcgttaaagaggttcaaagtcaacactgatattgtacaactcccagtgcttttctcttggtctggacatttgctatggctngctttcctttttgctagttaatcccttcctatgattgggttttgtttcccggtgggggctaggggggcggngtccttttttnccccctggctacccccgggccctnccttggtggtgggngcnaggctttcccttttgtgttagnnggatggggtgtgtttnngtgggttggctatgtttcctggggggtggggcctattgnncccccccctctgtttgggcggttttgtgnggnggtgtgtctgtgccttggctcactctggcttncttttggnctggcgtncctttggcactcgctcgnataaatagacaagcaaactgtgagactaagctgctccatctgagttgcccatcttgacttacaattcatactatttcttagttcttgactgagcacaaacagaccttaccgtatagcacttctgtgatgcatganaatagaatctngagctnagttactgcgcttcactgatgagccaatcttctnttctgccaanatcatagttacaaatgtgaaattcattcaagaaattcacatttttnacaantgcttntactttttcatgttttcttgctagatatgttcttggttttgtggcccgcttaaatatgtnctttg

SEQ ID NO: 481241 - DNA, 315 bp, Homo sapiens
  misc_feature (210)..(210): n is a, c, g, or t
cctggttcaaagggatcctgattccactgtgcgagtctggcacttgtaccctccggaaggcatcattgtgggtagcatcatcaccaagtgctccatccctgtgttggcactccagtcgggccatgctgaaaattgctgagatggaatacagcggtgcaacagcatctttctgcgactgctgctggatagagtatgcactgcttaccgggngctggatgcctagtttccagtgcctggggttcggacagggagggtgaactcctgctgtgtacagtgcttctgactttggtcagggctaaggccacttggaaaaca

SEQ ID NO: 481242 - DNA, 702 bp, Homo sapiens
  misc_feature (441)..(441): n is a, c, g, or t
gccgtcgcgtttgcacctcgctgctccagcctctggggtcgcgataccaaccttccagcctgcgacctgcggagaaaaacaattacttattgttcttgccccatacagtaccttgaggcgagcaaaagcaagttaaattgttctaacacattgagggaacaattcgtgtcgacaggctccagggctgggtctaggatgtggtctacacctcgaggactcgcagtgctcgacacggtctcatagggagaagtagtggatttccagctgactgcaagtcataggcactcgtgacaccacatcgcgggctaccttatcgcaacgcggtgagcgaagcgagccttggcacgtcagtggaagctcgggcaagtaacctcttggtagatagcatgacagaatgtaagctcatcgagagtggccaagatagtggtctgccttcgatgnccaatccgtggttaggactctacgaaacctgtggaccagtgggacctcatgtatacgactcgaggttaccttattggaccagaatctctctaggactcatgagcaacctttttggtacttttatggtcgagatcgttgaggggcgagggtaaagcaagcattggggcccaagagggcctacgtacgaccaggaaggggcggcctgaagcttggttcgacttcgttgtccttggggacttgttgaggtacgggaaagggaag

SEQ ID NO: 481243 - DNA, 350 bp, Homo sapiens
tacagtgagatggacacccacaatgtcacaatgatagactggattaagaaaatgtggcacatatacaccatggagatactatgcagccataaaaaatgatgacttcatgtcctttgtagggacatggatgaaattggaaatcatcattctcagtaaactatcacaagaacaaaaaaccaaacaccgcatattctcactcgtaggtgggaattgaacaatgagaacacatggacacaggaaggggaacatcacactctggggactgtcatggggtgaggggagggtcgtgtgcactctcaatggcattgagagtgcacacgggaactttgcagattatctaatctttttat

SEQ ID NO: 481244 - DNA, 333 bp, Homo sapiens
aggagctcggtaccctgtctcgcccctctctgaggccagatgcagtggcttacaccgcaatcccagcactctgggagacaaggtaggcggttcacctgaagtcaggagttcaagaccagcctggccaacatggtgaaacccgtctctactaaaaatacaaaaaattagccgggcatggtggctcccacttgtagtcccagctacttgagaggctgaggcaggagaatctcttgaacccaggaggtagaggttgcagtgaactgagactgcgccactgcactccagcctgggtgacagagcaagactccatctcaaaaaaaaatgcatgaaaaa

SEQ ID NO: 481245 - DNA, 579 bp, Homo sapiens
  misc_feature (68)..(68): n is a, c, g, or t
cgctactgcactcaggatgcttttttcccagatcaaggaggtagatatgggcttggctgctgattttnggaaacactgccagagactgcccaaggtcatcgggaaccagagcctggtcaacgagctgaccttctctgcccgcaagatgatggctgacgaggccctggacagtgggctggtcagccgcgtgttccaagataaggacgccatgctgaatgcagcctttgcctggcggctgatatttccagcaagagccctgtggctgtgcaggggtcaaaaatcaatctcatctactcccgagaccattctgtggacgagagccttgactacatggccacctggaacatgagcatgctgcagacccaggacatcatcaaatcagtccaggcagccatggagaagagggacacaaaaagcatcaccttctccaagctctgaatgtcttccggaccctgagagaggaggactccacggagccaggcctcctcccatggggtgtcccagtgtataactttatgacttagttcttcatttcctggggccttatcttcactgtgaacaataaagtttgaacacaga

SEQ ID NO: 481246 - DNA, 197 bp, Homo sapiens
atccccgcttcacaactattgagacatacaaatgggaaggcttctaaacgagctataatgtataaataactgtaactctaaatgaatatcttgcacgtttgtcgaaatttctgcatttggttggaatcagtttcagaaggcttcatgaagttaaatcttaatcagtgctttagggacgagacgatactcttttgcta

SEQ ID NO: 481247 - DNA, 97 bp, Homo sapiens
gtcgacaataaaggagtggttctgcaggtggtgaccacagacaacttctcagttcctatgcttcctggctgatgtttgggtcacttttgaatgctgg

SEQ ID NO: 481248 - DNA, 237 bp, Homo sapiens
ccagaggcatcaaggaggaccacagcacgaggaagaagcctaacgcaacaaggtccacgtgatgcgaaaagggatcgtctctcttccatgataaacgaagattgacacacatcacagcagaggtgctgcaaactcagacagaaagctcagctcccccgcaggaggtagcacgcatcggcgaagcccatctggtggctctaagccagtcagactcgccacacctgagctttctcatct

SEQ ID NO: 481249 - DNA, 530 bp, Homo sapiens
  misc_feature (281)..(281): n is a, c, g, or t
  misc_feature (287)..(287): n is a, c, g, or t
  misc_feature (516)..(516): n is a, c, g, or t
atatatgtgtcccaggatccgaaagatcagcttttactcggaccaacatatgctactccaaaagttttagaaaaggcagggttaaccatgaattatatcgatgcttttgaatttcatgaagccttctcaggccagattttagctaactttaaagccatggattctgattggtttgcacaaaactacatgggtaggaaaaccaaggttggatcacctcctctggagaagtttaatatctggggcggatcactgtctctggggcacccttttggagccactgnttgtcnggctggtcatggcagctgccaacaagactgaggaaggatggaaggccagtatgctttagtggctgcctgtgcacttggaggacagggtcatgctatgattgtggaagcttaccccaaatgactgctctagaaaggaggcgaccgactgatctccttcagcacttgcactgggcaatgccatttccaatgcactacccaagtgatacctgcagttcctagctcttcttangaaacaacatttgt

SEQ ID NO: 481250 - DNA, 377 bp, Homo sapiens
  misc_feature (29)..(29): n is a, c, g, or t
aacagtccaattatattcttggccaattntgtccaaacggacaagaaaaaagccaagtcaacgacaccattatcttggcaagatcagaatgggtttactattggggcagaagcgagaaaactttggttattggaaaaaaaaagaaaaagaaagccagaaaaaaagatactatggggtcaagtgtaacttcatggaaatgccacgtctggtcttcaatgaaaaagctgggttaaaggcttaccgaaaacttttgaccggatttaattaatggtgccagaaccctttttaatggctgccctcattggtcagctaagtatttttcttatttccaaccccgggttccttttaaccatcggatccttcaggatccctgtggt

SEQ ID NO: 481251 - DNA, 490 bp, Homo sapiens
taaagctgtgactggatttcataacaactttatgaggttactttattgactccttttttcttggtgacctccctggtgttattttagctctctgaagctctcttttatgctcctccaaccagcaaactaaggctttatttatatcgctaactctcatttctatgactttgtcatgttcaaggccaagtggttaaagaataaagaaaaatataaccagtgggagttcatccaattttatgttaatttcatataaattgtttcagtgcaagaaaacctacctatgggttctttatagagcaatcagtggttaagagcactgactgcacttctaaaggacatggttcactccagcaccctcatgtcagctaacaaccatctgtaactccagtcccgttggatctgaagccctcttctggactctataggcacaaggcatgcccagggtacataaatttgcattcaggtaaaaaatccatacatatcatttttt

SEQ ID NO: 481252 - DNA, 414 bp, Homo sapiens
  misc_feature (37)..(37): n is a, c, g, or t
tgtgtctggggcttgttcatttcttactttacttagncggcttcaagtctttcttagaagcaaggtggatatacattgaacatgactttgggcatgtcacttagcccttaacctgcatgtcctcttctctaaaatagaggtaacgtcacgcctgagtactcatctgctaaggttgtgcaaaatcaatgaaatactaccacgtaaaaggagttttcttcgtaagtgtatacacctactatgtacccacaattttttaaaagtagtcctttacttgaaagttattaaatagttgtgtgagagaatctttcttttttttgacacagggtcttattccattgcccaggctggagtacagtggcacaatcacagctcactgcagccttgatctcctgggctcaaggacatcctgtgtca

SEQ ID NO: 481253 - DNA, 137 bp, Homo sapiens
  misc_feature (9)..(9): n is a, c, g, or t
  misc_feature (62)..(62): n is a, c, g, or t
  misc_feature (106)..(106): n is a, c, g, or t
  misc_feature (108)..(108): n is a, c, g, or t
gcgttagtntcaaagctttaccaggagcagcctgggttcagccagtcagtgactgctgggtntgaatctgcacttatccccaccacctggggacccccttgttgtntncaggactccccctgtgtcagtgctctgct

SEQ ID NO: 481254 - DNA, 151 bp, Homo sapiens
tcatcgagctcggccccgggttgaatactattgccgtctactctttttttttcttgctttctttctttctccatttctctttgtttttctaccatgggctctaaattaggttctctgggttcaattttctcctctaatttttcccttccct

SEQ ID NO: 481255 - DNA, 642 bp, Homo sapiens
ggccccgcggtggcagcaggagcagctggtgcccatcctggagaagttttgcttcactccccacacggaggaggggtgcctgtctgagcgcgctgccctgcaggaggagctgcaactgtgcaaggcggctggtgcatggcactgcagaccaagggtgacccagcatgtgggctgaagactggtggtgcccggactggatggggcccagagtcccccgtggacccctcacagcatggaactgccccggcctgttgtcggctgcctgcaaggcttcagctcaacgggaacctgcatgctggagctggcgcaggtgctggcccaggagaggcccaacgctgccatgatggaccctctgctcagcggcctcctggactccccggcactcaaggcctgcctggacactgccgtggacgaaacatgcccagcctgaagatgaaggttggtggaggtgctggctggcactggtcacctgtattcccgacatcccagtgcctgctcagccccatcccctgctgcagctgagctacacggcaccgactgcaccccaggccctggaggctgcccaggccgagctgcagcagcacgacgttgtccaggccaagtgggatccgcagaccctgcccagcgccttgggaggcgact

SEQ ID NO: 481256 - DNA, 112 bp, Homo sapiens
atccccctaatgctgctcacatattttaactttgctattcagtgactcagagcttccacacattgatatctgaatggggtgcactgacaaagacacctgttgtggaaggtaa

SEQ ID NO: 481257 - DNA, 258 bp, Homo sapiens
aatagtcagagataatggtagtgctggttgcattacaatgtgaatatacttatgccactcaactatattcaaaatggttaaggtgcgtgcttatagtcccagctactttggagagtgttcaggagaccgtggggaagtctagaaaagagaagggagaggtaagcggtagacaagcgattcagatcgggaagttccgtggatctgaaaacagaataggggggtcccgagcggaaaataaagccctgaggcatgacaaga

SEQ ID NO: 481258 - DNA, 534 bp, Homo sapiens
  misc_feature (331)..(331): n is a, c, g, or t
tgtgctgaggtcgatctaaggatcccccatgtgggcatcactgcactctacgggcgacagagtgagactccgtctcaaaaaaaaaaaggaactcaggttgaggcccagccggcggtggtttaatgagcttttcaggggatacggatgcgggatcaaattggagaagcacgggtctaggtcttagatcctctggcttcagttccgtcatgggatctcaggaatgttcagctgccctctcagggcaacttcttacttcactggaccttccaagacctctcgttcggtcaaaccccaatttgggatcaacccaggcttgcttccctcaggtgtnccaaagcgggtcagagtagtctacaccactatcggcttcaacttctagtaacgtctaagcctccagcagttgtgcttatgaaacggcttcacggaagttctccaccaccaagtagtcagcgggcatcggaattcggcttgtgtcaaagggaactcaacatcttcctcttcaggacatcccctattttaatcctcccagtgatg

SEQ ID NO: 481259 - DNA, 502 bp, Homo sapiens
  misc_feature (23)..(23): n is a, c, g, or t
  misc_feature (141)..(141): n is a, c, g, or t
  misc_feature (143)..(143): n is a, c, g, or t
  misc_feature (362)..(362): n is a, c, g, or t
  misc_feature (365)..(365): n is a, c, g, or t
  misc_feature (368)..(368): n is a, c, g, or t
  misc_feature (371)..(371): n is a, c, g, or t
  misc_feature (376)..(376): n is a, c, g, or t
ggacgcgtgggctgaacttccancttccatccaccccagctttaccagacaccatggagaaggtccttgttcttctgcttgtgtccctccttgcagtggcctatgcagctcccggaccccggggtcttattatcaacctgnangacggtgagatctgtttgaacagtatgcagtgtaagagcagatgctgccaacatgacaccatcctgggcattgcccgttgcacacacaaggccatggagaacagcgagtgctccccaaagaccctctatgggatctactaccggtgtccctgtgagcggggcctgacctgtgagggggacaggagcatcatcggcgccatcaccaacaccaactatggnatntgnctngactncaggcgctccaagcagtgagatcacgcagttagctgggttataccttcttctctttctccctctgtcccatctgagccagccagctgttggcaattaaaacccacttgcaaccttaaaaaaaaaaa

SEQ ID NO: 481260 - DNA, 851 bp, Homo sapiens
  misc_feature (33)..(33): n is a, c, g, or t
  misc_feature (48)..(48): n is a, c, g, or t
  misc_feature (227)..(227): n is a, c, g, or t
  misc_feature (233)..(233): n is a, c, g, or t
  misc_feature (264)..(264): n is a, c, g, or t
  misc_feature (392)..(392): n is a, c, g, or t
  misc_feature (480)..(480): n is a, c, g, or t
  misc_feature (515)..(515): n is a, c, g, or t
  misc_feature (546)..(546): n is a, c, g, or t
  misc_feature (645)..(645): n is a, c, g, or t
  misc_feature (652)..(652): n is a, c, g, or t
tttttaaattttgttatagagacaagagtctcncttatgttgctcagnctggtctcgaccccctggcctcaagtgatcctcccacctcagcctcccaaagtgctgggattacagatgggtgtcaccgcacctggcctctgaggaggatttcattataaacctgccctgaagggagggaatccaattttacgagagggtgtagcctggtgaggcctggatgacctccngaggcnggggcttgtgcctgggctgaggcctaagggncaatgggcagacatgaagttgccccaggcagagggtacagtgtgggcaaagtcaggaagtggcagggcttggatcactccaggaagagagaggagtcatgtgtcacaggagctcgagacccagagagngaggcagggaggcagggaccaagcttgggcacagcaggaaggcaggacagggcatggtggggccaatggaatcattacccaagacggngattttcagggaaacagcttagataaggccaggcntacagtagctcccacctgtaatcccagcatntggggaggctgaggtaggactgctgagcctgggagctcgagaccagcctaggcaacatagtgagaccccatatccataaaaaatttaaaaaaggagttngtgttcntgtagtagcagacttgggaggttgaggtggcagtatcacttgagcccgggagttcaagcctaaagtgagctgattgagccattgcactccagcctgagcaacagagagatacgctgtctcaaaggaaatacaaattaaaaaaccaggcgggtatgctggcgtgtgcctgtagtctcagctacttgggacactgaagtgg

SEQ ID NO: 481261 - DNA, 875 bp, Homo sapiens
gatcgcttgagggcaggagttcgtgaccagtcctggtcaacatgatgaatgccttgtctctactagaagtgcagaaatgggctgggtgtggtggcatgtcgcctgtgtgtcccggctactcgggaggtctgaggcagcaggaatcacttgaaacctggagggcagaggtttgcagtgggccaggatcgttgcagtctgcactccggcctggtgcgaatagagcaaaacttatgtctcaaatagataagactcttttcaagttttctaccctctgatcaagacaaatttggggatatccagtgccatctccaaggactttcaggggatcatagatgcttttctgtgcctatctgctttgagcatgtgaaaaaggtgatagtctgcttctctctggtacttgtctgccaaccatctgatagtaagattacgccaaggcccttgagccctctgtccttctctggttatgtgactgtcccatggttcctaggaagacagagtatgttctccgagctaaagtcgtctcctctctataacgcagtttactagtgtcttttcagtagcagtgagccaaaatagtagaggaggggagagaggcacctggaactctgcgggcctgcatgcggaaaacgtgagccagaagacgaatcatggtataacgatattgtattaacaggagagcctctaagttccacgatcgtgaagtcccactgttgcagtggccaccaggacggtaaaaacggtgggtccagattgctgtcatctgaaaggcctcagcgagatgaaagctatcagtaatcaggctgaaggcttgtgggtctggtgccaccaccacgttagcaccaggccctctctggtccagaggctcatctctctgg

SEQ ID NO: 481262 - DNA, 117 bp, Homo sapiens
atactggcatttgggaactgtatggatactccaaactgacttctttcaaaaaaacaaaaacaaaaaatttttttagctttgacaaacacacaaaagtggtaataaagagagccctcc

SEQ ID NO: 481263 - DNA, 352 bp, Homo sapiens
gtgttgaatgtggaaaggaatcaactgacacatctcccacgctctattgggaactgcttcagctccagaccctcagtgtgaaagaggcccacatgtggctgatggcaagtaggggtgtcctgagttgctcagccgagaagcagtggcagagcctcccagccccacatcccatggcatcaggaggcagcagaagctttggggcactgagtttgccaccggggtccctgcagacaacaggctgaaggaacttcccgacaccctgggagagctgcgaagcctgcgtaccctcgacatcagtgaaaacgaagttcggagactgccgcagatgctggctcacgtgcggaccctggag

SEQ ID NO: 481264 - DNA, 263 bp, Homo sapiens
gagcctgttcccttattggtgagttggaggttagtgcaagattttatccaagtggaggtttatccatctgtgtagccacgggcatgtctccaggcacaacgccacgtgctagttcccttactggttcctgcagcctgatttccccccaccccaggctgctttctattttacgtggggataaggctctgaccttgggccgggggctctccaggggctcttcccttgctgtctacctaaggcaagctaactcctttcgtcccccg

SEQ ID NO: 481265 - DNA, 206 bp, Homo sapiens
gtgttgaatgtggaaaggaatcaactgacacatctcccacgctctattgggaactgcttcagctccagaccctcagtgtgaaagacaacaggctgaaggaacttcccgacaccctgggagagctgcgaagcctgcgtaccctcgacatcagtgaaaacgaagttcggagactgccgcagatgctggctcacgtgcggaccctggag

SEQ ID NO: 481266 - DNA, 240 bp, Homo sapiens
ctgctggtcgactctacgacggactccccctagggactgtcttctcagctgtggcattcaaatggcttttctgcgcttgtgtgtgtgccttatgcatgaaggagaaaggccacagtggttgtggcagagaggcaggtgctgtggtcccttccagggaagtggcaacatcatttcttttcctacccatcccatctctgaccagacaagctgccttggcgccagtctactcgcagaagacat

SEQ ID NO: 481267 - DNA, 1615 bp, Homo sapiens
  misc_feature (887)..(887): n is a, c, g, or t
agcgggtcggggagagagtgtacctatggcgaagacctagcgattacctgttgcgagctgatggtgactcggcggactcggggtgtcgggtgaacgacctgtgtcctgtgccgcgttctaccgtagggacgccattcaagcatccgagcattattatctccaccgcgatagggaatggactttacatagtgtatggacctattacgtacgcttcagaatagcgctagaagagaagttaagacctgcagtagtatgggtgaccatcgatgcacggctcatagtacacgggtttccggaccgaatgcacgaagcgggcactcacttgcgaagggagtgcgagtaggtgcatctactgcttgggtccgactgagcatcagaccatagcggaggaaaagtcactttccgaactaatccagtcgcagagagagcgtggaatttcgaggaaagaaatcatgaggcgaaagcagacggccattctggcatgaaccgtcagggtgagaattgactcacctccgtgggaaaccacaggttgttgaattgtttgagatggcatccgccagaggacttaacgttttccagagggtaaacggggcagcacaaagtcgtgggggccctacgacttcattggtagagtcccccgtgtccatgtggacgagccagcttgcgaaaagagtccaattattctactcgtggagatgaatgggattgtattactacttgctacgggcaaggcaggattattcaagaaggcatagatactgtggtctagaaatggtttggtaccgggaaaccaagtccccccgagggggcattgcgaagcgcaagggacgtcgcagaaatccacggggcggggatccgaggccatgaaatggagggaagcgcacgtntgtttttccccgagtgtggtcgtgtctgtgtccttggtggaaaggcaaccatcgggggttgtagacttcctgggaggcccttcgggttccaaggcccagaggttggggctgtgggtgcccttgggtccttggaggtggaggcccctggtagattccaggccgggggggccttcccccaaccatcgaaaagggcccagggggcaggtcccgggggacccacggggggccgacaggggccagcgcagacaactggcaagtggacacacatccgggtcactattaacgacttaccaggcgtgtagacaccttctgcaacacccttgggggagatgcgcgcgaacggtcacacaagtatggcaatcatccccgggtaacaaacatgggggaaaggagcggcccacaccacaagggggacactattacaaaaagacaaaggagaaaagggggtggaagcgacgaccaaagccaggcgtggggcagcgccccaggacataagagtgggcctcctagggacaacacgagtccaaccgagtggtggataaacacccctccacaccgacgaggggctccaacaacaacagggtctgctacaacactccagccactgcaatgagcaacacagaggagacgaatacgacgacaaggaagcgacaatccacccgtgctctaggcgcaacgaaaacaccacagcatatgagtggaacgaaacagaaaaggaggaagcatac

SEQ ID NO: 481268 - DNA, 189 bp, Homo sapiens
attgttcgcaactcaagctcgaagttacgcgcagatcacgccggaggaaaatcatccccgacgtggacatcaacaaggacagccggggagacacgcttgctggatcgcgatcagcaccaagcaggtgaagacccaggtactgttcgagaacggcggcccggtgttaatcggcggcgtcttcgagcaggt

SEQ ID NO: 481269 - DNA, 836 bp, Homo sapiens
  misc_feature (251)..(251): n is a, c, g, or t
ctcttgtgccccgtcgtatgtagtggtgtcccacacagagggtgcctcgttattacccccttcgtggtgcacacgacaccaccacagatgatgggtaggggccaacatcacatttgtgctgagagggcgctgcaccagcggcgtgctcctcgtatgcgggtcgtttttttgtcgggtgatgcgaccacaccaccaccccacatgggctcaccagtagtccacccccaacatttcttgcgggtacgagtttntgcgccaccacaacacttcggggacacagagagccccaccacgtgtttgttgtggtgtgtgagtatgttcgcctagacacacttttctcccacgcgggagagagataacaccctctgtgtcacagagatactctgttcacactaacacgagcgtgaattatacctacgtagactccacgcaccccccttcttcacacacgcgtgatacgtgatagcgtctctctgtggtgggtggtgtcactctgtgctctctgtggtctgttcactctcgagaggcgccacgcggtctggtgaggcgcgctctctgtgaggacactgtgtctccctctggtgtgtctctcccgtgtgcacagctgcgccacctcgtagtattccaccacgtgccccgaggtttcttcgctcggttttgggcacattataacctccctttcctactgggtgttagagctaccaccttagcacacacaaggaaaatgccccttcgtgtgaccactaagattgagatttatacccaccataccacacatagcccccagaacatcattttgcactcaagaagagttttggaccaaaaaaataaaaaaa

SEQ ID NO: 481270 - DNA, 168 bp, Homo sapiens
gccaacttcatagattccggtgttccttgtatagtccaacagcctacttagtgtacctaatggatattcgtctggaggagcagtagaagaaaagcacatatgatattgcccaagcagccagcctgtcgtggattgatccctgaagttcgacgactacaacattcatct

SEQ ID NO: 481271 - DNA, 1652 bp, Homo sapiens
  misc_feature (979)..(979): n is a, c, g, or t
tttatgataatggttgttgcgggctcgtatctgtgtggtggtgtggtcgttgctactcccctcttcttggctttgtcgttgtgatggtgtgtctgctcgctgactgtaagtgcgatcctgctccccccgctcggctgcgtgtgtggcgtggactgttgttgtagcttgacgacgcccagcggctcgcgtctctccctcctccttgggatgatgagcaaattattggggggggtgttttttttttttgtagaagaaattctctattctttgtgtccgcctgctggttcgtcttccccgtccgcgggggtattgtttgtggtttttatgtatcgcgccgcctccgcgccggccttcctcttttggttggtgtgtttatagtagagaggcgccgcctccgttgtgtggtgatatatatgttttccgccccgccggtttcgtgccctcgtccggtagagattagtgtttcgcccgcccccgtgtggaggttgttgtgagaggacacccacaccaccttttgtaggtgaggggcgggggccacacgaatttgttgttctgtcccccccccttgtgcggtgtagagggcaccatgtgatgatttataatagggcgtctctggtgtgtggtgtaaacagcaggatgttggattgagtattgcgccccctctcggtcgcggcggaatatttgttgttgataggagagcgagctgagggctgttgtggaagagatgactagaacaacgagtggtctgtggtgtgtcgtaggatatgagggtgtgcgtgatgatttgtgtgtccgccgcccgcccgcgttttacacacacttatgaggagaagaagaaagaaaaagagaggtgtgtcctcccgcacaattagcgcgccgctgtgtcctacagagacaccctcgcggcggggttttatatatataccacacgcgtcatctttgtagagatatgtgtgtttaagcgctctatgtgtatagngctgtgcccgcagcacattgtggtgacgacacatcatatagtggggcggcacacccctcgctctatatttttttacaaccagcgcgggagagatatatttctctgagagacccacacactgtgtgtgtgacgactatatgttttgtgttgtgtgtactacatagtagtgtgtgtggagagaaatatatagcctccctccctcgccactcttgtgataagagatagtatgtgttttgtgagagacagacagaggcacacactgtggagtagtgtgtgagagatatatatattttttcggcacgaggcgcacacaaagagatatatatttgtatagagagagagtgtgtgtgttgtttagtatcttttcacacgagagagtgtcaataataacacacgtgtagaggcacgcacacactttgtgaggtgtgggtcgttatatataacacacctctctagagagaagaaaaataataaaattgttaatttctttatgccacaccttgtgttaaaaagttaaaatatacttgtgtttgtaaagccctgtgttctcacacacaatatcgccctaaggtataagggagaagagaggagagagagagaataaccacaccccacctgtgaaaagagatgggtttccaccttttttgtatatgtaaaaagtaccccgtgggga

SEQ ID NO: 481272 - DNA, 121 bp, Homo sapiens
  misc_feature (106)..(106): n is a, c, g, or t
ctcaaggctttatacttcctacaaacaggtctcccttctggaatcacatctctggttattgaaactctaaaaatacgagagaattagccgggcacggtggctcatngctgtaatcccagca

SEQ ID NO: 481273 - DNA, 313 bp, Homo sapiens
  misc_feature (104)..(104): n is a, c, g, or t
  misc_feature (177)..(177): n is a, c, g, or t
  misc_feature (191)..(191): n is a, c, g, or t
  misc_feature (209)..(209): n is a, c, g, or t
  misc_feature (216)..(216): n is a, c, g, or t
  misc_feature (244)..(244): n is a, c, g, or t
  misc_feature (287)..(287): n is a, c, g, or t
  misc_feature (289)..(289): n is a, c, g, or t
  misc_feature (302)..(302): n is a, c, g, or t
gagagagagagagagagagagagagagagagagagagagagagagcagggccggggcagcccctctctgcccagggaaggcaccgtcctcaaagacaaggcttngccgggcagtggcttccctgagcggaggggtggcttgagcaggacacttcttgcccttactcaaaaacgaaanaaccgttttccagnaggcgtcggggggaacgnctgacgnagacacaatcgttatgttctcaattgtnttcctcctcttactttctctcctgcctggtttggacaagccantngcattcgcccttnaggtcctcgca

SEQ ID NO: 481274 - DNA, 254 bp, Homo sapiens
aacgatgtcctcactaaaaatacaacaattagtggggcatggtggtgtgcacctgtaattccagctacttgggagacagaggttacagtgagctgagattgcgccactgcactccagcctgggtgaagactgtctccaaaaaaacaatgttatgggctaaaagaagtcatactgcgggattgtccgtggaggggatgggaatcaagcaccagcagttatattgggattgcctgcctccagtcagctgtggagag

SEQ ID NO: 481275 - DNA, 309 bp, Homo sapiens
acgtgcctgtagtcccagctacttgggaggctgaggcaggagaatcacttgaacccgggaggcagaggttgtaatgagctgagatcacgccactgcactccagcctaggcgacaagagcaaaactctgtctcaaaaaaaaaaaccccaaaaaaccaaaataaataaaataaaaaataaaaataaaaaaattggctgggcgcggtgctcacgcaataatcacagcacttagggagaatgaggagggccaataacctgaaaacaggagtttgagaccagcaatgataaaagtggtacaaactccagaaaca

SEQ ID NO: 481276 - DNA, 319 bp, Homo sapiens
atctgagactaccgactcaaaagttaacttctctcactgctacaaatgatagcatcgagaatggtaattgcagctagtcatgagtcggctcacgcctgtaatggccgcactttgacaggctgcggcaggtggattacctgaggtcaggagttcgagaccagcctgaccaacatggaaaaaccccgtctctactaaaaatacaaaattagccaggcgtggtggcgcatccctgtaatcccagctactcaggaggctgaagcaggagaatcacttgaacccgggaggcagaggtcgtggtgagccaagattgtgccattgt

SEQ ID NO: 481277 - DNA, 322 bp, Homo sapiens
ggtaactgcgtgcagtgtcttgccttgctttctcttcttactgcaccacagcttggtttcatgttacaaaaagaaaagctggaggctcccaccccgccacatccaaatttcatttccccctgtagtgtagcccatttccaccccaccaaaaagttgccacaggttttctttgaatagaatatttattgggaagctctattttaatagtttttatttaagaaagtctactatgggaagagttcttctgtttgagaagaaaaaaacaagttaaaaactgaatgtactgatttagaaaatatatataaattttttttgttaaata

SEQ ID NO: 481278 - DNA, 411 bp, Homo sapiens
atagcgggaccaatcacttgaaatcaggagtacaagactagcctggccatctctactaataaagacaaaaattagccaggcgtggtggtagtacatctagtaaccccagctactacagaaggccaaagcacgagaatagctcgaacccgggaggcggaggtatgcagtgatactatgtgcctcagcctcccaagcagatagggattacaagtgcgcgccatcaagcaggtagcttatgtatatttagtagagatgaggttactccatgttggccaggccggtactcgaactacctggcctcaagtgatctgcccaaccttggacacccaaaatgctgggataacatttgtggggccacaatgcccagtgctaactattaaactattacttataacttatgtgcactggagt

SEQ ID NO: 481279 - DNA, 245 bp, Homo sapiens
ctggtctgcggcgagtcgatgcttgagttgtgttgatacgtgaaacgcaggtttgctgtcctgttctttcctcccacgactcttccttttgcctgactatcatgatctcggaatcctctctgcgtttgaaatgcagagaggatcagcaagcaggagtatgacgttccttggtcaacgcgagaacctcttggtttcctttcagcgtatgcgaacaagagtggtgatagcgcctactctctgcgtat

SEQ ID NO: 481280 - DNA, 105 bp, Homo sapiens
ccgatgcttagaaagcggctcggggggggcatcatatagtcactccaggtttatggagggttcttctactattaggacttttcgcttcgacgccgctgttacctg

SEQ ID NO: 481281 - DNA, 685 bp, Homo sapiens
  misc_feature (483)..(483): n is a, c, g, or t
  misc_feature (685)..(685): n is a, c, g, or t
ggagaaatcaaattcggcaggtcaggctggtgcgacttcggcaccgagggttagtcacgctcggagccatgccgtcaagggccgctgcagtctgtgcaggtcttcggacgcagaagacagcgacagctgtggcgcactgaacgcggaatggtctcataagtaacggcggcccttgagatattgagccgcgcacgctaccagtacaagctgctgagccagttctgcttctcggcaagagcgaattgctgtgtaacatccgtgttcgtgtaagggtggtggtcacgtgccagattatgctatcgtcagtccatctccaaagccctgtggcctattaccagaaatatgtggataggcttccaagaaggagatcaaagacatctcatccagtatgaccggaccctgctggtagctgaccctcgtcgctgcgagtccaaaaagttggaggcctggtgcccgcgctcgctaccagaaatcctaccgatnagcccatcgtgactcaaaactcccttgtatataacagtttttgagggatttaagtttcaaacacaaaacccaaaaaaaaaaaaaaaaaaaaaaaaacgcggcgttttttgttgggggggcgggaagggcaggttttttcgacccttttgtaaaagggaaaaggcggccccattggggtttttttaaacgtatatatataaan

SEQ ID NO: 481282 - DNA, 114 bp, Homo sapiens
ccgatgacctctagggatcccaactgtaccacttatggcctgccgtccttacacaacttcttcctcctcttcatcatcactgaactatcagtttctcagaatagtccacttctt

SEQ ID NO: 481283 - DNA, 134 bp, Homo sapiens
ctctagcacgatcccatcgtgcaagccctgggtccagacaagctggtgttgggttactgcaggtaattcccgaatgagtctcagtgggttttggtttttgcatttggtgtgagcagatcagtgaggtgccatga

SEQ ID NO: 481284 - DNA, 144 bp, Homo sapiens
tgctcctacccttatagactaacaacaacaaacccattagcttagcatgggtggcatgcgcctattagtcccagctatttgggagtgctgatgtgggagaatcacctgagcctgggtgattgaggctaggagtgaatgatgact

SEQ ID NO: 481285 - DNA, 242 bp, Homo sapiens
  misc_feature (47)..(48): n is a, c, g, or t
  misc_feature (95)..(95): n is a, c, g, or t
cttgggagtccggggttggaggtgctgggcaatggaacttcaaattnnatgtcgcccagcagtgaggggagtcgggaggtgaggcctgtagcaanccaatttggtggagtccagcgataccaggtgagaagtggttcaccagagggcaagggtgggggcctcggcagatctgtcctcttggcccctctgtcctcaaatgtccaaaatgttggaggacctctgttcatatccacgcctgggcc

SEQ ID NO: 481286 - DNA, 199 bp, Homo sapiens
tcgagctcgcccactgtgtgctcagtgtattccttacgaccctgttgtgtgaaacataacattggcatgtcgaggagtcagaactcggattcccagcctcactcgcctctgtgtgtgttgaccacgtctctgctgtgaataggcatttcatgcagtgtgtcttgttatggagcacacagtgtgggtgatgggggatccg

SEQ ID NO: 481287 - DNA, 476 bp, Homo sapiens
cgaataacgaagcgcatcatttctgatcaagtccggcaatttatctgtcgttgtgtatccttgctgaattccccactcgagaactagggcagcaaagatattcaaaagctcaaagcccctttcaatgaaagaccagagatatttgcaggatgcggaggtgccttcgcctgagcttaaatcccagcaactaacccttgacaagtcatgaacgatatcatttctcatatctagataagtattaagtttttcggacagatcaggatctaacttcgcccgccggcggacttggtcaagaaagtaccctaaaggtttctttcgctctgactgattcaagctatgaagcttttcaagagtcaagggaccctctttttgcagaacatatgtcgtgcagaagcgcatcatactctcgacagactgagcatggatgagcgcacggccaaggaggtgataaggatcttcgtccggaaagtctctct

SEQ ID NO: 481288 - DNA, 98 bp, Homo sapiens
gcccgtgtggcctcggtggacatgggtcctcagcagctgcccgatggtcagagtcttccaatacctcccgtcatcctggccgaactggggagcgatcc

SEQ ID NO: 481289 - DNA, 406 bp, Homo sapiens
gtggtggctcgcgcctgtggtcccagcactttgggaggccaaggtgggaggatgacaaggtcgggagttcaggaccagcctggccaacatgctgaaacctcacctctactaagaatacaaaaattagctgggcatggtggcacatgcctgtaatcccagctacttgggaggctgaggcgggagaattgcttgaacctgggaggtagaggttgcaatgagctgagatcgtggcactgcactccaggttgggtgacagagtgagactccgtctcaaaacagaaaagaaagtaaataaaaaaaaaattgtttttaagtgtggactcttgaagtcagtcccaactcggccatttactagctgtgtgaccttgggcaaatttctcaatctctctgaagcacagttgggtca

SEQ ID NO: 481290 - DNA, 521 bp, Homo sapiens
  misc_feature (1)..(1): n is a, c, g, or t
nctccgacgtgtcagcataaatcagtaattcattcctttttattactaatagtccactgaatgtatagaccacattttgtttatccatttgtctgactgatggacgtttgtatttgtttcacctggtagttgtcatgtaatagttctgctacaaactgttgtgtacaaatatcatttgaatacctgttttcagttcttttgcattatctacctaggagtggaattgctagctcatagggtaattctatgtttaacttcttgaggaaccaccaagcaattttctatagccagtggctgcaccattttacattcccaccagcaattccagtttttccacatctttgccagcgccttttttgttgttgttaaatgataaccattctagtgggtgagaagtttacctcactgtggttttgactggcacttccataatgattagtgttgttaaccatcttttcatatgcttgttgaccatttgtatatcttatttggagaaatttgtgttcacgtcctttgcctgt

SEQ ID NO: 481291 - DNA, 810 bp, Homo sapiens
  misc_feature (4)..(6): n is a, c, g, or t
  misc_feature (8)..(10): n is a, c, g, or t
  misc_feature (12)..(14): n is a, c, g, or t
  misc_feature (17)..(17): n is a, c, g, or t
  misc_feature (691)..(691): n is a, c, g, or t
  misc_feature (699)..(699): n is a, c, g, or t
  misc_feature (715)..(715): n is a, c, g, or t
  misc_feature (717)..(718): n is a, c, g, or t
  misc_feature (725)..(726): n is a, c, g, or t
  misc_feature (729)..(729): n is a, c, g, or t
  misc_feature (738)..(738): n is a, c, g, or t
gctnnntnnngnnngcnggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactcttaaaatcaccagtgctgtttggggaccccctgggggagtgcatcatcgctggccatgagagtggagagctcaaccagtatagtgccaagtctggagaggtgttggtgaatgttaaggagcactcccggcagatcaacgacatccagttatccagggacatgaccatgttcgtgaccgcgtccacaggacacacaagccaagcttttgantccacaantcttgaacatcagaanannttccggnnagnaagtccgtnaatcagtggccctccccatatgacctttggccccggcggggttcgaaaccttgtttccccacccccacgttg

SEQ ID NO: 481292 - DNA, 670 bp, Homo sapiens
  misc_feature (605)..(605): n is a, c, g, or t
  misc_feature (617)..(617): n is a, c, g, or t
  misc_feature (657)..(657): n is a, c, g, or t
  misc_feature (667)..(667): n is a, c, g, or t
gatggttattatttctggagatacttgcattaaacattcctttttatgacatttgatgcaagtgtacaactttaaaaacagagttttcgtatttttgaaaaagtagtggttgaaatgtacttaaattattatgtagtttaaataggactctttactccatgtgtttaagaataaaatcttttagttagcagaaggtgataacttaaatcaggatttctcagtcttagcactgttgacattttgggccaaattgtactttgttgggtgtattggcctatacattgtaggatggttggcacattcctggcctcttcctactatttaatagatgccagtagtaccctgcagttatgacaagcagatatgtccagatattgctgaatgtctccaggagaggggacaaattcctccttggttgagaattactgttataaatagatcggtttaaataatagtagaagtgtccactgaatttcatttatttttgcattaacagtcttttgaaaagactagtatgtctcaagctcgaggtttatttaatggcaagtgctttaacttggttctgacacttgtggtccaatatagagtgcccatagaccaagagnctttaatctganccccaaagaattcattcagatttagccttccagccccctnatataagacncag

SEQ ID NO: 481293 - DNA, 280 bp, Homo sapiens
  misc_feature (4)..(6): n is a, c, g, or t
  misc_feature (8)..(10): n is a, c, g, or t
  misc_feature (12)..(14): n is a, c, g, or t
  misc_feature (17)..(17): n is a, c, g, or t
gctnnntnnngnnngcnggccttcctcgcgtcacagccgggatgaagccgatcctactgcagggccatgagcggtccattacgcagattaagtataaccgcgaaggagacctcctctttactaaaaatacaaaaattagccaggcatggtggcacacgcctatagtcccagctactcaggaggctgaggcaggagaatcacttgaacccaggaggcagaggttgcagtgagctgagatcacgtcattgcactccaccctgagcaacaagagcaaaactcc

SEQ ID NO: 481294 - DNA, 234 bp, Homo sapiens
atgagcgagcggatgcgtgcagtgctcagtgaccatgggctgaggctatggtgacgcaggtcaggtgcacggactcgaagggctgggaggaaaccttgtggctggagcccaccgtcctgacttggggaagattttaagtggtggacacctaatcaagaatcgatcgacactgccccgtttatgtcgcagcgtgattatatgtctgtaactgatgaaaatgaaatacattggctt

SEQ ID NO: 481295 - DNA, 385 bp, Homo sapiens
gggtgctcagtaaagctaaaatatcagcctgtattgtacaaaactccaggtgacacaaaataaactacgagagtggttttaacatatctgaacacacaatagctaatcacccagaaacgtgggattagataccccattatgcttagccctatacctcaacagttaaatcaacaaaactggtcgccagaacactacgagtcatacgcttataactcatatggacctggcggtgcttcatatccctctagaggagccagttctgtaatcgataaagccccgatcaacctcaccacctcttgctcagtctatataccgccatcttcagcaaaccctgatgaaggctacaaagtaagcgcaagtacccgagtacccatctctgcttgac

SEQ ID NO: 481296 - DNA, 250 bp, Homo sapiens
cggggaagtacaaactaaatctgttttggatagaatgttggtgatagaaatgaatagagaaagaactgtattatgaaatagagaagacaggcaaattaaaggatacagtatactaactgccaaggaaggcagccctagaaagaaaatgtcaaggctgggtgtggtggctcactcctgtaatcccagcattttgggaggccaaggcaggtacatcacctgagatcaggagttcgagaccaggctggccaac

SEQ ID NO: 481297 - DNA, 133 bp, Homo sapiens
ctgttccggggagagggtgagagtcgtaaggggcaatagcaatagagattacactgtgctgactaaaacactctgttctactgagacgtcgaataccgtaccttcgtggtacctaagttttaattggtatgta

SEQ ID NO: 481298 - DNA, 304 bp, Homo sapiens
  misc_feature (266)..(266): n is a, c, g, or t
  misc_feature (293)..(293): n is a, c, g, or t
tagcagggtagacaggtgaagtaactggatgtgtatcagccatgccctttccccatgcccccggcactccccattcccacattcttttattttcacgtacttactataggccttgtaggggctcttgtgaacacagacaaagagccaaggtgctgtggctagatgccatgtaattcccaaatgcatttgaggaggcatagggcatattgagaccataccaagggtaacaaagacaaagacccgtgtctcgtataaaaaaataaaanattacccggagtatggtgggtgtgcanaaaaaaaaaaa

SEQ ID NO: 481299 - DNA, 203 bp, Homo sapiens
  misc_feature (39)..(40): n is a, c, g, or t
  misc_feature (69)..(69): n is a, c, g, or t
  misc_feature (92)..(92): n is a, c, g, or t
  misc_feature (99)..(99): n is a, c, g, or t
  misc_feature (113)..(113): n is a, c, g, or t
  misc_feature (116)..(116): n is a, c, g, or t
  misc_feature (140)..(140): n is a, c, g, or t
  misc_feature (153)..(153): n is a, c, g, or t
  misc_feature (159)..(159): n is a, c, g, or t
  misc_feature (163)..(163): n is a, c, g, or t
agatgaaattcccgggcgtctaaacaaaacccactttcnnccgctacacgaccgggggtatactacggncaatgctctgaaatctgtggagnaaaccanagtttcatgcccancgncctagaattaattcccctaaaaanctttgaaataggncccgtntttnccctatagcaccccctctaccccctctagagccaattgat

SEQ ID NO: 481300 - DNA, 389 bp, Homo sapiens
gacaggtctcaaggattgatatccagatatataaagaactctcaaagctcaacagtaagaaaataagtattccaactaaataatgggcaaaatatttgatacagagttttttatcacagcaagatatattaaaggcgaaataagcacattaaagatgctgcaaactattaatcattaggaaaataaaaagtttaacattataataccagtatatgcccactaaagtgactaatattagtagatcagctataccatgtgctgtctaggatattgagcgatcagtaccctcagacattgttgttgcaaatataaaatggtacaaccattttggagtatcatttgacagtttttttttttttctttttttgaaatggattcccgctgggtac

SEQ ID NO: 481301 - DNA, 102 bp, Homo sapiens
cccttccccacagtgaggtgaactttctgccacttgtccctcatcacaccctcagcttttcacatcagaacccttacctcactttagttttcattgcgccat

SEQ ID NO: 481302 - DNA, 178 bp, Homo sapiens
  misc_feature (42)..(42): n is a, c, g, or t
  misc_feature (49)..(49): n is a, c, g, or t
  misc_feature (143)..(143): n is a, c, g, or t
  misc_feature (172)..(172): n is a, c, g, or t
gtagccaagtagactggaatcctgtgctgaacccgaatcttncaacagnctacaatctgtgaccaccacaagatgtgccctgatggcagctgaaggttgattcagatgggcacttttcttccccttcctgcctagtttccttntgttcttgagtcacgcagaattccttctntggtcg

SEQ ID NO: 481303 - DNA, 953 bp, Homo sapiens
  misc_feature (953)..(953): n is a, c, g, or t
ggcgggcgcggtggcgcgtgcctgtgatcccagctactttggagggtgaggcgggaaaatcgcttgaacctgggaggcggaattgcggtgagccgggattgcgccactgactccagtccgggaaacagtgcgagactgtggtctcaaatacagaaaaccagagacaaaaagatttctgccgtgagcccgccgtgcctggtgtacatcatttccaatatcttactagttattctgtggggctaaggttgccacaattttatcagaccccttttaaatgtcattcaaattttttcccaatatttagactgtgtttgcagtaagaattcataagatatgcatgctagtactcctgtccttttttcaaaaggacaacttattagatattcttggttcctcatatctttggccaacatgggtatgtggcattcttcttggtttaccagtcaggctaaggaagctcaggaagaaacaatatctcattttttatgtacttttctctgattcttaattatgttgaccatgtttccatttctttgtgaaatgcctatttatgttcatcttcatcttaacttgtcaacgagtacttgtataagtatataaaccgttgagtatatatttttctgtgctgctcacaggttgggatataggttataataggcggtcaaatttacccaatgtttaattcctctatcatgtgcacttgaatggggcttagaaaggcggtcactacggggccgagtttggttgcacatctggcatgcgggcattaacatcccgggcagtgggcagtccattggggttttgggacagtaatcttaaccactcaggttttaggggttacacgcaggtgtttggagtcaactgagggccaaaaaaatgtgggtgcagtgcaaaaatagtgactgtatttggtcttctctcttttttttgtcgtatcttaggcttgtgcctcn

SEQ ID NO: 481304 - DNA, 434 bp, Homo sapiens
agagagagagagagagagagagagagagagagagagagagagagagagagagagagagagagagagagagagagagagacacagagagtgagagaatgtctcctgttctctcgtctcatctgtctccttcttcctccttcctcgccttccctgcttcatatattgcccgctcgtcgtctgctctctcgttcatccactctctcccactctctccttctttgttttcccctcttcatttccctgcggctctttcttttgtctcctcttctcttgctattgtctccctccatttgcctgcttcctctcattttcatctctgcccctgctcctcacttcctctccctctccctgccttcctccttgactcttctccccctctctccctcacttcttactctcttccttcctgttctctcttctcccttcgccttctc

SEQ ID NO: 481305 - DNA, 717 bp, Homo sapiens
agcgggcccacgtggtctcgggctcctgacccgtgctgctcacgagttcaagactcctgcggcggcgccttttccagttccaggtgtgcagaattgtcctctccccatgcgcggcgggtctgcatttggtcgctggctccgagatcgtcgcggggccgcctgaagcccaatacggtaccgggggccgcatgccgtagacggcgcaccctccgtcctctccccaatcagcaggtccgagatgccgatatgcatccggctacgggaaagtggatctgtgcatttcgggtcgacccgtcggaagatcatcgatgactcctgttagatagtcgaatggattccacaagcccgactagctttcgctgaatgacattcaattctcctatacgtcgaagaaaatgttaaagagtatctgcagcacacattaggagcaagaagaggagctgccatgctagagatgtcgatatctttgtgacggaaacagtgctgtagagagtgactgcccaaccctgtggactgggtgcgtagtttctctattcacctgcaatggcatcttgtggcacatggaggtgagttgatctggtaatcgagattgattccgaaggatcgtcgtgtaggataatagtgtgctgggctagaatggtccctggaattcgaatagagcacttggcagctcaacacagctagcagtggccagcatgtggcagggaggcattccag

SEQ ID NO: 481306 - DNA, 267 bp, Homo sapiens
taaccagaaatatcttgcattgcaattattaccctagacctcgggcaagaatgaattcttgccacagctgcccaactattgaactttcatatttctcaatatgaaggaaatggatgcaaattaaacaaaagcccatagagtgctcagagcacagtcacaaaatcaatgagacagcatggaaataaagtctgaactgcaaactttaggaggatcgcttgagcctgggaattccagaccagcctgggcaaatggtgaaacccaatcctt

SEQ ID NO: 481307 - DNA, 722 bp, Homo sapiens
ccctatacaggggccctctcaggcctcctaatgacctctcgggctaggcatgtggagtttcacttccagatccataagcgctcctcatactaggcctactaaccagcacactaaccatataccaagtgatggcgcgatgtaacacgagaaagcgaccataccgaaggccaccacacaccacctgtgcaacaaaggccttcgatatgggataatcctatttattaccgtcagaagtgtttctcttcgcaggatttttctgagccttttagcactccagcctagcccctaccccccaactaggagggcactggcccccaacaggcatcaccccggtaagatccccgtagaaagtcccagcgtccgtaaatcagcatccgatattagctcgcatcaggagtagtcaatgcaccgtgagctcatgcatagtctagagtagaaaacaacgcgaaatccaaataattcaagcagctgcttattaccaagtagtccacccgtggagtctctatgtacacccgtcctacaagcctcagagtacattcgaggtctcccttcagccatgttccgagggcatctacggcctcaagcatgtttatcgtaggccacaggactgtccacggagcttcacgtcaatcataggctcagagctttgcctccacgatctgcttacaatccgtcaagctaatatttcaccgttaaccatccaaagcatcacttggcttcga

SEQ ID NO: 481308 - DNA, 364 bp, Homo sapiens
tttattgaagattcttgaagaacgctgagagcggtgtgctgtttctggtgactcatgcgccggggcgactgttggcgacgatccggtcgcggtgccgtcggctgagttttccgatctggacgccagatcgcctgacgacgctggtgcggaaccgtaccggtgtggatctggaagacgccgaacatgctgccgcaatggcggggggatcgcccggcgctgccctggctctggcggccggaactacgttcgagatggatcaactggcgcgtcagtgggtcgagggcgacatcgaccgggccgaggccctgtccatcgccgacaagttccgtggcgctgaagggcaggaacggttcgagaccctgat

SEQ ID NO: 481309 - DNA, 459 bp, Homo sapiens
  misc_feature (4)..(4): n is a, c, g, or t
  misc_feature (67)..(67): n is a, c, g, or t
  misc_feature (75)..(75): n is a, c, g, or t
  misc_feature (378)..(378): n is a, c, g, or t
  misc_feature (383)..(383): n is a, c, g, or t
  misc_feature (386)..(386): n is a, c, g, or t
cccnaacactccactggaaacaacactgaaagtggtttaggtccccaagggcctgttaggccagagnctcccccnaatcccatctgccagaggtgtttccaggtggaaggaagtggagaacagcccttcctcctgcctcccacactgtcctccagcaagggtttcctgtatcctgtgcattgaggattaaattattcacatggtcagagaagcccatcaccactgatagttattgtaggtatggaaaactaacgactaagaagggagaaaaatataccaagcagttggcttggctgaacacaagtaaagactcttacagtcactggtgtgaactgcttattatcaatgtctgattgtgtatatttgtatattacacanttgtngtnattaaatgtgtcagattaactttgttataaaatttatgacaacattaaattttattcacatgaaaaaaaaaaa

SEQ ID NO: 481310 - DNA, 114 bp, Homo sapiens
tctaggccctgtggtagggctgtacctcgcattatgatgctgttgtgacctgcttcctccggagtactttcagctggcttaaattcagtgggtacttgtggtgcgctcgtgcct

SEQ ID NO: 481311 - DNA, 116 bp, Homo sapiens
agtgtgggactgtagtgcagtataccacagcacagctcacagtgcagctagcacacagaacaggagaactacagagcacaaaaggtctacaggatgcacagtacacctattgccta

SEQ ID NO: 481312 - DNA, 145 bp, Homo sapiens
ttcactttctacacagcttagaaaaattaactttgtgaatgaacttaagatgtctgtactctatatgtgatgctgtgcagtattgtattttatatggaaagatgtcaacatatagccactaaccaagtaaaataagaaacgtgat

SEQ ID NO: 481313 - DNA, 392 bp, Homo sapiens
  misc_feature (8)..(8): n is a, c, g, or t
  misc_feature (91)..(91): n is a, c, g, or t
  misc_feature (95)..(95): n is a, c, g, or t
  misc_feature (314)..(314): n is a, c, g, or t
  misc_feature (362)..(362): n is a, c, g, or t
  misc_feature (385)..(385): n is a, c, g, or t
gcctgcgnaacctgcgcggctactacaaccagagcgaggccgggtctcacaccctccagtggatgtatggctgcgacctggggcccgacgngccntcctccgcgggtatgaccagtccgcctacgacggcaaggattacatcgccctgaacgaggacctgcgctcctggactgccgcggacacggcgggtctagatcacccagcgcaagtgggaggcggcccgtgagcggacaagtggagagcctacctggagggcacgtgcgtggaagtggctccgcagataccttggaagaacgggaaggagacgctgcagncgcggaaacacccaaagacacacgtgacccaccatccccgtctctgancatgaggccaccctgaggtgctngggccct

SEQ ID NO: 481314 - DNA, 365 bp, Homo sapiens
  misc_feature (1)..(1): n is a, c, g, or t
  misc_feature (14)..(14): n is a, c, g, or t
  misc_feature (38)..(38): n is a, c, g, or t
  misc_feature (47)..(47): n is a, c, g, or t
  misc_feature (52)..(52): n is a, c, g, or t
  misc_feature (82)..(82): n is a, c, g, or t
  misc_feature (188)..(188): n is a, c, g, or t
  misc_feature (364)..(365): n is a, c, g, or t
ngggactgcgatangaatcatgtctggtcgcggcaaangcggaaaangcttngggaaaggtggtgctaagcgccatcgtaangtgctccgggataacatccaggggcattacaaaaccggctatccgccgttttgctcggcgcgtggcgtcaagcgcatttccggtcttatctatgaagagactcgangtgtgctaaagtttctagagaacgttattcgagacgccgtcacctataacggagcaagccaagcgcaaaactgttcacagccatggatgtatatatgccctaaaaagtcaggggcgcatctgtatggcttcggcggctgaatctagataagcggtctcctgagaacttcaaaaccnn

SEQ ID NO: 481315 - DNA, 178 bp, Homo sapiens
caggaaaaaaaatagaaacctagcggttgctgaaactagagaggctactctcttgtcttccgtgcaggaattccccggttccccagcttgctggaaaaatttgttgaccttttcttttttgtagatttttcttaacagaatcaccagtaacatttccacatgtcccaatacttggtta

SEQ ID NO: 481316 - DNA, 324 bp, Homo sapiens
cccctcgatcacccatgttgacggacccactgagatctacaagttgacccgcacaggaggcccatggagtaggaggctgcagcagtctggctgggacggtcttctgcataaccgagaccctctaacttgagtggggagcatgccagaaagagctcaatgtaagacattaatgcctcatggctcttcatctgtcgttctcttggacctggcggcatgtccatttgtaggtgtgccttttgacggtggctgtcgcgagcgaagattcctgcagcccctaatgcagttgtgtattataacataaactctagtatgacacattttctg

SEQ ID NO: 481317 - DNA, 455 bp, Homo sapiens
agtgttagtgctactgtgtccaaacagacactcatgcataagctgtctgctgcgggattcttgctctcgtctcagagacttgagcctcagctgcaatgtcaggtggcatcacagctaacacactgtcctccatatcctctatgacaatacggcgcaggtctgagtgcagagtctggatgaaggtcacagtggtccataggggtgtctgagctggcgtactgtgctagtactctttgctcgtgctcagctctctgctgtgccagtaattgctcctgaatggctggaggcagggcagccagaaactcagggctcacttcagtcaccccaggattccccagcactgcaggcgctgagctatttgtggagggggcagaccgggttggtggacgaatgcctagctggttctgtagaacttcccgacggatgtcatcaggccgggcagcagaaaagagggg

SEQ ID NO: 481318 - DNA, 474 bp, Homo sapiens
gtgaaactaatttgcccctagtcttggctgctggtaggacttctgaggagcaatgggacatgagttccctgtatatgcgccacttgctcaagggaagcctcaggaaccagcacctggatgccaggattaccaagccctgggtgagcgagaggctggagaacacagtgagctcacccagtggcttgctgcccaaccatgtgccattgtgaactgacttccgtccgctgtatttgtatcataaggcgttgagacatctgatggacttggcttaggccctgctgggacatcccacttgtaatcccttacactccatcaggacaccaggactgtccttaggaaaatgtccttgagatgtgagcaggagtcaaatatgctgtgtgggtgtatcggaaagctgatgtgtactgcctcagcacaaagacccagtgtcttttgctcctcctgttcctgtgccactccagaacctcagcagat

SEQ ID NO: 481319 - DNA, 197 bp, Homo sapiens
taattttaattttggccattgtttggaaaaaataacccgtctgtgtaaatatgaaggatagttttttccataaaacagatgttttttttgttttaaaaaaaacccctggccttgttttaccccctttggaaacatgtggggatattaatgctaaactgtaaaattcaggaattaaaatgtggccctgtttttcccta

SEQ ID NO: 481320 - DNA, 267 bp, Homo sapiens
actcaacaagatgagaataaggaccctttatgatgagccacaaccacttaatgaagagtaaatgtatcttctcttgcttatgacttaacattttcttttctctaacttactttattgtaagaatatacagtataggctgggcacagtggctcacgcctgtaatcccagcactttaggaggctgaaatgggtgggttgtttgaacccttgagtttgagaccagccctggccaacgtaaggagaccccgtgtctattttcattaaaaaa

SEQ ID NO: 481321 - DNA, 297 bp, Homo sapiens
aagatccattcaaaaaaatataaatatttgcaaatgaagtaagtcaagggtacataggtagaattgcagtaattagcaggtagagcacagcaacccctatcgatacaggggccgtttggtgatcaaggtaggatcactagaataaagcgccttgagagcaagccgcatcgggtgtgtttgttttagtcttgggttaggtaggctagtgggttatcaaagggcgggcgggtatttagaatgcccttccttttaacaagcagccttctcctgctccaccagagctatgccaagtcgttg

SEQ ID NO: 481322 - DNA, 284 bp, Homo sapiens
acgtcatcctccgctccatctgcactggctgctattaaacaaagactctgagaggacaccgcagatatgactatctatgtttgtggacacatggacaatctgtgcacttccagcacaatatttgctgctgctcacctgattggttggtatgaccctaaagtaactcgagtcttccatgctggacttggtgtggtgctaggggaagacaagaaaaagtttcaaacacgttcgggtgacacagtgcgcctcatggctcttctgggagcaggactcaaacgatccat

SEQ ID NO: 481323 - DNA, 226 bp, Homo sapiens
ggtgatctgaggtatcccggctatcacatatcacccagcatgtgttcctaccgccacctatacagtttccttagatcaatgaggataagaaaaaacaaaagatccttatttaccttcatttttttccctctatcattattttcctttctttatgtagatctgatgttcaggtccgttggcaaatgaataaccttagtatttgtttgagaagataatgtgatagccg

SEQ ID NO: 481324 - DNA, 227 bp, Homo sapiens
agtatagtgtcgtcaccaccatcatcacaccaccttcaccactcactgtcgtcaccaccatcatcaccaccaccttcaccactcactgtcgtcagcaccatcatcaccatcaccttcaccactcactgtcgtcaccaccatcatcaccatcaccttcaccactcactgtcgtcaccaccatcaccgccaccttcaccactcactggcatcgccagcatcatcaaacc

SEQ ID NO: 481325 - DNA, 508 bp, Homo sapiens
cccaaaaagacacgcacccaacaacgaacgggggttaagggccaaaacccccccaaccacgagccgggaggagaaaagagacggccaacaggagaagggagaacaaagaccgggaaaaacccaccggaaaggaacaccaaaaggccgggcaaaaacggataaaccgaagaagcggaaaccgacaggaggggggaagaccaagccagcagggaaacggagcagagcagaaccagaaccaacaccagagaggcgggggctaaaaaaacccccaaccggataggaaccaccggacccgaaggccaaaggaaaaccccacaaacccgagggcaaggaaaggaaaaccaccaaggaggaaaacgggaagggaccaaacagggggcggaaaggaaaaagggccaagggcaaaaaaacggggaaaaccgcaaacggccgggaaaaaaagggggacggggggcaaaaacaaaggccggggaagaaaaacgggccgggggcggggacaggaggagcc

SEQ ID NO: 481326 - DNA, 583 bp, Homo sapiens
cccgtaccagacgagctacctaagaacagcttaaagagcacacccgtctatgtagccaaatagtgggaagatttataggtagagcggaccaacctaccgagcctggtgatactggttgtcccagatagaatcttagttccactttaaatttgccccccgaaccctcgtaaatcccccttgtaaatttaactgttagtcccaagaggaaccagctctttggacactaggaaaaaaccttgtagagagagtaaaaaatttaacacccctagtaggcctaaagcagccccccattaagaaagcgttcaagctcaacaccccctaccttaaaatccccaacatataactgaactcctcacaccccattggacccatctatcaccctatagaagaactaatgttagtataagtaacatgaaaacattctcctccgcataagcctgcgtcagattaaacactgaactgaccattacagccccatatctaccatcaacccacacagtcattattaccctcactgtcaaccccacacaggcatgctcataaggaaaggtttaaaaaagttaaaggaactcggccaatctta

SEQ ID NO: 481327 - DNA, 199 bp, Homo sapiens
cgggtgatctagagatcccacaagctgacctcttccaccaggtaatgatggtctggaacttcaagtatgatgggcaggtatgagatgtacgcacgggatctcggtggtaagctggtcaagtccaactacagccgctcaccatcgtgaaagagtagccggtttcagatgccatgtccttggggtgaggaagagacctctg

SEQ ID NO: 481328 - DNA, 82 bp, Homo sapiens
gccattggattgagaagaaatttgacgaagccctgaagctgagaggccggagctctcatgaacaactaggagggtgtacaag

SEQ ID NO: 481329 - DNA, 358 bp, Homo sapiens
  misc_feature (115)..(115): n is a, c, g, or t
ctgtgtgccgggaggggtgaggagcgcaaatccggcgcgatgtccgggtcttgagcggcccgcttgtggggcccctcgcgcagaggagactggtgggcctcgggtctccaaccgntcgtcgaggaagtgtaaccgggtcttgcgagcggggcactgggggcactcgagagggtggcgccacaagcaggtggtgctgaccccctgcgtttgaggtgcccatttgcaccgtgatggaaacgaaggttcccaagaccctttaggcgaccgccctcatggtctattcgaattaacgctgaaacccagaggtgcctcagacatcctctcccagtctgatcaaccccgtctgaaagcccgtaat

SEQ ID NO: 481330 - DNA, 884 bp, Homo sapiens
  misc_feature (296)..(296): n is a, c, g, or t
ctccctgcggcgcaccctggaccagcgccgggcctggtcatgcagctctttcaggaccatggcttcttcccgtcagcccaggccacagccgccttccaggcccgctatgcagacatctttccctccaaggtttgtctgcagttgaagatccgtgaggtgcgccagaagatcatgcaggctgccactcccacggagcagccccctggagctgaggctcctctccctgtaccgccccccactggcaccggctgctgcccctgcccccactcccagccccgcagggggccctgaccccnacctcacccagctcggactctggcacggcccaggtgccccgccaagtgctccacccccagagtcggggccttggacagcctgcttgggagggggctccccaaagctttcccaaccccaggttccctcacacagtttgccacaaggcgggttgaggcgaccccgtgagaagatgccagggactttataggtaccccctaaggactatggacaaggtattgtggggggcagggaagggttatctcctccgggtaaagccatttcgccctctcccagtgggggggcggaattgagggcctgctccctctgggtaaaataaccccttttcccctcgaaagctcccctcccgggtgacttggagggggcaagcttgacgggggctcgcagaggctcaggtcctccctcctttcgaaggcccctgtaccataaccctttgggagcgtgtgaaccttcaggagcttttcaacttttatgccaaaatggctccctgtgaggggcttgcaagtctagagggtaggtgcacggccttgggaccacaggggaggcgctgtggaattagggggagtcaatgacccctttttttccccgag

SEQ ID NO: 481331 - DNA, 135 bp, Homo sapiens
ggactgcctgcagtccttcgcgccctcctcgccctcctcaccgacatcatgctccagttcccgcttggattacactgggcaacgtggttggaatgtatctggctagactatgatataccaacctggctaaaaaac

SEQ ID NO: 481332 - DNA, 1260 bp, Homo sapiens
  misc_feature (361)..(361): n is a, c, g, or t
  misc_feature (690)..(690): n is a, c, g, or t
  misc_feature (702)..(702): n is a, c, g, or t
catcaaggacgagctaagagaacacgtgtgttcaagtcaatggacctgaaggagctactcatcttcaagaagcagtgaagtgccttctggggagtcgtgagatcttggaccgagtaggccgatggcatggtgattcggctgccctccttcgccgtggcgacggaatgctcggggatcgagctggttcttcgaagcagcagagtagcctattactgctagcatggggtacgtcaactgcgctggtacctagggtgctatggttcaagggactacagaacgagcccaagcacggcataggaagctgggctaaacgcccgatacaggaattcgcggatgagagagtcgtctctacacgtcaagnaaagttggaatggttaacagaagcagcgaccgatgatattcgcaccgcacgagcaagacgcgagcaggcctccggtaggcgggtccacggccgtccgacgccatgccacaagctcgtcagcgctccatgcgtggcgtggtggaacgtcgcgtctggtcttcaagcaaggatgaagcaccattatcacagacatgcatagatcctggacatctccgggcaacgcgtgtcccggggaacaacgcgatcggaagtcgcacaaggcctatgatgtgaagtaaagctccgcgtgcgcggaacgttgcacaggggcacgggccagagcatagggncgtgtcccatgntagcatcaggcaacctaataacaggtacggtgggagaaccgatgaagtacagaaggatggaggcaagtcaagggaagcctaaaatccgagttgtgtctgaggacttccgtccaggacgtcatccggctccaccaagagccttcagtgagtagtgcttagcgcacatcttggtgcccttggggggcagagggtgaaggcagagctgttgaagttgtgggcccagaggaagtccgggctggctttgcaaaaaaagcagggccaggtcacagacggaggggtcaccaatctggaagcacattgaattaagtctaaaagaggaagccacgttgtggggaccgggacccggagggggcaccacccttgggcatatccggagccacgggggacaacccgtcataggagcacaagagaggggggaccaggtcaaagagccagccacctaaaacgaacgagcgaatcgagaggcgaaaggacaccgatggatacaaccgaggacgcagaagagaacacaaacaaagggagagcacacacgacatgtgcccagaagaaagcagacca

SEQ ID NO: 481333 - DNA, 420 bp, Homo sapiens
  misc_feature (6)..(6): n is a, c, g, or t
  misc_feature (32)..(32): n is a, c, g, or t
  misc_feature (170)..(170): n is a, c, g, or t
ccattngttttttaaaactcctgccgggaccntaaaaggataattgtgaggtaaatttaggtgttaggaacccaatgcaaatattgccaatgaaggaaggtttttccttcaaaaaatccttaatttgaagttaacttatttgaaaattttattttgggcccatgtgcggntgtcacgcctgtaatcccaggcactttgggagtccgagtggggcggatcacgaggtcaggagttcgagaccagcctggccaacatggtgaaacccgtctctgctaagaatacaaaaattacccaggcgtggtggcgcgtgcctgtaatcccagctacttgggaggcggaggcaggagaatttcttgaacccaggaggaggaggttgcagtgagccgagattgcgccactgcactctcacctgggggacag

SEQ ID NO: 481334 - DNA, 1092 bp, Homo sapiens
  misc_feature (135)..(135): n is a, c, g, or t
  misc_feature (139)..(139): n is a, c, g, or t
  misc_feature (229)..(229): n is a, c, g, or t
  misc_feature (426)..(426): n is a, c, g, or t
  misc_feature (430)..(431): n is a, c, g, or t
  misc_feature (434)..(434): n is a, c, g, or t
  misc_feature (445)..(445): n is a, c, g, or t
  misc_feature (450)..(450): n is a, c, g, or t
  misc_feature (452)..(452): n is a, c, g, or t
  misc_feature (483)..(483): n is a, c, g, or t
  misc_feature (488)..(488): n is a, c, g, or t
  misc_feature (496)..(496): n is a, c, g, or t
  misc_feature (779)..(779): n is a, c, g, or t
  misc_feature (955)..(955): n is a, c, g, or t
  misc_feature (980)..(980): n is a, c, g, or t
  misc_feature (1017)..(1017): n is a, c, g, or t
gtagctgttcagagtacttagtgccgggaatccgtgttcatgtatatagctattcatcgagtagcactggtttaccgggtccttcatcgccatgatccctcatgcgtctgtggccgttctgcagacttctcaganggcngagtggcagccgggcaccctacagaaactcagagggcagagtggcagccaggcccacatgtctctcaagtacctgtcccctcgctctggngattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgngcannctnaccaaaatgtntaaantnatctcagaggggcccatggattaacgccctnatccnaaggtccntcccatgacataacactccacacccgccccagccaacttcatgggtcactttttctggaaaataatgatctgtacagatcattattttccagaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcanacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctanagaaagtggaacagcccggagcctnatgtgaaaggaccacgggtgttgtaagctgggacacngaagccaaactggaatcaaacgccgactgtaaattgtatcttataacttattaaataaaacatttgctccgtaaa

SEQ ID NO: 481335 - DNA, 1057 bp, Homo sapiens
  misc_feature (135)..(135): n is a, c, g, or t
  misc_feature (139)..(139): n is a, c, g, or t
  misc_feature (229)..(229): n is a, c, g, or t
  misc_feature (426)..(426): n is a, c, g, or t
  misc_feature (430)..(431): n is a, c, g, or t
  misc_feature (434)..(434): n is a, c, g, or t
  misc_feature (445)..(445): n is a, c, g, or t
  misc_feature (450)..(450): n is a, c, g, or t
  misc_feature (452)..(452): n is a, c, g, or t
  misc_feature (483)..(483): n is a, c, g, or t
  misc_feature (488)..(488): n is a, c, g, or t
  misc_feature (496)..(496): n is a, c, g, or t
  misc_feature (744)..(744): n is a, c, g, or t
  misc_feature (920)..(920): n is a, c, g, or t
  misc_feature (945)..(945): n is a, c, g, or t
  misc_feature (982)..(982): n is a, c, g, or t
gtagctgttcagagtacttagtgccgggaatccgtgttcatgtatatagctattcatcgagtagcactggtttaccgggtccttcatcgccatgatccctcatgcgtctgtggccgttctgcagacttctcaganggcngagtggcagccgggcaccctacagaaactcagagggcagagtggcagccaggcccacatgtctctcaagtacctgtcccctcgctctggngattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgngcannctnaccaaaatgtntaaantnatctcagaggggcccatggattaacgccctnatccnaaggtccntcccatgacataacactccacacccgccccagccaacttcatgggtcactttttctgaaaataatgatctgtacagacaggacagaatgaaactcctgcgggtctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcanacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctanagaaagtggaacagcccggagcctnatgtgaaaggaccacgggtgttgtaagctgggacacngaagccaaactggaatcaaacgccgactgtaaattgtatcttataacttattaaataaaacatttgctccgtaaa

SEQ ID NO: 481336 - DNA, 260 bp, Homo sapiens
  misc_feature (159)..(159): n is a, c, g, or t
acaagtatcaaaaaggagtgtgcgtgtgtgtggaataacacccagcgcttgtacactgcccataaggtcgcaatggacttttaaaaccaacaaaagccgaaacggtggcccagaaggctgctcctattgttatccccatgctttctaagttcaagtcgnaatgactagctttggtcacactatttttagtacacagctaaacaaatcacgtggcgcccttctggcatgggatgacatagcgataatccagaaacaggtac

SEQ ID NO: 481337 - DNA, 419 bp, Homo sapiens
  misc_feature (131)..(131): n is a, c, g, or t
  misc_feature (150)..(150): n is a, c, g, or t
  misc_feature (161)..(161): n is a, c, g, or t
  misc_feature (170)..(170): n is a, c, g, or t
  misc_feature (182)..(182): n is a, c, g, or t
  misc_feature (215)..(215): n is a, c, g, or t
  misc_feature (378)..(378): n is a, c, g, or t
ccaagagcaaggaagacctggtgtcccagggcttcactgaattcacaattgaggatttccacaacacgttcatggacctgattgagcaggtggagaagcagacctctgtcgccgaccatgcctggcctccnttcaatgaccagagcaccntccgactaccnttgtggtcntaccgtgcggcntgctcaccctcgggcctacctgcagcgcgaganaatgttccttcgagcacttcatccgagggtggacggactgtcaaggaagttctgccagcaggaaggtggagccatgtgcaaggagaagcgaccacatccacatcattgcgctggcccaggcctcagcgtgtccatccaggtggagtacatggaccgcggcganggcgggcaccaccaatccgtacatcttccctgagggctccg

SEQ ID NO: 481338 - DNA, 759 bp, Homo sapiens
aatgaaagtagggtctcaagtaacccaagggtggccgggtacggtggctcacgcctgtgatcctagcagtttgggaggcagaggtgggcagattgcctgagctcaggagtttgagaccagcctgggcaacatggtgaaaccctgtctctactaaaatacaaaagaaattagccaggtgtggcggcatacccctgtggtcacggctacttgggaggcagaggcaggagaattgcttgaactcgggaggtggaggttgcagtgagctgggattgcaccactgtactccagcactctagcctgggcgacagagtgagactctgtctctacaaaaaaaaaaaaaaaaaaagttaccccaggggaggggagctacccctctagttgcgggccagccgggaatacctggctcccttggacgttggattaccatggggcgcgaggaggagcgttccattaggaacttaccgaaaatgtggattagccaagcattaaaccaacaagtggactcgggtcgcggggcatactcctatcaaacctctacaccattctggctatattgtggccagcagcgagctgccggcctatttctactaccagtgctccctcccactgtccccaccggcctccaaggattacccttatttctctccctggtgctcgggcatccccagtggttcttgtcgcccatgcgcagctggttttcacacacgctgttggcccaccggcaccccaccgttcccccgcaacccaggcgggggcgcg

SEQ ID NO: 481339 - DNA, 242 bp, Homo sapiens
ctatggatggccagatgggagaatcacttgagaggcacctgggcacataaggagactccatctctacaaaaaatttaaaacttagctggacatggtggcacatggcctgtacgtccaatgccactccaggaggtagcaggtggttgggaggatcccattgaagccaaagaagctccaaggttgcatgtgcagcttgtgactcacacacacttgcactaccatgcctggtgtgacagcagacc

SEQ ID NO: 481340 - DNA, 334 bp, Homo sapiens
gtggtgttggggcctccagccagggccctctaggggaaccaagcctctgctctcacctgtgggttcttgcccatcaggtaaattgtattggggaactcaaatatacgggcacttacatgtgtgggtccgaactcaagggatcttttatccaagctgcaaagcctggctttgatttgaaattttgtaaaaatttcagggcacccagggttctgattctgacccagcagggggccaagggagcttatgggaggttttagggaatttgagtttaatgagggggagaaaacccttgacccccacaagcgttccacggggagttatctaacactttgtg

SEQ ID NO: 481341 - DNA, 417 bp, Homo sapiens
tgcgacggagtctcgctctgtcacccaggctggagtgcagtagtgtgatctcagctcactgcagcctccatctcctgggttcaagcaattctcctgtctcagcctccagcatagccgggactataggcatgcaccaccgtggccggctaacttttatatttttagtagagagggggtttcgccatgttggccaggctggtctggaactcctgacctcaagtgatctgcccgccttgacctcccagagtgctgggattacaggtgtgagccaccgcgcccagccttccttcatctttactaccaggcacttttctaagtgccttcactttcacaactgccctatggagcaggttaattagtcgacgcggccgcgaatttagtggttgttgtcaacccgggaattccggaccgtgacct

SEQ ID NO: 481342 - DNA, 701 bp, Homo sapiens
taattttttgtatctttagcatagacggggttttgctatgctggccaggctggtcttgaactcccgacttcgtccgatctgcccgcctcaacctcccaaagtgctgccaccacaggtgtgagccaccgcgctcagtctgtaaggtgcattttaccaaatgttcagagaactgaagatcaacctacaactgcctcacaacttttcacccaaacgtcacatattcagcgctagcttacttaccctaaccacgaacggactatttacccttcccacccaacgatacacccctgctatgcttctagacaccgatcgctcaattaggacctcattctactagctcagccctccgacccctgtgacaccccccgcccctcatcgtagcgccagtcacgcatcacatacacctacaccccccgctgccctcctaccacgcctacaccgcctcactatcacccccccattctcttccccttcctccttaccttcccaccacctccctctcctcctctccttctcccactacttccgcactcctacctcctcctcatcactctagattcctctcttcctcccttccccctacccccgcccaccactttcctccctaccagtctcatctctcctctccctccccctcctctctcccccgcaccctatctctctctcctctccctctcttaccactctacctcccttccctc

SEQ ID NO: 481343 - DNA, 148 bp, Homo sapiens
gactctagagatccggtcagcatgaagctaagcagtcctttctctatctctcccagtctagctgtggatcatatactataacagacggaactcaacacacttcttcgacccgggaggaggagacccattctataacaacaactattct

SEQ ID NO: 481344 - DNA, 370 bp, Homo sapiens
agccttcctttttttgccccccccttttatttggatttaaatggtttgggccccccaagacccaatgttaaagtaaagacgccgggaaaatgaattgcttgggattcctttcttcatgtatatccagccccgccgtaaacccaaaacccctggatttaacttttttttagggtttttgcctttgggattttttttttttgaaccctgcccccccggcctgggctgtaaaaatagtttcccggggaataactttggatgagggccagctttgtttaatgttttttgaaattttcctggcccatcccagcctaattgtttagaacccgggtttttaattcctgtaagggggataaaagttttttggatggga

SEQ ID NO: 481345 - DNA, 127 bp, Homo sapiens
acgccgttgtcggcgttcacatccaggcgcagggccatttcccggcgcagcacttggccacccagggtggcgccttccagcacatacagggcgccgagacacgcagccggcgtgtctaatacgggga

SEQ ID NO: 481346 - DNA, 647 bp, Homo sapiens
gatatgagatattcatccgattataagctatcctcaaaaactatagatgcaatgaacacagtaataacccccaattgaagacgtcatagcttttctccggcagccagtatgtgtcacgccgcacaattatatctcgggcataagttatttcgaatgtaatactttgtaggctaatgatattattaacctcgtaataaatagcatcaccgtctaataacaacaacgtacatagagaacagctcctagaggtgctggatctcaatatcatttcctctggctctgaacagtacatcgtacattgtcagtcacattcccagcacaagttagaccatgtccctctcaggtttcctagcccaggtcatacatatattctgctgctttgtgacatccctgaaatgtctttaaagaatgaacggctgtcaattttaaggaatgacgaaagttatccccaaggaatgtcaggagtgttgagcatcagagaatccaatgttcccattaacagaataaagaagagaagctatatgttcattagatttttttaaaaatcgctgattcaacatttattcattataaaaactccattaatgtcaacatgtattccgtttgggcgggcacagtggctcatgcttgtaacccaatatttgtgg

SEQ ID NO: 481347 - DNA, 1655 bp, Homo sapiens
  misc_feature (852)..(852): n is a, c, g, or t
gctgtgatgtgggtgcactccgggagccagtcagcaggtgtgtggggaggaatggtgatggattcaatgctggggcatgtagaactttgaaggctccgtgggaggcactcactcaatccacactacgtctcatgatgggtcagctctccaggatcagtctgtcttgattcacccatgggcttccaagtagcacgtccctggtcatcttaggcaggtgaaacaggcaacagcaagagctgacaagcctacggacgacggggcgtatgggtacggaccactatgataagtacatgggacgggtaaaggtcagccgttgattgctagtacaaagtggcgaacacgaccaaaatggtgctcccacagaattgatttactcactgtgagtcaagaccacacgtggacacactggagcctctcgctcattagacaagcgattgttgagacctatgagcacaggtctcagacttagacagtgccacagtgccacaggaacgccctctgatagctctgagttgatgcgcagtcaccggaacacaacgctacggtaagtgttcactttgggctgtggtataggcccgatacgattgtcgatacgtataggaaaggaccccccaatagaattgtcatcccacttgtcgaatttcgttcacgaaaaacacgtggctatacattaagacgggaaaagcgcacactgggaaagcgggagacgctctcacaaccgctaccgataggcgaagctttgaacccataggctgtgagaacagatggctatgaacccgctctttacttacccatgggcattctggggcattcgttccaccggtcgcgaaggcggaagccggaacatgtcgnacccagttacaaagccggcggagcatggggttctaactacatgcacgatgtgaaccacaaggggtcctatcatacagatgcttcgttacacataaggctaaagacgtacagttggccgtaactgtacaggcataccggtatcatactcctcaggtgaatcattcccatttaacctgtagaatggacagttttgcaagcccacagggcgttacagtccaggcaggaccccttaagtatcgacagtccctttatagatgactattgtcgcgtaaagcgatcacgcgggacaatatcccggccagccattgctacttcgcccccgagcgccttatggagtacactcagattctatctttaaccccggcaatgtgacagagtccaaactgtgctaaagccaataggacaacgtgcactttgaaagagatacagcggatgccacaccttatctctcccgcgcatcgtgatcgagcggcacacagccctttacattagagggcatacacggcgtcgacccacctctgtaaaactcgagttcggacgctacaactaaccttgggtgacgactgccagacgacgacagcccacaaggacattgaccgtcagaggacgtgtgctgacatctagacactcgatgcccatcacatggggcccacaggacactgctgtgtccgaaccacgccgcagagagaaccagaacactcatgaatgttgccccacagcgtgacacagagaccaagagacgaactgattgcagtcgacgacaaacaactgctactagagagcagtagacagtatgtggtcga

SEQ ID NO: 481348 - DNA, 270 bp, Homo sapiens
catctctatgtaagttcagtgttctgccctttgaagagatgctcattaattcatttgtgaacatcttttatgaaatccaccatcactagctaatcttattgaggaggataatcagtggtgaagagtttacagacgtggattctttagcctgctctgctgcttgctccatagggagggaatgattcatccttcctgtaatctcttattttctcttggaaaatagtgatcatcaatactgcacaggctgctttacagtagtttataatcggt

SEQ ID NO: 481349 - DNA, 83 bp, Homo sapiens
aattccatgagaaatctgggtttgaatatttgtttactttgtctcctaattgaacaccactccagcccttctgtcgtcttctc

SEQ ID NO: 481350 - DNA, 135 bp, Homo sapiens
  misc_feature (99)..(99): n is a, c, g, or t
tctagaggatacctgaggcatggggtctgtacctcagcctgtggtcgcagcacaacaccgggttctgtaaactgtcactgtaacagccctgctcgctcngctgtgctgcaagagcattgctgagcagctgtgact

SEQ ID NO: 481351 - DNA, 1798 bp, Homo sapiens
  misc_feature (1)..(1): n is a, c, g, or t
ngcgcataccgcgtgcgcggtcactggtgagtcctatgagtttagtcgtatgtggtctctgttttacagcagtgctctgcgtgcagcgtgggtcgccgggtgttaccactacgggtggggataactaaagggcgccactgagtactccagtgggggaacaaccgtcggccagcagggtagtttgtaacaatcggggggataactccgccgctcgcctaggtacctcacagctgcgtggtggtggcgtgcaccaagtgtaggatacattcatgaccactcaagtcccagtatacgcgttgtggtggattggagtttcccagccggtatgtgctctcgtgtgttgctccagaaacaggtggtgggaggaggacaacacatgttgtgcccccgggtgtcctggtggtaataactccccgggggtggtttgaggtggtggctcccccaatggtgatacctaatgtggcccccataacatcagggtgcccaaagccaagggggtataagtgctctactcacggggatgaagcgctaacctgggtgggcccaacagagaatgggtccagggtggggggtcctatatcccagagggtacgcgcgtgggcgaagaggagaacgggggggcaacaacaagggcggtgtcgtggtaaaacccgcaaggccgctgtctgggggtgttagtgaagaggtaacaagagggcggttagagataaacgcgtcacacaaagtagcgctgtgagtaatagaaagggataggtgtattcgggcctcagaagagagtgtggaaaagagaagacggtggggtgtaaaaaagtgtaagtgtaaggggtgctccccagacctctcacacagatgctcccgctggtggggtggtctcaccaggatgggcaccacaccacccagttgtagagaggcgacaggtgttccggtgtgagaggctcacagtgatcctcaccacagtccacacactgtgtgggaaaccactcactcaagaggcaaagagtgtgtaggagtgtgtacccagcgtgtgctgtgggtcacagaggggtagttgtggcggcgtgctggtggtgtgtgtcacagaagtgtgtctgtataagtgactcccagggtcctctcatagaccggtcgtctggtgtagagcccccgtgtgtgtgtgtcacaacagatgcatcatatcagtgtgtgtggtgtgagtggtgtataaacagatgtgaaaagatgtgtgtcgttaagatctccataatgacacaagagtctaaaagacgcccaccatggagagacacccacgcgcagtgtgtccccggtgtgtctcacacaagtgtgtctagatgtggccacccgtgtgagtcacagagtgtgtgtgtgtacacgtgtctcccgtgtgaacacactgtgggggggggctcccaaagacccagagaggggctaagaggtgtgtgacacgcccaccggtctaagaggtgcacacagacagtcgtagtgtgtctccaggccccaagcacagagcggtggtgctacaacaagagaggtggtgtccgtgtgaagaccacccgtcccgtgctgtcagaggtggtctcgtggagaagagcgtgcgtccgtgggagacccccgtctcagagaaaacgtgccgtctacacgtgagaacaagagtgccgtgcgtggacacgaagagggggagtgcccagagccgtggggccacacaggacacacccagccagagccaggtccagagagagttaagtagagggagaggggaggctgggtaaaagatagataaggaagagtgtgggtataggga

SEQ ID NO: 481352 - DNA, 1467 bp, Homo sapiens
acacgctggttgctggtggttgtggggaccccgcggctgccggctatatcgcgctagagtgggcccgcgccgcccagtgcagtggcgtggtgggcgcgcatggctgacgccgctaagctgagctgtccccgcctttgcgtcttccctgacctcttgcgtgtccccgagcgctgctgacacttgagacctggtgtcagcctcacagcgcaaccaaacattaccctttcatcttgtactgcctccttccacaagcacctgccccatttggccaaaacgaagattatcactcagagtattacgcgacgtgcctcgcaacatgccagcccagcaaatgagactcacacaaagccctatcactcacgctatgccaacgaagctatcacccctgcacaccaaactaaggatgactcccaaacgccaaggcagaagttctccccagctgccacgacaccctactcaggctccccgacgctgatcgaccgcctgcacccaccgcaagccacgctacccgatgccactacgccgctcttgcacccgccttcgactccctggcggccacgccgcgcatcccagccactcagcctacctgcgaccgcgcgcagcgccccacctgctcccaccccccgaagggaagccctgcttcgaccgcccaccactctctcctggcgggaggttcctccactcccctcctatccactctctggccacgactccccccaggaacccgatgcctcctgcacccccagcccccttcctccgcacattcctctcccacttgcggccacttcgcaccattccctaaccttccacacaccgttgccaccaccgcccgggcgctccaaccccccagcggcaagctttccaacccagctgcaaaccacctcaattgcgcaaccaacggattgctgcacgccgcgcttgcaatccgcgtccacagggcggcgcaaccgggagagcccacaggcccctaccctacccggtttctagccgcatttggcccacactcaccttggtcctgcaccggagactctccgagcggcacaatgtagcaccaaaaacccgcataatcaatgtaaatggcgaaccccccataaactggacagcacacagacagcaacacccaacgcagtggttttagtggaaacaacatcgatgtgcccctcgaacacagcggagcctacagccctcaaaccaccaataatctgcgccaccgtacacggtggacatagcgcccgcgcgagacgcagagagcacaacccccaaaacccgcgaaacaaagtacgccaaccaacacagaccccgagagtaatacaatcgaaggacgcaccatcaaacagagttggcacataccccgaccgacagatcaccccacactacgaaaaagacagcaagcaaaaaacagacaacaacgcagaaaaaaaaacgaacactaacacacagcagaagaaaagacacagcgaaaaaaac

SEQ ID NO: 481353 - DNA, 103 bp, Homo sapiens
agaatggttatatcgggatcgcgatttcttttcttggtggggctgtttatgaagtaggtagtctaaatgcaatcactaaatgcaatcagtctaaatgcaatca

SEQ ID NO: 481354 - DNA, 291 bp, Homo sapiens
ttctagaaacacctgtaggaatggaattgagatggggaatgctatggatggagcgaaggggggaatagaaaataaggagtttaagatcattttggatgtgaattttgagattcctattagacatccaaataaagatgtcaagtagtcagcgggatgtaccagtctggatttcaggggagaggtctggactggagatataatgggaatcatctgcaaagggacatggttgaaagtcttgagactgggccgggcgcggtggctcacgcctgtaatcccagcacttggggaggc

SEQ ID NO: 481355 - DNA, 221 bp, Homo sapiens
tttagctcggtccccccggtgtgtcttacgcgatgagcggcgccaagccggaggcgattgctgccgcggacaggcgcgctccctcctgcgaagaggatggtttcgccgttgttgtcgaggagttgctggcatctcgataatctcgcagtgtgctcatcgcaactgaccttgacggaaccctcctgactcctgacggcactatcagccctcgcactcgtgat

SEQ ID NO: 481356 - DNA, 118 bp, Homo sapiens
attccaccagcaaggcgcggccggggacatgcggtacccagcacaaccctcctcgcaaccagcagcagatcacacctcacctacagtgcctcacaagctcaccttcttccagcgaaga

SEQ ID NO: 481357 - DNA, 405 bp, Homo sapiens
actgcgatgcatgtaattaccacttcgcgcgcactgtgtgcccgacgctgaggggcgttctgcatattcaaaagcgcgcgaggcccggcgcgatggctcacgcctgtaatcccaatactttgggaggccgaggtggacggatcatctgaagtcagtagttcgagaccggcccggccatcacggtgaaaccccgtctctactaaaaatacaaaacttagctgggtgtggtagcgcatgcctgttatcctggctactcaggaggccgagatcacgccactgcactccagcctgggcaacaagagcaaaactccgtctcaaaataaataaataaataaataaataaataaataaataaataaatataaataaaagtagtgggttgatacggtccaatttatttgtcag

SEQ ID NO: 481358 - DNA, 217 bp, Homo sapiens
  misc_feature (48)..(48): n is a, c, g, or t
  misc_feature (110)..(110): n is a, c, g, or t
  misc_feature (184)..(184): n is a, c, g, or t
  misc_feature (186)..(186): n is a, c, g, or t
  misc_feature (189)..(189): n is a, c, g, or t
aaaatcaagatgtggctgaagatcagaggctcagttagcaacctgtgntgtagcagtgatgtcagtccattgattgtccttagagagttaatgttacaaaaaagaattcntaataatcagacaaacatgatctgctgaggacacatgcgcttttgtagaatttaacatctggtgtttttctggngnganatatatacatatattgctttatttgaaa

SEQ ID NO: 481359 - DNA, 417 bp, Homo sapiens
cctctctggcagactccttctggccaccctcaagaccatgtggatccagctgaatcctcagccctgggactagactaaggttgagggaaagagccgtttctcattcagtaaccagaacaggctaataggacacacacacacacacacacacacacacacacacactctctactcttcttttgctaggggaaggtcacagcacaactatgtccgggacgggacattgtgaacatgacccagccacagtctataccagaaagatgatacagatgtctgaagtggtgccccatgtgccaacaggataccctctacccccagactttgtctctggggtccatgtcccttcctgaaaagcacaatccaagactggtatggcacagaggtagagagaaaggcatggactggaacaatcatgtc

SEQ ID NO: 481360 - DNA, 112 bp, Homo sapiens
gcggccgcctactactactactgctcgaattcaagcttctaacgatgtacggggacatgattggcttaaagtgaaggaaataaaggtaaaatcacttcagatctctaaaaaa

SEQ ID NO: 481361 - DNA, 968 bp, Homo sapiens
  misc_feature (5)..(5): n is a, c, g, or t
  misc_feature (8)..(8): n is a, c, g, or t
  misc_feature (41)..(41): n is a, c, g, or t
  misc_feature (45)..(46): n is a, c, g, or t
  misc_feature (53)..(53): n is a, c, g, or t
  misc_feature (69)..(69): n is a, c, g, or t
  misc_feature (81)..(81): n is a, c, g, or t
  misc_feature (84)..(85): n is a, c, g, or t
  misc_feature (114)..(114): n is a, c, g, or t
  misc_feature (127)..(127): n is a, c, g, or t
  misc_feature (142)..(142): n is a, c, g, or t
  misc_feature (145)..(145): n is a, c, g, or t
  misc_feature (161)..(161): n is a, c, g, or t
  misc_feature (163)..(163): n is a, c, g, or t
  misc_feature (166)..(166): n is a, c, g, or t
  misc_feature (172)..(172): n is a, c, g, or t
  misc_feature (175)..(175): n is a, c, g, or t
  misc_feature (181)..(181): n is a, c, g, or t
  misc_feature (186)..(186): n is a, c, g, or t
  misc_feature (188)..(190): n is a, c, g, or t
  misc_feature (196)..(196): n is a, c, g, or t
  misc_feature (198)..(198): n is a, c, g, or t
  misc_feature (217)..(217): n is a, c, g, or t
  misc_feature (228)..(228): n is a, c, g, or t
  misc_feature (239)..(239): n is a, c, g, or t
  misc_feature (241)..(241): n is a, c, g, or t
  misc_feature (244)..(244): n is a, c, g, or t
  misc_feature (250)..(250): n is a, c, g, or t
  misc_feature (274)..(275): n is a, c, g, or t
  misc_feature (287)..(287): n is a, c, g, or t
  misc_feature (289)..(289): n is a, c, g, or t
  misc_feature (298)..(298): n is a, c, g, or t
  misc_feature (318)..(319): n is a, c, g, or t
  misc_feature (327)..(327): n is a, c, g, or t
  misc_feature (332)..(332): n is a, c, g, or t
  misc_feature (339)..(339): n is a, c, g, or t
  misc_feature (360)..(360): n is a, c, g, or t
  misc_feature (364)..(364): n is a, c, g, or t
  misc_feature (380)..(380): n is a, c, g, or t
  misc_feature (385)..(385): n is a, c, g, or t
  misc_feature (388)..(388): n is a, c, g, or t
  misc_feature (399)..(399): n is a, c, g, or t
  misc_feature (409)..(409): n is a, c, g, or t
  misc_feature (411)..(411): n is a, c, g, or t
  misc_feature (446)..(446): n is a, c, g, or t
  misc_feature (451)..(451): n is a, c, g, or t
  misc_feature (475)..(475): n is a, c, g, or t
  misc_feature (479)..(479): n is a, c, g, or t
  misc_feature (758)..(758): n is a, c, g, or t
  misc_feature (777)..(777): n is a, c, g, or t
  misc_feature (803)..(803): n is a, c, g, or t
  misc_feature (867)..(867): n is a, c, g, or t
  misc_feature (869)..(869): n is a, c, g, or t
  misc_feature (954)..(954): n is a, c, g, or t
gaaanaanaaggtgcaggatctggatttgtttcgggtgganaaannagggganccagccctcatccganaaaagcagaganaanngcttcaaggacccgggactagtggaccanctggtgaaggcanaaagcgagtggcgangangtaaatttcgaggcananaanttgaanaanctgaanaaccnannnagcaananaatcggagaaaaaataaanaaaaaaaaacnagtgggaaaanangantctgtnccaaaaaatgtgctgagtttcgannaccttactgcanangctttagcnaacctgaaaatctcacaaannaaaaaaanccgantcctcantgatgaaaccatcctgaagtntgangcggaggaataaaatnggaancanagcgatttganaacctccgananattgggaaccttctgcacccttctgtacccatcantaacnatgaggatgtggacaacaaagtanaaangatttggggtgattgtacagtcaggaagaagtactctcatgtggacctggtggtgatggtaaaaggctttgaaggcgaaaagagagggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataangtgattggcaaaggcagtnaaaagtctgatgacaactcctatgangagaagtacctgattgccacctcagagcagcccattgctgccctgcaccgggatgagtggctcngncggaggacctgcccatcaagtatgcggcctgtctactgcttcgtcagacggtgggctccatggccgtgacaccgtggcatctccnagtcatcagtttga

SEQ ID NO: 481362 - DNA, 1529 bp, Homo sapiens
  misc_feature (409)..(409): n is a, c, g, or t
  misc_feature (450)..(450): n is a, c, g, or t
  misc_feature (463)..(463): n is a, c, g, or t
  misc_feature (466)..(466): n is a, c, g, or t
  misc_feature (486)..(487): n is a, c, g, or t
  misc_feature (502)..(502): n is a, c, g, or t
  misc_feature (560)..(560): n is a, c, g, or t
  misc_feature (562)..(562): n is a, c, g, or t
  misc_feature (576)..(576): n is a, c, g, or t
  misc_feature (606)..(606): n is a, c, g, or t
ctgtgcctcctcctcgtccctcgccgcgtcgcgatgcctggagccggcgggagccccgtcgctcgccattgtcggcgacgagctcaggcaagcaggttccaacggagggaaggcgtacgagccttgctcaaatgccctggtcgggagaggaggcgtggccgagatcaagccgggagttactgtgtgaccagaacgtacagtgatcacagagaaccttccagaaaagctcacagccttcaaagacgaagtacatggagtttgacctgaacaatgaaggcgagattgacctgatgtctttaaagaggatgatggagaagctttggtgtccccaagacccacctggagcatgaagaagatgatctcagaggtgacaggaggggtcagtgacactatatcctaccgagacttngtgaacatgatgctggggaaacggtcggctgtcctcaagtnagtcatgatgttnganggaaaagccaacgagagcanncccaagccagttggnccccctccagagagagacattgctagcctgccctgaggaccccgcctggactccccancnttcccaccccatanctccctcccgatcttgctgcccttcttganacactgtgatctctctctctctcatttgtttggtcattgagggtaagtatgagatatacaatcaatgtctaagtaaagcacaaaattatctgccttaaaggggctcatgggtcaggggaatcctgagcccattgggtccccatccactctcttcttccacatccttcccacgatcccatgtgcagaagggctgatatcaaaccaaaaactagagaggggcagggccagggcaagggaggattccagaactgtgtaccccatcacttggaggaaaccaagcactctccataccatttcagaaagtctccacggccaagtctcaggctcactgacactggctctgactgaggaccccaggccactctgagaagacttggagtagaggacaaaggatgcgagagacctacataacaagggtaaccttggaaaagaagaccatggttccagttgctcctgtgtagtacacaaggaaaaaagacactccgagggcacaggaatggcacaagtaggatacacactatcatatacaaacacatcttagacacatccacagagaagcaacgttaaccgaggctggcaccaggaaaagaaacaaagcagaataggagagaccacaaaacacatagacccaagcaagagaagaagcccaccagagccacagagcaccaggagcaaaacaccgagaaaactaaagacgagaactgcgaagagattacagaataatagagccacgagaacagcgagcacagagaaagagaacaaggaagagaaagaataacgacgcacgaagtactaggagagaacagacgacagccaattgcgtacacaagaagggaaaacagaacaccagacagaacaactaagaacacgaaaccagaaaaaactcaagcgacaaaagaaaagcaggagcaccaaaacaaaca

SEQ ID NO: 481363 - DNA, 261 bp, Homo sapiens
  misc_feature (193)..(193): n is a, c, g, or t
tctaggtggtcccatcagcacatgaagcggaaactgcctgagagggctgaagtggacaagagcagcccccacctcgcctaagctgagctgtgccccctctagggatttggggcacctggcctagggttagagggagagagggagaggccgtgacgtgctgagtgcagctgactcaggaagagccagagcgggnatgcagggccaggcaccactcagcctgcccaagtggcgtgtggctgcctctgcgggccggggacccac

SEQ ID NO: 481364 - DNA, 638 bp, Homo sapiens
cggcacgaggtgctcttcctcattcagtataaggcagccagtttgcttagaaggcaacattggaatgttagagttcatcagaaacatagaattttaaactgtgagttccactgaatacattttaatgtctgtaggaagaatcaaaacacctatttaaagatggcaatatataataatcattttaaaagtatttgattcaacctaattttccagaaatgaaaaaaaaaaaatcagctctaaaaccaaagctgatttcagaaaatttgaaaatgtaaatcagccctatccataatatagtttctctaaaactttatcttagtcattttaaaataatataactattaaaaaatgtaactgctatcttaatgttctgaaataatttaaaacattttaaaatatgaatactgtagtataaaagaaagaaatggtgggaacgaaaagcagagaaagaaatgccaattccagtccaaagttttatttgccaagttttcttagaatgaattttaccagtttatgaattattgtaaacagaatgtgtcatggaaatactgaaagatttttccctagagtggccttattgactgctggtgtgatgccactgtaatgtaataaattattaaattgtttcaatgtgttaa

SEQ ID NO: 481365 - DNA, 702 bp, Homo sapiens
  misc_feature (26)..(26): n is a, c, g, or t
  misc_feature (29)..(29): n is a, c, g, or t
  misc_feature (46)..(46): n is a, c, g, or t
tttcaaactgaaagtccgtgcaaggnttncgattcccagccgcccnaagtacgtgccgtcatgctgcccagggctcttggccttgttgccaatgagctgtccattcactgagaagcctgtgttggggtcctgtaccaggctcaggataacaccaggctcctcattgatgttgaagcacagggtgtcctctttctggggcacgtggatgatgaagtgagggtctgtgtccacgccggtcactcggtctggcagccgctgggtattggagctggaatgagtaggagaaggctgcaaggctgacagcacgaacgtccttctgggtcccagcatctccaaaggcggagaatcctctgagggcttgtcgatggtgggcttcaggccgtcctggtccgccatgcccctgatgctcatggaggtcagtggggtcacaaacccatagtccagcgacatccgcagggcctgggatgacaggttggccctcacctccctgtccaccttcatccgcttggccagcagctcctggatggtgaggtaggcccagaggcgctcgacgtggttctccagcatgtggccacgctctcggagcagtttcttcatctcctcctcatccactaggcaggttatactgaattcttgtccctccccatgggcctgcacatcagccttgaagctgctctgtttgttgtcagcaatgcgcccggc

SEQ ID NO: 481366 - DNA, 307 bp, Homo sapiens
gtgctctagcggatccctatcgtaatatgtatcacagactagacactgagtatatgggactccaataaacatagtaaaacactttaacattatttacttcaatattatcttggaattattcaatggtttccggagtttatagttaactgatgtggtaaccatgaattcccgacccaattggtagcggatagatatattaggggcggttggttggtcctttcacatgatccaccgggaggagcctccctttggtaagaaacatcaaggtcacactggttacatattacggggggtaccgggctcgaat

SEQ ID NO: 481367 - DNA, 671 bp, Homo sapiens
tccgtgaaatatcctttgttaatctcgacgattgttttccataaattctggaaactttgattcgctccccacatttattagaccccgacacccgttgtgtggtcctcaataacattttgttagtgtaaatctcacctggtgaccacaccgttatctccgtagcaatgtgcccctgtgtcacctgacaagtctgttaaaacatatgctgcggaaattttaccccgattttacgccccttggtacaaaccctgcctattcagccttgtcttgaaatcgcaatctttcgagtattgcaaccgccgcggtgtaacacccgttgggtttctaaccgcgggcttcaatccgtgatgtctgttcccctcttcccccgcaagggtcatagttttaacattggcctttcaaactctgttatgcccccccccatttttggggggaaaacttttccacaaataaccctacttcttttgaacctgagacttaggaccccattaatttggcgtgctcccgcttcccctcctagtcttttcctgcttatatataacccaccacccgcttaatttgggggtgtacaattaaatgcaccggtgctttaatcaacgacccggtcccttttcctcatttcccaaaaaatttgggataaattttaaacactttaaatctagacctcgcct

SEQ ID NO: 481368 - DNA, 1116 bp, Homo sapiens
cccactggcgtctgcgctatctgcggaccagcgctggtgccgctggcccggagaccagtggtggcctcccgagatggccgcttcgctccgtcgggaatgcccacgcattgtttggatgatacccctcgcggaccgtgagcgaggaaagtaggaggttcatggcatatggaatgttcgataagctcaatatggagaaaaaggcgaattgcatgggcatctgaacgaagcgattagtgagcagctagctctaatcggcctgcggtggtgtctgagacgctcatgtatcacgtagcagcctgtcttggacacagccacagtcccctagagcaaggacaaaagcaaccctggatgcatgggtctggcgagtcgcagtcgagatgcgcgagtcgagatggctgtaggacacagtgaactctgtgcttcaatgccgttgtcatctgaaatgccttttgaacgggggcaatgttatgaggcatgcccgcaggagagggcaccaagggcccccagcttttccaggcccgatttacccgtacgggaagcaataattcatggcctggactgactggaactgcatggcaaagaaggtggcatgcgccagtgaacggattaccccccagtaagtgtacacaatcctcgtgttactggcggagtcctatgtgttgtatcatatcatatgatgaatatcgggagcttcgcaaggacactgtaacgagaacggatgcaattggccacgaaacgaaggggctaaagaaggggaggctcccaagggaggtcctgcgcgtagcacttagggatcccccccatccgtagaaagccattgtcgcactgtggtgcggcttattgtaacacgaaaaccgcccagagtggggtggccacccaatcgttacccttgcgaggtctcttacccccccttttcaccgcggcaaacaggcccaggcggacactcgtggggaacactgaccaatgaccctacttgggcgacaagaggaaaacccccgcggggaaaccaagcaaagaaccgccggcaaggaactccgcgggaacgccgggagcaagaccgaagaacccaggggacatccgcagtaaccggaggaacacggaagaagccgcggagaa

SEQ ID NO: 481369 - DNA, 342 bp, Homo sapiens
ggggaaatatctgaacgaacacttctgtatttacagaaaatgacaacgatgacgatgaagatgttcaagttgaggtggctgagaaagtgcagaaatcgtctgccccaggtaacactgaatactcaggaacaattaatggatggtaacatatgaagaatatctaggaggcacaccctctctggcatctatgatgggccaaaacccgcattcgcttggcctcagtatgtgaaatatacccagcttagacacagggtgcggcagtgtcatgtttctctatgtgtccgagtgtcatgtcttcaccgtacagggatgcatggtcttactctctcagctctatctgac

SEQ ID NO: 481370 - DNA, 139 bp, Homo sapiens
aaggagatttcacggcagcaacaatcctacctccatcgctaaccccacataaaacactcaccaagacctcaccccctgtacccccatgacctcaggatactcctcaatagaccatcgctgtagtataaccaaagacaac

SEQ ID NO: 481371 - DNA, 500 bp, Homo sapiens
  misc_feature (368)..(368): n is a, c, g, or t
  misc_feature (451)..(451): n is a, c, g, or t
  misc_feature (489)..(489): n is a, c, g, or t
ggcccaagaattcggcacgaggatgtattcatctattgaaacaaaatatgacatatactacattatagattatcactaaggatttataatcatctcttcatctaaaataaaaaattaactggagcctgttgaatgtgaaataaacaaacagtaagtaaaaaatgctcctgccttgttcaggcagcagatatacgcaccgatataactttttgaatgattaaccgcggcattatttggactctccgttttagggactggaaatcccagcctggttgaatgtagttcccgataaggatctcctgaaatctctaaaggtatgacacatactgtatagtccaatctgaagtggggagcgggccgcaagcttnattccctttagtggaggggttaattttaggcttgggcactgggccgttcgtttttacaacgtcgtggactgggggaaaacccnggggcgttaccccaacttaattcggccttgccggcacntcccccttttc

SEQ ID NO: 481372 - DNA, 380 bp, Homo sapiens
  misc_feature (10)..(10): n is a, c, g, or t
  misc_feature (43)..(43): n is a, c, g, or t
ctgattttgnaaggtgagagaacgaatgtgagatcaggtaacntggtgatagttgcagatctgggactagaaaccaatgaagttatgctcagcatggttgctcgtgcctgtaatcccagcactttgggaggccaaagtgggaggatcacttgaggtcaggagtttgtgaccagcctggccaacatggtgaaaccccgtctctactaaaaatacaaaaattagctgggcatggtggtgggggcctgtagtcccagctactcgggaggctgaggcaggagaatcgcttgaacctgagaggcggaggttgcagtgagccaaaattgcaccaactgcacactgcactccatcctgggcgacagtctgagactctgtctccaaaa

SEQ ID NO: 481373 - DNA, 355 bp, Homo sapiens
tatcggacacgttttatcgggacgcggcctgtgcaacaagtgtacgacagtggcgccataggatccacacagtcaaacagcatgtgccggcgatcgggatcctataaataaaccatgcccatttaagtaagttgttgcgccccacgcccttcatcacgggattcatcccagaatcgagtctataagtgtaactcgcaccggtcgcctgcacttggcgtaccgaccacagaaacattatatccatgtaccttacatcgcgattaagacatgcataagataatgtgccgggagaggaccataaaagagtttcggttccgaattcctcgtgcgccgaaccgtcctttttgcaggcccc

SEQ ID NO: 481374 - DNA, 320 bp, Homo sapiens
gatccatttgtccaaaatgtataatgaagatttgtgcatttacatgcctgtaatcccagcactttgggaggcaaggcaggtggatcacttgaggtcaggagttcaagaccagtctagccaacatggcgaagctctatctctacaaaaaatacaaaaattcatcaggcattgtggcttgcaactgtagtcccagctgctcgggagcctttaggcaggagaattgcttgagccctggaagcggatggttgcagtgagccgaggtcgcaccgttgcactccagcctgagtgacagagtgagaccctgtctcaaaaagaaaaga

SEQ ID NO: 481375 - DNA, 975 bp, Homo sapiens
agcggggctgtcctggcaagccgacggccgctgctggcctccgtgacgcggcctcctccgcgcctcgcgtgatggcgtcgagaggggccgcggagagcccgaaatgcgagggcatcaagttatcagcacgatgtcaaaccattgtgtccccagatttgccggggctcaggtgtggcatggttagagtcctcagaagcatgtgtcttccccagtctctgcagcaacatagtatccgttgtggacaggaaccaccatgtgacagagcagaaaatatatacgtgaagacatggccttgtgaagcttcaaggtttttccacctcagtattgatcttctgagataactcttgcatccatatgcctattctccttatacccttgagtccagcacagaatgtgaactcagtgcctggcttccaggtatctttagtaaccaacccagttgttaccgagggttgcaaacagtgaacccatcgaacctgagaaacacattgtccctctcccataagtaaatggagaagcttctgctatgaagaacgaaacgaccctatgagtgagcacaaggaaccgtaatgaatcaggcaccagcgtttgaccagttgacacggggcttgaatggcaacacctaattaggtccaatctggacgcattaacaatccgagccttacaaggttacacagttaattggtaccattttacacgcctgacaaattagtctcggaaaactccgcaatgggttaccccttacagcgaaccaggacaggaaacctcccagggaaaattccatttggcgcacgagaagatggtaattcgtaaccgttctcaaaaacctgtgaagtatctgggacattttaatacgcacacaagtgggagacattgcgcctagtaacatggccaggtgttggcgaataatatatacaaatatagtgctcagagagcaattacacgacaagacatccgccaaagtgtgggagtacc

SEQ ID NO: 481376 - DNA, 574 bp, Homo sapiens
tcgactactatgaggatccccgagtgtacttgaagatatgaagtcttaagattaaggaatacagcagcaagacttatcgacacctatatgttagcacatcaggctcatgtctgcactgacgagatgggatgagtcatgacatcaccttaccagccacaggcaggcaaataaatgtgcatagatatggtacaacgtgagagaggtattacaataaagtagatctatattagctgtacgagaaagccagccgcggacggcaccagtgtccaactttgcggtcgacagtggagactccactgccgtgccctctagttgcctcgatgacgttcagtgggggttttacacgatctaacaaaagtggtactcatagtgctatacagtggaactcacgtgtcctgttccatcgttcagcttacgtcagatcctgcttcgtgatacaggaggggaatgaaactgaccatcagaaaggacaccaggcactgagtggcgtgccctctcttggggcatcctggtcctatcgaggagtccgtcttctacagctgcttcttgtagaacactcgggtaccgtcctcga

SEQ ID NO: 481377 - DNA, 334 bp, Homo sapiens
gcccagagaggcagaacgcccatcccttaaccaattgggacccagaaagcccggcagaaagaagccttctgctttcccagaagcggtagtgagattttgggaacagggcttgatcaaggaggtggggagagaggaagacggagtagcgaggcaagtgaggccccctttccatgcatcgcttggggtgtgatgaggagagcccatcaatcattcatcctttcattagggaggtcccactgtacccattcatccatccccgcccttccaggtgcccatccatcctggtgaaagccatttgccccactcaataaaaccgggcattcctccttcggga

SEQ ID NO: 481378 - DNA, 217 bp, Homo sapiens
tggtgcatctactcttcaactcttcttcttcctcagatcatttagttctaggcgtgtccagtttgagcacgtactgatgaaagtcctccagcgagtgataaggccagtgtctgcctgggtaataaagcctgtctcatctggtttgtcttcatcactttcttcctcttcctcttcttcttgaggattcttcatcagacttggttccaagttcccaccc

SEQ ID NO: 481379 - DNA, 588 bp, Homo sapiens
  misc_feature (13)..(13): n is a, c, g, or t
tgcagcactccgnatgtgcaggagcggatgaagaatctcctgcagggtaacactcagtctgtagggctcctgctgagcgagagattcgtcaacgtcccgccgcagatcgctctgcccctgcacaaacaactgcagaaggaaatggctgaagctcaaaggaccaataaacccagcggtaaatgccagttctgtctgatgattagcaaaacatgcaagccattgaagaagaagagcatttctgcaggagaccaggctaaagacgagctgctgttcgtgaacgacgaggaggagttcttttatgagcaagcaacggtgaagttcagctactgtgttcaggatgagcgggactcgtgtgcgacagggaaatggtcgtacgatgacgagccaatgaagccgtttcgcacagtgatggtgatccccatggacagaatggacaccatcatgcagaaaatgactgattatctgaccgtctgaacacactttaacctttcaggccagtttgaccacaaatcacccaaaccagtgaaataatttattcattctgtacataatcagcccacaaaaataataataaacaacccaaacaga

SEQ ID NO: 481380 - DNA, 368 bp, Homo sapiens
tataaaaaaaaaaaaaaaaaaaaaaataattttggcccgtcctgggcctttgctcccccccctgtttttgggcccttataagccccagtagtggcttcaaagctggggaacaaaaattaaaatgaaaaacccctttcgtggagaatttgcctggggaaaaaaggaaggggttttttagggatgttcccggatttcttttaacccttttcctttcccccccaagttttgttgggaggaaaaccaattattatgaaaagcttttattggatgtttaaaagtttcatatgttcccaagctttaatttggggatcaaaatttaaaccattttttaaaaggattgttcccttaaaaaactaatttcaaaacca

SEQ ID NO: 481381 - DNA, 106 bp, Homo sapiens
attcggaacaggagcgctgcggccccgagcgctcccgctaccacctgcagcagaacgtgcagttctccgaggacacagtgaggctgtacatctgcgagatggcact

SEQ ID NO: 481382 - DNA, 426 bp, Homo sapiens
ctttctaaacttcagacaccacagacagatcttgatggattttgccatttctgcacaccattctaattttatatttaaaactactatgtgcttagtacttttaaagtcaactcactgtttgatgtaaatttattttaaaaaggaagcatatcactttggcaaatggaaaattagtatcactttctgcaactagaagactaccttaaaatgtaataaaaacagtgttattaaacactagctatgcagtatggccagtgaagagagcccaaagtctatcctttttttaattaaaaggtgtgataagtaagtaacgttaggtaagggtaaaagacacgtaaacaccaaattgagtctttctgcatgatgtgatcaaatgggttttgaggacttttcttgagtacttaccttaccatcctactctgggaa

SEQ ID NO: 481383 - DNA, 336 bp, Homo sapiens
  misc_feature (38)..(38): n is a, c, g, or t
  misc_feature (53)..(53): n is a, c, g, or t
  misc_feature (69)..(69): n is a, c, g, or t
  misc_feature (90)..(90): n is a, c, g, or t
  misc_feature (92)..(92): n is a, c, g, or t
  misc_feature (95)..(95): n is a, c, g, or t
  misc_feature (122)..(122): n is a, c, g, or t
  misc_feature (303)..(303): n is a, c, g, or t
  misc_feature (310)..(310): n is a, c, g, or t
ctggctgcaccccaacacatggccttccctgccccagnccacaccgtgcacgnaggggggcacaggggnaggtagaggggctgtgccagngnctnccccatttcccagctcctcacagaggncctggtttgctcagtcttctgaactccagggaccagccctgtgggcatggggtggggagcagggagttgcccttgccctccctcgggaagccacctaagaatgtttacatgccaaacagaatgtaacacccctccccaagcccttcccagtcactgcatggcctctgcccatcctgaactntcaaccncaccccaacaccctggaagccactgt

SEQ ID NO: 481384 - DNA, 396 bp, Homo sapiens
  misc_feature (389)..(389): n is a, c, g, or t
atccccccacgtggccgcgttttcatgtacaatcagcacggtggctgtggttggcattttttccacggtgaacctcgtgcgcgccttagcgcttgaagttcacagtaaacaggcctccaccggggtgctttacattgggcgtcaggcgcttttcttttgatgacaaccacataaacagggctttgcttttcaattgatgacacgcaggctataaaaccagtggccctgcaaaccccggctttagggacaacaataaaaaatgcctgctctcgttcgtgccgccagcttgaccaactacctggaagtgtcccgccatctgggcctcaacccccatgcactgcttgcgcaggtcggccttaacgccgccttgctcgacgaccccaaccggngtatccc

SEQ ID NO: 481385 - DNA, 80 bp, Homo sapiens
tttcttgcacaaatggcattttattatagataatctaatttacaaagctttgtaaattttaagaaaaacattcatagatc

SEQ ID NO: 481386 - DNA, 838 bp, Homo sapiens
  misc_feature (236)..(236): n is a, c, g, or t
gctccatgagcagtgctgtgctgcaggcggtacagtaggatgtgtgagctatcttgctccctcatggtcgtgactcggtgctccccgtggatggtgctgggtgtgctgtggtgctccatggcacagaacgctgatgctgtgctccttcatgctggtcgtgggatgcgcataacgcgcacgaacgatgtgtcatcagttggtgggaagcaagtgtcgtggtaccggtcagatgatcntgatggtaggattggagatatgaccgactggtcggcctgtgaactgagctattgcaagagggtgcgtaggttgttgtcaagaggattctgcttttgattgcctaaacggtgtccgcaagagatcagggtgagcgcggtaatgcccgacctgagtgaaggctgcgtgtgcctggaatggcacatgcgtcttcccatgccttgctttgagacgaacgtccatcgtatcgtgtatcatgtggtcccccatagtccacagcgactggtcttgtcccagtgagtgagacaaagcgactcttcgtctaacctggctcgtagaactcaggttccttcctgcactacagtgtgtcatcctctgtttgaccctgcgggtcctcccagccctgagcctgtggccctcgggggtcctcctgagtacctgggacaaagacacaggttggaggacgaggaggacgaagggaaagaggctgaaacggtggggggggctggccagcctttcggccgattctttggagaagtggggttctggggtcaccgttggggggacccccacgggggttcctggtttcttccgggagggagatcaccacttcttctgatgtgac

SEQ ID NO: 481387 - DNA, 1014 bp, Homo sapiens
  misc_feature (20)..(21): n is a, c, g, or t
  misc_feature (37)..(37): n is a, c, g, or t
  misc_feature (57)..(57): n is a, c, g, or t
  misc_feature (66)..(66): n is a, c, g, or t
  misc_feature (87)..(87): n is a, c, g, or t
  misc_feature (109)..(109): n is a, c, g, or t
  misc_feature (112)..(112): n is a, c, g, or t
  misc_feature (125)..(125): n is a, c, g, or t
  misc_feature (160)..(160): n is a, c, g, or t
  misc_feature (163)..(163): n is a, c, g, or t
  misc_feature (175)..(175): n is a, c, g, or t
  misc_feature (180)..(180): n is a, c, g, or t
  misc_feature (233)..(233): n is a, c, g, or t
  misc_feature (311)..(311): n is a, c, g, or t
  misc_feature (322)..(322): n is a, c, g, or t
  misc_feature (361)..(361): n is a, c, g, or t
  misc_feature (386)..(386): n is a, c, g, or t
  misc_feature (388)..(391): n is a, c, g, or t
  misc_feature (423)..(424): n is a, c, g, or t
  misc_feature (446)..(447): n is a, c, g, or t
  misc_feature (511)..(511): n is a, c, g, or t
  misc_feature (743)..(743): n is a, c, g, or t
  misc_feature (931)..(931): n is a, c, g, or t
  misc_feature (933)..(934): n is a, c, g, or t
  misc_feature (974)..(974): n is a, c, g, or t
tgtggaggtgtcgacaaacnnaaaaccatgaaacatntattattgctactagtgtgngtgtttttntagggttgagtcccaaggtgncaacgagaatgaggagggtttnttnagtgcccgtggtnatcgaccccttgagaagaagagagaagaggctccnagnctgaggcctgcnccacngcccatcagtggaggtggctagtcgggctcgtcgcagccaaagcagctgccantcaaaagaaagtagaaagaaaagcccctgatgctggaggctgtcttcacgctgacccagacctgggggtgttgtgtcntagaggatgtnagttgcaagaggctttgctacgaacaggaaaggccaatnagaaatagtgttgatgagttaaatncnnnngtggaaggtgtttcccagacctcctcttcttnntttgagtagatgtatttggtgnnagaggtgtgggaaaagaggcagaagcaagtgaaagataatgaaaatgtagtcaatgagtactcntcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaanatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaacaacacagatgggaagantnntgtggcctacaggtgaatattggctggaatgataaaatanccagcttacaggatgggaccacagaactttgatagaatgg

SEQ ID NO: 481388 - DNA, 399 bp, Homo sapiens
ctctagagttatcccccccgaatgtggactcagcgatggcatcttcttgcgtggtgctccagggctctttggatctctgggcttctcaagattctgctaatatctgtattaatcatcttgtgcatagtacgattgtagttctcttgagggaagcggctttacgccttgtgccgtacaattcatcttacttccggaaagcactttcagtccaaatgcagaaacgtcccacatgccctccaggagctagcttcaaaatgttcagcttgcttacattaagcagagtaattccaggcatgtttctgaaggccttattgaataccattttcctcattatctataatgcccgggcccctgcgctggatactgcgacagtatctcacgcttgcgtccacttttttg

SEQ ID NO: 481389 - DNA, 139 bp, Homo sapiens
cagcacagcgaaactgaaggtactgaccacgtacatttggtttaaacctttcacgaaagagatcggcgggcgatgcgccgtggcccaagcgcaagaggatggcggacgtaggctggcatattgtccggccgtgcgaacc

SEQ ID NO: 481390 - DNA, 391 bp, Homo sapiens
  misc_feature (73)..(73): n is a, c, g, or t
  misc_feature (312)..(312): n is a, c, g, or t
  misc_feature (361)..(361): n is a, c, g, or t
  misc_feature (366)..(366): n is a, c, g, or t
tttcttatgtttgctgattttacagttctgactaaagctgacctaaatggatcagtttatgtgtaatattctngtgctttaatgactctttttttctttggagggagggtaacattatttggacagatgcagaaggaactgttagtgagtcaagacaaacacatctgaaataaaggaactgtgtattaacatgttaacaattcataactgcactttttatgacattttgaaaatctaatttattagggtacagaacaatggggtttttgttaaacctggtatcaccatttaataccttggcaagaaaatttnattttccattggttaattaagttagggaattttaatttggggtccaatnaaaanttgggccaaaacctggaacacccaa

SEQ ID NO: 481391 - DNA, 432 bp, Homo sapiens
gatagttataacttgacctagattagagagctgcaagcgtacagtgataatatatcagatttcggtgacaagtgaccagtggaaaataacatagtagaaatacatgggcctcacagatcatccaaacatgtgaccaagaatccctctttgatcaaggaagggtaaagtcgcttgctagtgctcgccgcagagacagaagccagagagccttgggaaacagccattccctcacttatgtaatgttcctgatcttattacaatacttcatgggatttctgaaccttacgatgtcagtcctcttctgcgttacatgcttccccatctggtcgtctccatcattcatcatgtcacaggagaagacactgaaggaatggatggtcaaatctacaagagacacttagcaagctatactgacaaaaatatcactgcagc

SEQ ID NO: 481392 - DNA, 102 bp, Homo sapiens
ttttttttttttgggccacggcctcaaaataattttaatacaaaggatgcaaacatctataaatgaaaaatgtggttcttctgccccttctgtcgtcttctc

SEQ ID NO: 481393 - DNA, 1008 bp, Homo sapiens
  misc_feature (184)..(184): n is a, c, g, or t
  misc_feature (187)..(187): n is a, c, g, or t
  misc_feature (207)..(207): n is a, c, g, or t
  misc_feature (298)..(298): n is a, c, g, or t
  misc_feature (334)..(334): n is a, c, g, or t
  misc_feature (821)..(821): n is a, c, g, or t
  misc_feature (825)..(825): n is a, c, g, or t
  misc_feature (829)..(829): n is a, c, g, or t
  misc_feature (832)..(832): n is a, c, g, or t
  misc_feature (838)..(839): n is a, c, g, or t
  misc_feature (842)..(842): n is a, c, g, or t
  misc_feature (851)..(851): n is a, c, g, or t
ggttctcgccaccctaacaccgtctggcctcgccagtagacgatggggctgctgacgggccacctacagagcgcaggcgtcaaggtgcgcactgctcatgcagctgctggggacactcggaagccatgccagtgcgggccttctctgctctctctggcttgccctgcgtgacaaccatacccantcntgacatccaggtgtaaactnctttgtggtccccgcggatgaggcccaggctcgaatcccatatgcccgtgtcaaccacaacaagtacatggtgactgaacgcgccacctancatcggaacctccaactggtctggcaactacttcancggagacggcgggcacctcgctgctggtgacgcagaatgggaagggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtacagccatgaaaaaaaaaanaaanaaanaanaaaacnncanagcgcactntgtatccagatgagacacaaagaccgcacagacaggacaacagtgcactaaggtgattccctgtcaccccagctagctggtacaacattgaaaatctgccggaaccccatacagctagcccatataacgcgaaagcggttacacgattaataacgaa

SEQ ID NO: 481394 - DNA, 1064 bp, Homo sapiens
  misc_feature (184)..(184): n is a, c, g, or t
  misc_feature (187)..(187): n is a, c, g, or t
  misc_feature (207)..(207): n is a, c, g, or t
  misc_feature (298)..(298): n is a, c, g, or t
  misc_feature (334)..(334): n is a, c, g, or t
  misc_feature (877)..(877): n is a, c, g, or t
  misc_feature (881)..(881): n is a, c, g, or t
  misc_feature (885)..(885): n is a, c, g, or t
  misc_feature (888)..(888): n is a, c, g, or t
  misc_feature (894)..(895): n is a, c, g, or t
  misc_feature (898)..(898): n is a, c, g, or t
  misc_feature (907)..(907): n is a, c, g, or t
ggttctcgccaccctaacaccgtctggcctcgccagtagacgatggggctgctgacgggccacctacagagcgcaggcgtcaaggtgcgcactgctcatgcagctgctggggacactcggaagccatgccagtgcgggccttctctgctctctctggcttgccctgcgtgacaaccatacccantcntgacatccaggtgtaaactnctttgtggtccccgcggatgaggcccaggctcgaatcccatatgcccgtgtcaaccacaacaagtacatggtgactgaacgcgccacctancatcggaacctccaactggtctggcaactacttcancggagacggcgggcacctcgctgctggtgacgcagaatgggaagggcggcctgcggagccagctggaggccattttcctgagggactgggactccccttacagccatgaccttgacacctcagctgacagcgtgggcaacgcctgccgcctgctctgaggcccgatccagtgggcaggccaaggcctgctgggcccccgcggacccaggtgctctgggtcacggtccctgtccccgcacccccgcttctgtctgccccagctggaggccattttcctgagggactgggactccccttacagccatgaccttgacattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtacagccatgaaaaaaaaaanaaanaaanaanaaaacnncanagcgcactntgtatccagatgagacacaaagaccgcacagacaggacaacagtgcactaaggtgattccctgtcaccccagctagctggtacaacattgaaaatctgccggaaccccatacagctagcccatataacgcgaaagcggttacacgattaataacgaa

SEQ ID NO: 481395 - DNA, 190 bp, Homo sapiens
ccacacagtgattgctcagccagagcacacaaatctggtacacacggtctgtgattgaacacttctgtcactccactcgggacgtggctcctctcccatttcacctactgaaaataacaccactccaccatgatgctttgaccccgggaatactggagaagggcagaagaagaagcctaaaatgtctgat

SEQ ID NO: 481396 - DNA, 542 bp, Homo sapiens
  misc_feature (22)..(22): n is a, c, g, or t
  misc_feature (355)..(355): n is a, c, g, or t
  misc_feature (359)..(359): n is a, c, g, or t
  misc_feature (363)..(363): n is a, c, g, or t
  misc_feature (366)..(366): n is a, c, g, or t
  misc_feature (372)..(373): n is a, c, g, or t
  misc_feature (376)..(376): n is a, c, g, or t
  misc_feature (385)..(385): n is a, c, g, or t
accacctgcactcctgctcccnaggccacgaatttatatcgaaggccaaagacataatgggcacactaggacccaggtgctctgggtcacggtccctgtccccgcacccccgcttctgtctgccccattgtggctcctcaggctctctcccctgctctcccacctctacctccacccccaccggcctgacgctgtggccccgggacccagcagagctgggggagggatcagcccccaaagaaatgggggtgcatgctgggcctggccccctggcccacccccactttccagggcaaaaagggcccagggttataataagtaaataacttgtctgtacagccatgaaaaaaaaaanaaanaaanaanaaaacnncanagcgcactntgtatccagatgagacacaaagaccgcacagacaggacaacagtgcactaaggtgattccctgtcaccccagctagctggtacaacattgaaaatctgccggaaccccatacagctagcccatataacgcgaaagcggttacacgattaataacgaa

SEQ ID NO: 481397 - DNA, 1167 bp, Homo sapiens
tgggaacacgagaacatacacccagctgttagggattcagtgaactgggaattgtcccacctcacttcactttcactcatggccaactcgtacgagcacagcattcatgctcgcgtatatcctcagcacaacagctcaggcagccagcattgcagcaagagcaagtccagtgaaggcccatgcatgcacagtccctcaacacatcactgcgatgtggattcagtgtctgctcagacagccccttagtcagtatcgagctgcaaccatccatcacaggctggccatccatgtaccacagactgtctgaggaatcaggttggtgatgcacaccaccttcaggcaaaccaacaccgggtgctggccagatcttcattaccagcaaggccgccaaagctgtatcagctgctgcaacagcatgctccctgcgacactgcttcagagtacagctagcagcagcagtcagcacataatgctgcaatttcagcatgcaccagtccagcacatcagccaatgtaggcaacagttgccaacccactcatctggggctcttcgctatacatggttgagcaacctgcagcaggcattaccagcgttatccagaagggagcttatagaccagaattacggaccacgcctcacgaagtggtgacggccgctgcagcttgctgactgcttctcctagatctcacactcgacgaagccacgtgactgacaaactgccttccgggtatactccggcagtctcgagatggtgcataatcatctaccttccgatccatttacacctggctacatcataccagcttacaaacgacgagaccacggcattaagatcggacgattgcgacaataacaaaagaaaccaaaccaaagacaacaataaacacacaagagatgaggcagacagcatggaacaatcaaaccgcgcaccagactggcgcagacccaacggagactacagaccaccctggctggggccagataaaccgagcgaaagtgcccaaaacacgacaaggcgcgcaggggtgcaccaagcacggtccaacacagcgtgcaagacaaccaggggagggaaggacagagaggaggagagacctactccacggcccaccctgacacaaggagaggaagaccacaaagaagacaacacacgcgacacgggaacac

SEQ ID NO: 481398 - DNA, 187 bp, Homo sapiens
acagaatcataaaaaaggctgcagctatgcacctccctctgtgctctctcactctccattctctaaccatgttagatatgcctcctttctatactcatgcatcttattttagtaggttctagatgaacatctgggagatgtagtacttatctctgcatgttctaagatcttgtctaaactgcaatca

SEQ ID NO: 481399 - DNA, 854 bp, Homo sapiens
  misc_feature (768)..(768): n is a, c, g, or t
  misc_feature (854)..(854): n is a, c, g, or t
agcggaggtgtggcgggtaacccttgggggcctcagtgcggcacgcgatggcatgtcggagtgggctttgcagagctctgaacgtgggcggtgggctaggctcgttaacttgccgagatgccctccggggtttgcggatggaggacgctgaggcgccgctggggggacaggcacggcgggacgcgcgggaactgcccagcgcgagcagtgtctctaggtggcggaatgccgtgtctgtgctcgcagacttgcaagctgtggaaggcttggggccctaggaagatagtggctgagcatctcatactccatgtctacacttcgcagagaggggacgcgagaagtgttctacttatcttgacccagagtggtcagggctgtcgtcatgtgcgaggtggcgaaggatgacagtccttatttgctgtgtgtagatcaattcgtaacagagcaagggaaatttaacgattgagttaactgtgtattacccatgaggtatcttgctggcgatggtgtagaaactatagactgggggtttctggcaaaagtgacacttctggtcttttgggctagtatagaattaagcaaattcaaggcagggcgcgtttgttggcgaaggagtgtgtagagcttgtgtcctagtgcgaaaggtaagtgtatgtagagcggcaaagatttgcagcgagagtagtaatggtcgtcacaatactttggtgaagagagtaagacgttttgtagttgcattgtgggggaaaagtcaaggtaagtagtcangaaggttgttgtcgcaatatatgtccaaaatttgggttaaaagccaaggggcgattccatcttaggggagtgggctaggacggaan

SEQ ID NO: 481400 - DNA, 380 bp, Homo sapiens
caccggcaggttgtactggtttcccctctgcagtgccctggcccgtgggagggggaaggctgattctaatggtggaggaatcccagcttcagtggcttcaaggcaggccattcaacttaccgaccttggcttatacacaccgacgagacgcaacacagacgcagacactagactggcatttgggactcacactggccatgtactcaaaaaggcaggacagcccgttaggggcccaggaatcaaaggtggggagtggggaaaaggaacccacccctctgagggggaggaggagggtctaggctgcggtaggagtagagagatggctacgaggactcagtcatctctagttcctgaaattccctagtacaacctgccggtgg

SEQ ID NO: 481401 - DNA, 279 bp, Homo sapiens
caggaatttatgaaagcagttcagtaatagccaggaagctttttcaatacgtgcggctgtgcaccacgctcattactggacgtacgaagtacatctgaatgagccacgcaaatctcatgcaatgctgctaaattccagggacaggtccgttctataatgctctgtagtgtccggaagtgcaggtacattcccaagttcatctaaaaacatgatcatacgatgtttgttgctgttgatgaatggatcgacaccttccatgtagtgctccttagctccaaa

SEQ ID NO: 481402 - DNA, 489 bp, Homo sapiens
gtcttctccccgacaccagaacaagaaaaggatgccctctctcaccactctattcaacatatacagcactggaagtcctagccagagcaatcaggctagagaaagaaataaaaggcatccaaataggaagagaggaagtcaaactatctctgtttgcagatgatatgatagtatacctaggaaactccacaatatctgtccaaaagctactagctctgataaacaactccagcaatgtttcaggatacaaaatcaatgtacgaaaatcagtaccatttctacatacctacaatgtccaagctgagagtcaattcaagaacacaatctcatttacagtagccactaggaaatgcaatacctaggaatacagctcactagggaggtgaaagatctctacaatgagaattacaaaagactgcatgaagatattagatatgacacaaagaaatgaaaaaacatttcatgtcaggggagaaggggtacagagct

SEQ ID NO: 481403 - DNA, 322 bp, Homo sapiens
tgatcgagccggtacccagggacagcaagtatgagcaggcgcctgtttggttagtgttgtacagcccatgagctaggagggggttttcatttgaaagggttacatattgccgggcgcggtggctcacgcctgtaatcccagcactttgggaggtcagggtgggaggatcacttgaggctaggagttcaagaccagtatgggcaacacagcaagaccacatatttacaaagaatttttctctttacctgtctgggcctgatgttacccgcctgtagtcccagctactctagagactgaggtgcaaggatggcttgttccgctg

SEQ ID NO: 481404 - DNA, 339 bp, Homo sapiens
caaattgatcagtggttcaggcttggagtatgcatcagaattatctgtagagcttagtgaaagtgctgatgcacagagcccacccaaagcttactgcttcagaacctctggggacctgccagttctaatgtgcacgcctagtcaagaatcctttaaaggctgataaacgcattcttgaaatcactgtcaatgcaaaagtgaatgttcttgtgcctataaaacccaagtgttagccactttctacctataaaattctatccaaaaagactcgcagtcaaaaccccgagccaaaacacaaaagaggcaccaaaacagtgccgacttcaatgtgcagaggcc

SEQ ID NO: 481405 - DNA, 464 bp, Homo sapiens
  misc_feature (42)..(42): n is a, c, g, or t
cgatcgcagctgtcatatttccctaattgtgctccatgctanctggaaagccttctcttctcttccccaacctggtaggttcttacccaccctttaaagcccaaatccaaaggccacttgctgtgaagacttctacccttacctggcaacagggtaaagagttcttcgtcctctatctggtcatcatcacctagggaccacactcagcatcacacatggtggacagctggccttaagtgcctcctgccaacctcaaaggaagaggctggggccacgaaatttcatttggagcgtttacttgagtcaaagtgaggcccgctgctgagaagactcagaatccagtaacctcaggatatgagctcccatttgggcttggttacataccagccggtgtctaaacatatatatgtgtgtgtatatgtctatttcctcccaactccgcctccctagtcgctagggactac

SEQ ID NO: 481406 - DNA, 219 bp, Homo sapiens
  misc_feature (205)..(205): n is a, c, g, or t
acgtctcagactgttgttcattggcattagttagtagtaaagactggttatgatacatgcatcgtaaacttcagaaggaaggagaatgtttgtggaccactttggtttcttttttgcgtgtggcagtttaagttattagtttttaaatcagtactttttaatggaaacacttgaccaaaattgtcacagaattttgagaccattnaaaaagttaatgag

SEQ ID NO: 481407 - DNA, 280 bp, Homo sapiens
acctgacatagagcatgcgagcatgaaggaccaatagcaaacattatcagtacttggaacacagaagaccttcggaaccgagaccactatctcaagcagaagagagctaagttgatgtccatgagaaaggctatgaggactaaccagatacaaaatatggagcagaaaggacaacccactggggaggtagcggaaatgacagagcaaccagaacatgactagcagaggagcagcaaacattactaaagaggagatcgcttgcagagcaagtacggttgca

SEQ ID NO: 481408 - DNA, 187 bp, Homo sapiens
gttgggactttcacgggtttggggtgagctgaacgcttcttaactggctggctgctttcaggcctactatgggctgttaaacttttttactctctctacaaggcttctcttcctagctgtccaacagagctgcttcctcttgggcactaacagcttaaactttacaacgggcgactttagcagcggc

SEQ ID NO: 481409 - DNA, 175 bp, Homo sapiens
gtattgtgcagatcctcaagcagacctacagcaagtttgacacaaactctgcacaaccatgactgcactgatcaagaactactgtggctgctctacatgcttcagtgaaggacatggacaaggtcagagacattccatgcgcatggtgcatatgcctgctcttgtggagtgtgca

SEQ ID NO: 481410 - DNA, 390 bp, Homo sapiens
ttttgtattttgtttttagtagagatggggtttcaacggtgttggtcaggctggtcttgaactcctgacctcatgatccgcccacctcggcctcccaaagtgctgggattacaggcgtgagccacccccccggcctgtgtctggtgtcattttaactgaagttcttgagggatagtttcaaagcctggacaacatagagggaccctgtctcttaaaaaaaaaaaagaaaaaagaaaaaattgcccaagcttggtggcacttgcctgtagtcccagctactcaggagactgagtcaggagaattgcttgagcctaggagttagaggctacagtgacctagcaccatgccactgcactccagcctgggcaacagaacaagactttgtctcta

SEQ ID NO: 481411 - DNA, 222 bp, Homo sapiens
  misc_feature (183)..(183): n is a, c, g, or t
gggggcacccccaccaaacgggacaagcaacaggcacgcagcaacgcagcgcaaaacgcgcagccaagccacacccccacgggaaacagcgaggaaaagccccgagcaaaaaacgaaaggggaacgaagcgaaacaaaccccaggggcgggcaaaaacgagccagccaccgcggcacacgagnaacccaaggaacagaagccggcgcgaagagggggcgaga

SEQ ID NO: 481412 - DNA, 916 bp, Homo sapiens
cggacgcgtgggtgaagattggcacccagacaccattcgcttttcacccaagatgatttagatgtcttataaaactctgatgaaccatgatggctacacagacattaagtatagacagctatcaagatgggcaacagatgcaagtagtaacagagttaaagacagaacaagatccaaactgctctgaacccgatgcagaaggagtgagccctccccctgtggagtctcagaccccgatggatgtggacaagcaggccatttataggcatccactatttccattattagcttcgtctgtctgaaacactgtgaacaatctacacagggctctgaaggcacaacttctgccagtttcgatgtagacatcgaaacatttcgtaacgaacagcaacgagaaggaccgggaaacctttcttcgtgaagatccagaaaccgatcaatttaactggtcaacagcaatccaggttctcgcgcattcatcttcttgagctggccccaggttaacgaactctgcaaagatttctgcagtcgatacattgcttgtctgaacatacaataatgaacagtgaacactctgttgagtggacgaagcctggaaagcccgtactcaccagtgcagtcccagcaggattcacagtgccatcaccaggcaccatcaagccctcagggacttgtggtgccggcgtcccgcgctgacagcagggaaacgtacccatggcgacggtggccagggtggcactgtgtatcacgctgtcacggtcgtcactcctcctaggcccaattgcgtcacacagacccttgtccgcctgggacaattaggaatccaaaactcccatcttcaggtactgttaatcccagatctcaagcatcttgcatcacgacgatgctcactctaaaatacaaagcgcgtctgcca

SEQ ID NO: 481413 - DNA, 1610 bp, Homo sapiens
  misc_feature (243)..(243): n is a, c, g, or t
  misc_feature (408)..(408): n is a, c, g, or t
  misc_feature (1359)..(1359): n is a, c, g, or t
gcggaagatggcggaggtgctgcgtcctggggcttgatggtcgaggccatctcctgggacgccatgggcggccagcgatgggctcaaacaggtacgtgctggggccggaatggtggctggctcgtacgcctgtgacaggcatcaaccatttcgtggcaatgtgtctactagaagaccaagctagagagatcacctggcattggtcactctcgaaaagacggtgagtgtaacacctgaatcctntctcactgagtgtcccactacactgacttccagtggcactgcagaccggcatcatgtctggacgagaacgcggtagacggcatgggtatagtctgtcgcgcaaacataacacactacaagcgaaaggtctcacgagcgcaggcctgcatgagtacccgttcctcnaaaggctagattttggagcgggggcaattcctcgagcccgctcgcatatcagaactaaaggaaagaagatgccgagcatgtggtgtgtttccattgcatgccccgtgcaagaagggtccgtaggcggtctcgaaaaagtcgctaaccgagagggagaaagtcttagcccctgcgatcctcgtgcgagccgccattggggtcttcccaccgtaggcggttgtgtgggctccgcgcacaaggttgatccccaggtgcaatgggggggacagatgcgccaaccccattgggagaagaggggatggaataggaaggggcacaaaaagccacgtacaaaggcgcgtacagataattcaccaaaataaaagcccggggcacatgggacagggcaaagaacccaagacatccgggtcgggaaagatgcgtaaaccgacgaagagaccaagaagacccggccaggatacacggatacggatcggaccggaacagcaaacaatatcctgggagggaaaagggacactcccaagtgaagagttccccatcacagaaacgcaaacccggaccgaggcacatttcccgggcgggatgcctctaggaagaccggcaatatggaagaaggcagggggcgtccaaattccgcgtgccaaaacataggcagagccgagtggaaagagggcccagcaggaggaggctacgacacggaggaaaacaaattcaactcacgcgcagtggggccgtcataaacacgggggggctaggcaccaaaagtgggtcggcagggggggacaagcgatatcaatggccgccttgaacgggagcgagcaccacggggagaagcttcaacatcaggacaaggtggggccaaaaacccccggaggggaggcaccacaaaccgggaacaaagaacggaagagagacaaggagaagtaggagataccctggaacaccagtgcnccgggtgcttacagaaaccacgaggcctgtacgaacagcaatgtggcgacaagaacaacacgctaccaggagacaagggggggagtgagcaaagcacgcgggccgctttccgggaggggcgccccccgcttccagagggagggactccacagaggacgattcaaacatgcgagaacacaaaccgcagggaggagaccacccgaccagaacgaattcaacacagactgaaaacgcacacgttcaatcccaga

SEQ ID NO: 481414 - DNA, 589 bp, Homo sapiens
cctcagctcccaagtagctgggactacaggtcgtgatgtctcgggagtcggatgtagaggctcagcagatctcatggcagcagtgcctgattcacagccccagggcgagcgttacccaagtcccaagggctcctccttcacagtcaccaggcgcatatccacgctcctcacaccagtcacagatgccgaaactcacagccatgtcctcgtcactccagtctcgtgggacactcgagctccataagagacagtgtccactcgaggaactctattctattcctgaggaccaagaacctgaggaccaagaacctgaggagcctacccctgcccccggggctcgattatgggcccttcaggatggattggccaatcttgaatgtgtgaatgacaagtacgggttggggagggacaaaagctgtgaatatggctgtgatgaaccactgctgaaaagaacagataaataccgaacatacagcaagaaaaactttcggatttccaggcaagtgggtcctaaaacttcttacatggcatacatagacgactcacgtggcaatggaacctttgtaaatacagagctggtaaggatgct

SEQ ID NO: 481415 - DNA, 233 bp, Homo sapiens
gaccagggaggaggtttaatcaacttggaccccctccggcctagccgccgaggaggtgcattcgggacaaccactaggtcagaacgcagcctctccagagtcctcaggctcgacaacgattatcctgctgctatcacgctttgatttactgatctcgctgaaaagacagacgcttttagataccgagtcgatagggggtctgcggtacttttcagtagataggtggtgcttgt

SEQ ID NO: 481416 - DNA, 200 bp, Homo sapiens
attcctgtggtcgtctctagcaggatcccctatcttttgctgggttcatggaccctgatgcttttttgccacagaaaattaagggtttagattcttaggagagaagctaatgttcatgttcaattttattcttatttattttttgcttatgttttcttatttcagtactgagttgaatatgatcattattttccacttac

SEQ ID NO: 481417 - DNA, 158 bp, Homo sapiens
gtatgagaataaatcagaaataccagaagctcctagcagtaggttcagcttccactggttctatgtatcccccatttctttccctattcaggtccgatatttcttttttttttttttttattttttttttttttttctaaattttttttatggggggg

SEQ ID NO: 481418 - DNA, 139 bp, Homo sapiens
ctgctctgcgacctgggaacacacacactgggtgaactgttaactttacggatcaccttgctacttgtaccttgccacgttttccgtgcctgacgcacacttcactacttgactcccagtcatttctccatttccattc

SEQ ID NO: 481419 - DNA, 128 bp, Homo sapiens
aaatcccactgtatctgatctcaccgctgctgtagaactattttccaagctctgaatgtatatgacaattattcgggccaggtgaaatgcctagaatatttcagagacagcaactagcagtcgggtgc

SEQ ID NO: 481420 - DNA, 132 bp, Homo sapiens
aggaaaaaaggtggtcaggattagggtggatgtaggtaaagtggcaggaaatcagagttgtttctgcctattgattttattttgctttgtgaaatagaaggcaagatgttggctgagcgtggggtaggaggt

SEQ ID NO: 481421 - DNA, 319 bp, Homo sapiens
tactatcgcccccactagagctcaacgtcctttgttcgaacctggcttatttatcaagtaaattagttgtacagcatgtagctaaaacaaaacaacaaaaaattctaaaaatgaattaaatcactttcatccacttcatcccacaaaattatggatacactgtgcatcatttccacatttctccacaaagaacgagggacaacccaaatgaggcacaatgactgaaggcagcagagcagtctgtctactttctgggcaagcacatagcaatcgcagggaccaaggtcaaggtgatccagcaaaaggttctctccatttg

SEQ ID NO: 481422 - DNA, 174 bp, Homo sapiens
gcaaggattggactggtcggcagtgacctttacttcgggcatcaacatgcacgaaagttgcgctgcctgctgtggcagctgcacgcctctgttccctcttcattccctacccacaaatgacttgtggaccatttttgctatcaaaatatctctggctcctgacatgccagaccg

SEQ ID NO: 481423 - DNA, 197 bp, Homo sapiens
ccgtatatgtgtctatctataatcacgtagagtaaaacggaataatcatgtaggcaaatttttatttggtatttttatggagacagtctcacttggccacccagcttggattgcagtggggcaacctcagtgatctcagttcactacaacctctgctcccaggtacaaggaattctcttgcctaagtctcccgagta

SEQ ID NO: 481424 - DNA, 198 bp, Homo sapiens
cccctttaaaccaaagttttagatggggagtttcaaaaaaccgaatgtaaatcctttatcagattttaacttgggcaggactttaagtgaaacccaatgaaaactttaacaaaaattgttttttaaaacatttacagttttggattttccaggtaaaaataaatagggaatcccaaataaatccctttttagttttga

SEQ ID NO: 481425 - DNA, 195 bp, Homo sapiens
aaaggagcatttggcctcctgcttccttttgtggcctttgccggggtccattcccaaggaaaaaaaaggagcttgggctcccaaaaaaaaaaggggatgaaaccccaaggggccctatttttgggatttacaaggaattttattttttacaagtttgcccttaaccatggtttgcaagtgaacagaacattttta

SEQ ID NO: 481426 - DNA, 373 bp, Homo sapiens
gattgcaagtggaatttaaaataaaagatcaaaggtctgaatatcaatacaatatctattacatgagagcagggtaagatttttaataaacaaaccaaaaccaaaaatacttcattaccattataactgtttcattggaggccataaaataagcccataattttccaatcaaatttcaaaaattaaatcacaaaacagagtagagtgtcagaaacatgtatatcaaaagcatgaaaagactaagcaaacctagatgaggaaatgtgtggtgaaaatggacagtccttggagacaaagctcagaggtgctacctgtagctggcaggatatgttcttgaagaagtaggaaaaaattgccaattaatgtatacaat

SEQ ID NO: 481427 - DNA, 103 bp, Homo sapiens
tacgtctctagacccatccccgggtttcgagtgaagctttcctagagcattggcttagtaaagattctaattctctttagggaccctacacgtaggtgtggaa

SEQ ID NO: 481428 - DNA, 126 bp, Homo sapiens
ctgccactccgtcatcccgggttcaggcgattctcctgcgtcggcctcccgggtagctagagattagcaggtgcccaccaccatatccaggctaatatttagtattctttagtagagatggggttt

SEQ ID NO: 481429 - DNA, 125 bp, Homo sapiens
cactgcactccagcctggacaacagagcgagaccctgtcttcaaaaaaaaaaaagtgatttatttttcccttggatttattaaaaatttatacaattgaacaaattcatccggggaaaagggatt

SEQ ID NO: 481430 - DNA, 549 bp, Homo sapiens
ctagaggatccccaaccgtacacctccttgccgtgtacttcttcatccggatcttggagagtgtacttggtcctccatgttcttggtatcttacattagccatggatgctagaaggcactgcgtgcagtccaggcggttattcatatctttcttcaacagattgctgatgaaatccttggccatcgtcggagatctcatcgaatgcctcgtcgtcgatgtcccccgtggctgaggtaacgttggccaaggtttcgttatcgttgtctcccatgaagggggaaaggccactgactaggatgtagcagatgaccccgatgctccacatgtctgtggcgtagccgatgggctcatagttgatcacttcaggagccacaaattctggggtgccaaagaggaccttcagagaccccgcattctccagcctcctggccagaccaaagtcgatgagcttgatcctggtgcccgtcttgttgacacacatgatgttctccggcttgaggtccaggtgcacgatgccctgcttgtggatgtactccactccctccgag

SEQ ID NO: 481431 - DNA, 624 bp, Homo sapiens
gagggctacccgaggatccgggctttcccctcaaatatcatctttcaactataataaagcctatcctataattgacaaaaaaaactttttggtaaggtaatggtggttgttacttaggctttgaagagtgtaccttggtaagtatttgtaagaagtctatggtgattcaggaaatgtctgtctgcataccttttaggagcgtgtgaatggtgtcttcacttattatgtatgtttatctgtatgtatattccttattttgtcatatatgtagagaaaattgcatgacttgaggcatcatttaggttgaagaagttaatgcttaggatgcattctaggagaaaaaatcagttttaaaaacctttgttgttaacaaagtatatccagattggttaattttattgaagggttttttcctgtaattgataaaaatgtaatgacaacaattcaggcatcataaaatactgaactattgtgactttattcttagaatggctgtcttacattaaacatgtttttagggggaagttaggtaggagatagaaaaataagtgcccctacaaggggcattaaacattacaagttaattcctaagagaaaaatggaatgggccttgaggggaaaaga

SEQ ID NO: 481432 - DNA, 267 bp, Homo sapiens
aagcttttactgcacatttcagacagttatgacatgcccagtcctttcatctctgtctcctcagttaatagaaaggaaacatagcccatctatctggacctgtgtagaagaatttggaggggaaaaaaaaaaaaacaggcaagaattgtccccttatttggtgagctacctttattctgtcccatggttctacagcaaagggtttattataaaatattattccagtttccctcgatctcaatcagggctattatttaatcaacaatt

SEQ ID NO: 481433 - DNA, 176 bp, Homo sapiens
aaaggagactatttactacagttatatgaaaggctgttcgggctgacaaggaatgatcagaaaactagtgataccaaataagtatattcagttcaataattattttcaatgatgaatcacttagtgtgaaagacttgcgttgtgctatcgtttatgtaattacaacatcactgtca

SEQ ID NO: 481434 - DNA, 402 bp, Homo sapiens
  misc_feature (22)..(22): n is a, c, g, or t
gacaagattgaggcaagtaaanaattttaaaaagctggttgcaagtaaaagaatgaaaaaaaaggccaaataaaaacttcaatctacttcaactgctgaaaagtcctcttttacaaaccttattctgctgaggagccccattatttaacttacgtattcaattgtcaacaataaaaactaccaagttgccactgctaccatttataatcaaaatagtcttacttaattattgagctcttaaactggggtggtaataattttttatttgttttctaacatcactcaaaacttagagacatttttttttaatgggaattaaaggctgtaatttcaaggtccataaaacaagtttgtagacattaatgaagctattccctgaactccaaaaaaccaaagcaagag

SEQ ID NO: 481435 - DNA, 536 bp, Homo sapiens
  misc_feature (36)..(36): n is a, c, g, or t
  misc_feature (38)..(38): n is a, c, g, or t
  misc_feature (71)..(71): n is a, c, g, or t
  misc_feature (108)..(108): n is a, c, g, or t
  misc_feature (113)..(113): n is a, c, g, or t
  misc_feature (149)..(149): n is a, c, g, or t
  misc_feature (152)..(152): n is a, c, g, or t
agtagcgtccactatgcgtagtatctgcgcgtagtngnatcgcagagacgcctctcagcacgactatgctngtaacctcagcctcacacaccgccgcgggactatctntgaangcactcatcaataataacagacacatgtcatgaggnggnctgcatccttcttcagtcatctatacctgcgcgagcctgtcgctgtcttcggtggtacacgatgagtcagacagaaagtgtcccgccgctgtcgggtgcgacacactatgtaatacctctcggcgtaccgggatatctgcgtattaattttttatatattctttgataattatggtgcagtaattaatatatacggacgatggatgattgattttttatagtgaatgcgcacggtagtgtaaggtgacgatttagggaagtatttgtgagtattgttgagatatattatgtcgtaatattgttgtatattaggtgcgggatgttagctgatctaatgcggtatgtgggacgtggttggattacgaggagagctaatgtatgacg

SEQ ID NO: 481436 - DNA, 109 bp, Homo sapiens
ggtgctacctctctgtcttatgaattcgaacagcataccccgattccgctacgatcaatttcatacacctcctatgaaaaaacttcctacctgggttaggtctacctgg

SEQ ID NO: 481437 - DNA, 433 bp, Homo sapiens
tatggtgctccaagaattgtctttgcacctctctcaaaaatcactttggacatatctctacatctagtttgtgcattttctactctatatcattgatctgtgtattcccccagctgataatatattgtcttgataactatagctatgttataagctttgaaatcaggtatactgatgattgccccctttattttctgatgcaaaattgtttctggttatactagttcctttgactttccagataaattttagcataccacttttctgtatctagaaaaaaatcttgctgtgattttaataggaattgcatcaaatctttggaagaattgacgatctttactgtgttgagtcttccaatctatagaacatagtatgtctcaccatttgtgtacacaaatagtccgcagcaggggtaccgagcgtcgaatatcgt

SEQ ID NO: 481438 - DNA, 1034 bp, Homo sapiens
agcggggaaaaccgtgagctggatttataatcgccctataaagctccagaggcggtcaggcacctgcagaggagccccgccgctccgccgactagctgcgccacgcgagcaacggccgtcgtgattgccccgtccgagtgcaggtaccccgccgtacccactcgtgcggccgcagggctaggcgccggagtgatgctgggggcaggcggcgtctccgaaatgcacgacgctaggctccgagaaggcacggcagaatcgatacgggatgcaatgctgagtaatcaactgaatgcgatcgctgaaatggtactgacggcgcactgtcgcgcaaatgagcgtccgatgactatgaagctcgagatgctcatggcgaaagacacgagatgcttccattacctgtataggaatgttgacgtgggaaattggccatgctactccaagatcggccaaaacctttaattctcaattaaacaaatctaccccggtgaggcgaacgacacaggaaacagctaagtgacctcattaagagattatcgcgcgcggatacgcgatagcacggcgaactaaggtgatatcggatctaatcgtgaaccgaccctgagactgaactgatcgcggcaggattcggacctcactcgagtcatcacatgggactgtaaatccgcgcttgaattaggacactgaactcgttgtaacgaactcgctcgagctgagacgcgagcggtatacgcctaaaggataacgagaacaagatgcgcggctaattgatattactactcgatgcagaaacaaccaaaaaattctctcgccaaaattctacaatccaattaaactgtatccttgtgtcctctgaatgaaatgcctaaaactgagtcgcctgaatggaactacgttgtatccgcgcggcgcggataacggaaagaatcccaagttcctttgattcgaataaacctatttcacaacccagtgtataccgtaacggaggcccctattggaggagccgacctgaacttggaccccattaaaggactcct

SEQ ID NO: 481439 - DNA, 281 bp, Homo sapiens
acaattaatccccgttgcaagtttctattggaccaatatacaatatatgttcacatcatggcaagacaaaagatcctaacctttactatgatgtatttcgtccaggcttagactttgacgtccaggcttagactttgacgtccaggcttagactttgacgtccaggcttagactttgggtgtggactccatctacaagcggtacctggcttatccggtcaatacaattacttcaattaagtaaattctggatggctctttgcaaagcgccccggtcgacgc

SEQ ID NO: 481440 - DNA, 179 bp, Homo sapiens
  misc_feature (143)..(143): n is a, c, g, or t
tttttcaaatcattagctatgtaaataatgctgcatgtacaaaggggtgcgttatattttcaatttagcattttcattttgttaggataaatgtccagaagtgagtgagattcctggtcaacatggtagttctatatttttanggaacctccaaatttgttttccattacgtggctgcc

SEQ ID NO: 481441 - DNA, 871 bp, Homo sapiens
gtctatgccttgaaccgagtactcaagccctatactaaagttatgagaatgcatacgggaaaaaaacccgtataattgtgaacgaatgtgcgaaaagccttgaagcaatcctatcaactgagtagacttacaggatagttcatagtaaaagagaaactcaactaagggtgaacgaattgtgggaaggccattaataaaatgacgtactactagtcaggaacttagtacatagaagatagaattccatattggcgatgagaatatccatagagagatgtggagggaaaagtggcatgagtgtttattaaccggaggtccttcaggtacgttatgtgaaacacagaatgataggttcgtatagggtgaaagaagtcaacctttcatagaaattttttgaacgaacgtggaagaaaagagtattaaaaacgtatttcggcaaagtgtttagctaatcataaagaataagttcagtatctggagagagaacccccaaaaatgtgaagaattgtggaaaaagtttataaacgatttgttcaaaatctagttatagataagagaattcagtacgggagagaaatcatttaaccaatgtgcagaatggtggcaaagcatttaaaagttgctctcaacccttatagaacttaggatattcatacctgtaggaaaaaccttacaacttgaaggaatgttgggaaaggttttatacatatcttaaccttaatgcaataagaaattcattggggaagaactataatgtggcaatgtgggaaggttaatcatctttaacttttcgtaagaatatgtaaagaacctaaagggagatggatttaaaagtatatgaaaatagaatcttgggaaaccattgttggaa

SEQ ID NO: 481442 - DNA, 1023 bp, Homo sapiens
tactgagctggttcttcctcacctgtgcttgtggccacgtgtgcacatgctgtgcctgcttgctcatgcccgctgcccccgtgctgtgcctcctgcctgtggcttccccctccctacatgagatgatgctgtcccgtgggtggttcaccgagacctcagtggtgctgtgattgcagagaccctgctcaatgtggcctgatgtgtgtccactgtgtagcttccttgtgctctgtgcccatgtctgcaatgaaccagtggtgacttctcgctctcctgtcagggtggggtgatcagtgtgacccatattccggatccatgaactcacgtggtgatttctatgacctgtatggaggggagaagtttgcgactctgacagagctggtggagtactacactcagcagcagtggtgtcctgcatgaccgctgactggaaccatcatccacctacaagtacccgctgaactgctccgatcccactagtgagaggtggtaccatggccacatgtctggcgggcaggcagagacgctgctgccggccaatggcgagccctggacgtttcttgtgcgtgagagcctcagagcagcctgtatcacttctgtgcttactagtgctcattgaccaagccaatgctggcccagtgctaccccgatcaaggtcagccagatcaaggtcatgtcgagggtggacgctacacagtgggtggtatggacaacgtcggacagccctcccgtaccattgattaagcaattccagaaaaccggtgcattgctgttgtcctcaggcgccattggacaaccgtgaacaaacggacgtaatgccacaggccttacatgccgggtgacatttgaggaccccgcgtatgttggcaccgtgtaccacaaacgagtgcggtcccgggaactcaggcactgtctgtgcactgccagcggctctgaatcttcagcacagccggggtgacggccctagccctccgtcgaggtgcagggctcctgaaccgtcgctaccctacagagcctcccgta

SEQ ID NO: 481443 - DNA, 1064 bp, Homo sapiens
tcctttgaaagggttaaaaaccctctttggccgagggagttgtggggagtattggtggggaacaagggtccccttgggggctgagtatggcgcctagaagggcgcctaagtctgtgtgggcgcaaatcgcagtttcctggtgggcgtctggggagaactctctcactgtgcgcgggggcccgggggacgcagcccgaccaaataacaccggcgtttctaaaaaaaaaaaaaaaaaaaaaaaaaaaaaaaaaaaaaaaaacaaaaaaaaaaaaaaaaaaaaaaagggggggggccacatacaaaaaacccccgggggggccaaaagataacaggaaacgacacaagtagcacaaaacgggccgcaccaagcgggggcccgcctctcacgcacaaaacaccctaccacctatgaaacataccactcactcaaatatagagaaaacaagttaccccattaaacacaaaactttttggtgacaacaaaatctattcatctcgaggttgataataaaacatatagccaaacaaacaccccctcaccagcctcccttataacaagcaaccctagaggccagaaaaaactaaaaacattttcccaccacccatatacaatggaataacaacacacacccctcctattatacagtcgactgtttcacacacactatccattgctctaaatcttgctatacaccactcaactcgccgccaaaatttctttaattacaaaaaaacacttatcacattatcaaacttactacaccccactcaccacatccaatccactcatcccccatagtccccaaacactacataacaccataaaacaatacacaaatcctatcacatctcctcaatcacaatcaagcaatacatcactataacagaacaaaaaaacactaacgagactaagctcaaagatcaccatactaatacaaaccaatcacacttctacacattaattatctaaacagtgtatgatctcaactcacaatattcacaataccactaacaaacctcaatctaaaacaccccattataaattgtctatatataatacaaca

SEQ ID NO: 481444 - DNA, 926 bp, Homo sapiens
tggagggtcggaaacctttttattgggggggaggggccgcggcccccaaatttcggcacccaaaaaaaaaacccaaaagggcgttgaacacggggccgtcggtggtcggattggaccagggccggtggtggcgggaccgggggaccaggacgccatcgcctacaaatctcggcccttcggggcaagggcatagaggcccggggcaacaggcatagcaagagaagcgcagtcgagaaggcagtagagggcgagactcacaggtccgaacccagcatctcgagcgcatccctcgtggatgccacagcgcacattttggacacccaaaatgtgccgcgccaaagaggtgatgagtgcaaccccaggtgggtataaacgcgtattgagggcggccccccacaagagaaggggcgaggggcgaacgggtggagcaaacagcgggggcaacgtgggttctacacaataagaattattgcgcaaagcgcacgaggccggggacatcactcacacacaggggcgagcgggaatcatccgaggggaccagatgtgcataccaatgatcggcgcagcagagtcagacagccgccagcacccccgttcgtgacacagcgaccagcgagctcgaaggttgtgcccccgtgagcacagctcactaggaaggagcagaaggcgccgagggcatcccacaagtgagacaaccaggcaccccaaatgggaccaagtcgggggcagcagcacaaaggggggcagaacaccttgtcgcgacacaaagctcggcaccagagaaagaggcaggaccacgcaagagagcccgcgagaaaccagtgactaaagaggccacacctagtacgtctgccccaggaaacccggagaccaaggcagcgtacatgagccaccccaggtggaggagaaaccaccagcgccctgag

SEQ ID NO: 481445 - DNA, 255 bp, Homo sapiens
tacagagtgaaggtgttcaccacaggggctttccatttaaggaaggtttcgctgtggaaggccagggtcgggccgccgaacaccaggcaggcgacgagggtgagccattgtcttttttccagcttgcgctgcgagatgaagatggcgccgtacactacgatagagctgatgagcagtacggcagtggcactgtagatgcccccgaacgacagctcgtggccggcgatttcgatgaccctgaggtcgagtttggta

SEQ ID NO: 481446 - DNA, 1061 bp, Homo sapiens
  misc_feature (10)..(10): n is a, c, g, or t
  misc_feature (63)..(63): n is a, c, g, or t
  misc_feature (227)..(227): n is a, c, g, or t
  misc_feature (244)..(244): n is a, c, g, or t
  misc_feature (251)..(251): n is a, c, g, or t
  misc_feature (266)..(266): n is a, c, g, or t
  misc_feature (271)..(271): n is a, c, g, or t
  misc_feature (281)..(281): n is a, c, g, or t
  misc_feature (317)..(317): n is a, c, g, or t
  misc_feature (337)..(337): n is a, c, g, or t
  misc_feature (354)..(354): n is a, c, g, or t
  misc_feature (361)..(361): n is a, c, g, or t
  misc_feature (390)..(390): n is a, c, g, or t
  misc_feature (414)..(414): n is a, c, g, or t
  misc_feature (417)..(417): n is a, c, g, or t
  misc_feature (537)..(537): n is a, c, g, or t
  misc_feature (606)..(606): n is a, c, g, or t
  misc_feature (609)..(609): n is a, c, g, or t
  misc_feature (984)..(985): n is a, c, g, or t
tctccgaatntataccacagatacgcgacagtgagttcacaggcagagcaccacaggccactntgtccacatgaggggcctgccgtacaaagcgaccgagaacgacagttacaacttcttctctcctctcaaccctgtgagagtccatattgagattggcccagatggaagagtgacgggtgaagcagatgttgagtttgctactcatgaagaagctgtggcagctntgtccaaaacagggccnatatgcngcacagatatatagnactcntcttgaatcnacaacggggccagcaatggggcgtatagcagccagntgatgcaaggcatgggggtntctgctgccccagactnacagtgncctggagagccagtcagtgagtggctgtnacggggccggctacagtgggcagnacngcatgggtggctatgactagttttgttaggaacatttgagtcacttcaatcattttcacaggcagcccacaagcaattaagagcagttataatagaggaagctgggggacccattttgcnccatgagtttgtgaaaatatctggattaaaaaattacctcttcagtgttttctcatgcaaaattttctnctngcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtatnnttgctaagtgaaacttgttaaattttttgttaactcacaccttttttttcttaaaagtaaagggcttttttcacaa

SEQ ID NO: 481447 - DNA, 540 bp, Homo sapiens
  misc_feature (345)..(345): n is a, c, g, or t
agtaatagcagttatcatatcttcctcacaacacacagtggcacccagctaacaggaagacttcagcaacaacctcccttcctcctggggattgtgatgcctcggtgagaagagtgtcactctgcaaacaccaactccaaagtactcttctaggggagaagtgagaatatagggtactcacggaagatcatggttaaggagtgtgctggaaatccacaggttatcaatttccactgtttgctggtgctattgaaacttctaagagtaggcctagttctagaagtgtcaatagcagtacaacagcatacaatatcttcacctcctagcacgacatctgcccttgtngaggaacctaccagctactacagcagcccgggctctattgcaacatacacactttccggagagctccacaatctcaggccgtagtgaggaatctgcagcatcccacagcagcccagataccagtgggatcacacacttacctgcccattttactaccccaggcagcaatgtgctattgaaacttctaaaactagg

SEQ ID NO: 481448 - DNA, 619 bp, Homo sapiens
ggccttgcaccacaccctcggaaacctccgggttcgttatctttgccttgcgcagagctgcctctggttgaccctggttgctccagagtgtcccgctctccctccacggtgggaccctgggcagggtttgcccaccacactggggcacactgcactacagggtcttgtctgtgccccagcaccccggtgggcttgcagggtgctgtgttgccttgctccctatactgactccaaaccttgagaccacgtatttgttgtgtgagacccgagaggccctggcaaaccagggctagcgcctgccccctgtggttacctaggcgcctccagggttggtgcgctctgctgtggaatccctgggctcaaccaggcgaagcccctgctcttcactgtagttctttgtcctttcattttccagttgtccctgtctctgggtggggtggactggaccggactgaccccatggggtgcagcaagggcacctgggtgagccctcctgggggtcctcccaccacaaacgtgggatccgtgcacgttaacgattacaggacatcggaaaccctttgctctttttttttttttttttttttcttttttttttcttctcttttttttttttttt

SEQ ID NO: 481449 - DNA, 1191 bp, Homo sapiens
  misc_feature (5)..(5): n is a, c, g, or t
  misc_feature (147)..(147): n is a, c, g, or t
  misc_feature (193)..(193): n is a, c, g, or t
  misc_feature (293)..(293): n is a, c, g, or t
  misc_feature (397)..(397): n is a, c, g, or t
  misc_feature (409)..(409): n is a, c, g, or t
  misc_feature (514)..(514): n is a, c, g, or t
  misc_feature (558)..(558): n is a, c, g, or t
  misc_feature (581)..(581): n is a, c, g, or t
  misc_feature (596)..(596): n is a, c, g, or t
  misc_feature (677)..(677): n is a, c, g, or t
  misc_feature (1136)..(1136): n is a, c, g, or t
  misc_feature (1186)..(1186): n is a, c, g, or t
  misc_feature (1191)..(1191): n is a, c, g, or t
cccgnagtggggcgctctatagtggccggcaccccccgggaaactccgccctctatcaggggcccggaggcacgggaagtgcggttatatgcagcggggcgctcctgtatgacgacgagagcccacatcggctggctgttcgtcttntggcacgcgtgttagctgaatgtcaggaggagcgtatcagaggacncttatacattcctgcgcaccgcgcggggtcgatcacgatgtgtcacgctgagataagatttatgtgggtagtgggtcgtgtggtgcggacgcgtgcccgncggggtgtatctgcgcgcttagagcgtatacggagagaagaggcggaggagatggagggggaatgatgggtggtccggtgtcgttttgtttgctgatgataagnataataatatgntgaggggtagaaagagcacaaagagcgcggtcggtgtcggcgcggggcggcgcgtgggtggacaggtgcgccgcctcgcgcggacacgcatcccaagcgcaatgncagactcagcagcagggaagaaagagaggccattcgtgtccganactcggacaggcgctacggagantagaatgactagganagagggcgcaccaccggcactcccctccaatccaactacacatgtcccggcagccgtagggctgcttccgcttcgcccgcncgtgccgcgcgcgttcgattcgtcgaatgatagcagagcaggggacgtcgcgcgcccgctccctgagcctctcgcgccgctcgtatgcggagattaacgtcagcgatctccgcgaggcggacgcgagcggcgggcgagcgcggtgcgcgtagctgatgcaaccctaccgccgcacagcgcgccggctactcgcgcgcggtcgtgatgagggatgtcgtggtctgagcgccgggcgcgcgtgcggatttcgccgctgttggcgttggtggagtcgcgtgcggtcgtgtgagtgtagggtgatatgcggcggtcgtttattcgctagttgtgttgctgtctgcgaccgcggagtccgacgtcggagtagtgaatggtgggtgagcaggtagaggtgcagccatagcgtatgcgatggacgacgtgcgacgccccggtcgtatgttctgcgggccgtgtatncggatagtctgaactacatgtgcgccgccaacccgtcgatgtgtcacggncgagn

SEQ ID NO: 481450 - DNA, 1104 bp, Homo sapiens
ggaaatgaattgaaaggttgaacacagaatagggaatgaaaggccatttattactcaatgaatcaattagtaagaggaatggaacgcaatgccattttctgtttctaggcactcccacctatgtcacagcgtcatcgttcatataagtcggtcgtcgtatgatgtgcagtgatacagtacgatctgaactgtacttcaggatgcaggtctctatgatctactcatttggaccaatgcctatatcagcaaatggaagcaatcttgatgatgctgtgacggcatgggagcaggattggagctataattgaaaagcctacagtctcagctaacgctaggggaaggggaaatcacctcatttacagctagaaattggcaatctagaccaaaactcgattcaataatggcgtgaagaactaggtgcaattaactatatcgacctgtatgaacttgaagacgaaggtgaaggcgatacccgaaacttatcaactctagctaagcagattcggatcacaaggtgcaactactattctgccgcatgtcatggcgaaaagaagcaaaaccaggaagcatgacagaaggcagaaaagcaagaagcaggcaaccaagcaccgtagacgcacagccgcaggccagacgggcgcaagacggcacgacgggcttgacgcatagacccgaggacgcatgagagcacaaagaggaaccactaggaagtaggaggaacaaacgaaagcaggagcccagacaagaagccgggaacaccggacaagacgaagacacgagaccgagacaacgggagtcccaccacggcaccacacgggtccgcaacccggcaggaaaagaacgcccggacaaagcccggggcaggaacaaccacaaagcaaaggggggcacacccaaaaaacaacctgagataagaaacgcgcacgcagactagagaacacgagaggactcgacaagagcaacggacagtaataaaacatgacgaaacacgttcgcaaacagcgggataaagacacacatccacagggagacaagagaggaagcaagaagaaaaacagcgcgccgttcactgcccctcgcggttgacacgacacaggaggaagt

SEQ ID NO: 481451 - DNA, 215 bp, Homo sapiens
ctgtggaagacggcgaggagaacacacactagggtctgtgaaaaggtcgggggtagggggagggagagcctcaggaagaagagctaatggatgctggcttcatacctgagtgacgggttgatctgtgcagcaaagcaccatggcacatgtttacttagtaacaaacctgcacgtgcacccttgcccgtcttccacagccctacccgtcttccaca

SEQ ID NO: 481452 - DNA, 356 bp, Homo sapiens
caggccccggcagcactgctacttgggagaagccacttcacctttgtattagttattaaaaaatataatttgggctgggcgcagtggctcacgcctgtaatcccagcactttgggagtccaaggcatgcggatcacttgaggtcaggagttcgagaccaccctggccaatatggtgaaaccccatctctactaaaaatacaacaaagttagccgggcgtggtggcaggcgtctgtaatcccagctgcttgggaggctgaggcaggagaatcacttgaaccctggaggtggcggttgcagtgagcacagatcatgccactgcactccagcctgggcaacaaaacgagacttcgtctc

SEQ ID NO: 481453 - DNA, 1156 bp, Homo sapiens
  misc_feature (249)..(249): n is a, c, g, or t
gcaggtgttagcaggagcttcgaagggttagtgagcggctgtattttggggcatctgtggtacccggactgtgcaatcatgtgtgtcgcagtgaatgggtgtgcagtggacctaggaacgttactacgaggatacaagtgtcgtctacaagatatgttaaacgaggaagctctgggtgggcgctcgttcgcatcaaccagtaccatgacccagaggggttgtggcaggacttcccgatagctggtgttngggtaggggtccgtctagagtgctggaaagcatggtatcgtctagagggccgtgccgcaggtcgtcgtgacacgtacgacatcactctacgaacgattgaggtgaggcgggcacacgtcgaatgcgacgtatagtacggcgcgtatcattgcgtggttcgcagtggagcgacatacgatattccctaaatgactgcggcttatggttggtgtagaagagccacatgtggccttgaaggaaactgctggaaagattcagtggaaaaccattttgggcagccatgctttcaaagacaatggcagagcataggggtcagaggaggggtttgggcgtaggcgacgcaatttgcgcaatcatccccagatgcaatgtctgtagctgccagggacgagtgctttaagggaacagttatggcttcgtaatatacaatgtgagaatacgaagggacagatagaacaatactattggggcgtggttaacgggataggcgatgagtcatcgtctcttatataatccgtggtccttgtgtaagattggggttctatggacttgaatacggttcaaaggcggatttcatgtggtatggcgccataaaagtttgggatccaattaactcctggggtgagctttggcagcgaagggtatccacggggcacgcaaagatggacccgtgttggaacttagacttggggtgcgtcaataagatgccaaacaataacttgggttgcacttggtgtcattcgggcaaaagtggtcgaaataggggccatactcattcttctaaaattggccaaggggggcaagtaggtggtttgtggcaccccagtaggctttgcacttaggagggttatgagtacttttggccggggtttaggtacccggttggagtccccttgggaagactgaa

SEQ ID NO: 481454 - DNA, 114 bp, Homo sapiens
cagcctcgaaatacagaaggacaccggcgagttcgtggacctgtacatgcagcggaaatactccatagcaatctcatcatcggtaccaaggaccactcatccatccagatgaac

SEQ ID NO: 481455 - DNA, 397 bp, Homo sapiens
  misc_feature (294)..(294): n is a, c, g, or t
  misc_feature (364)..(364): n is a, c, g, or t
  misc_feature (392)..(392): n is a, c, g, or t
  misc_feature (397)..(397): n is a, c, g, or t
gagtgcagtggcgtgatctcggctcgctgcaacctctgcctcctgagtcggagcaattctcctgcttcagcctcctgaaggaggaactacaggaatggggaaccatgcccagctaatttttgtgtttttagtagagacggggtttcaccatgttggccagggtggtttccaactcctgacctcaagggatcctccagcctcagcttcccacagtgctgggattacaggtgtaagccaccatgcctggccataaacttgtatttttttaataacacagagtctccctttgttggntggagggctggatctcaacctcctgtggctcaaggggatcctctaggcctcagctttcccaggttagctngggaccacagacaggtaaccaagtggcngggtn

SEQ ID NO: 481456 - DNA, 152 bp, Homo sapiens
gggcaacattggtgagaccccatttctataaattttaaaaattaaccagggcatgttggtacacacctgtaagtcccagccacacagaaggctgaggtgggaggagtgctttagcccaggatgtcgaggctgcagtgagctgtgattgcacc

SEQ ID NO: 481457 - DNA, 132 bp, Homo sapiens
  misc_feature (51)..(51): n is a, c, g, or t
  misc_feature (85)..(85): n is a, c, g, or t
ggaataaaaacatattaacaaaatgtattcaatcatttacaatacaaacanggaatctgcagtctgttgttgtagcctgacaaangaaatctatccattaagaatctgtgcacaatgtaattgcaaatatgt

SEQ ID NO: 481458 - DNA, 164 bp, Homo sapiens
cacaagaatcagcggtaggtaagcaggcacccagcaggagctgatatcacagttcttacatggacaactctttcaggcattatccatcagagtactttattttacaaccgtgcttttctatctaaaactcaaaggtgcacttattatacatacaaagttttata

SEQ ID NO: 481459 - DNA, 506 bp, Homo sapiens
cgagcacggtgctgagacgcgagcaagggctgctagcagcgtgtcaccctctcactatgattaatacgttccgacgctctcatggaaaaagtagataccatgcaaaaacagatggacaatttaaacagaaagatacccattatcagaaagaataaacaagaaatgatcgagactaagacaaacaacccactaagaaatgaagaaagctttggctggactcatgagtacactgcaaatgggctggagacacaaacgcccctcttgagcgtggaggactatgtcaaccacgaaacctttgacaaacctgacaagttgacgacgaccaaccgacttgaaccagattgagaaagactatctaattacaaaaagtatactataggcatcatgagaatacctgaagaagacagagagaaaggaacaacagaaacatttgaagcaataatgcctgagaatctcaccaaattagtgccagacaccaaaccacagatcaggaagctcagaaataa

SEQ ID NO: 481460 - DNA, 532 bp, Homo sapiens
tattgagtggacttgatagtcctggcagatgttcgaggtgtacgagaggagtcgatgggtgccttgcgtcgggaccgtgggatgtggagtggatgctgggtgtgacagaggccgcgatgagaggaatggctgtactgccaatgggctctgcatgacgacgatctcatggttctaccctgagagcgtgaccttggcgttgccgattgatgaagcaagctctgttcctgtaggtgtgtgacctgcgatggcgcttggcgagcttagcgatcggacccgcgaagcatggggccttgtgccggttgcggcgggacgtcaatgtgttgctactgttcgaatcggtgagcgaggtcagactgagtggcatttctaggggagaggttgtctgtgactttgtatgtcgtggttctatgcgccgctatcacccgacggcagtcgtaagaggttccttggatggatatggtgggcatgcaggcttgtacgccctctaatggcgaagcccggtttcgtggtccctccgcgaggcgccacaccg

SEQ ID NO: 481461 - DNA, 682 bp, Homo sapiens
  misc_feature (465)..(465): n is a, c, g, or t
  misc_feature (560)..(561): n is a, c, g, or t
  misc_feature (594)..(594): n is a, c, g, or t
  misc_feature (599)..(599): n is a, c, g, or t
  misc_feature (617)..(617): n is a, c, g, or t
  misc_feature (619)..(620): n is a, c, g, or t
  misc_feature (624)..(624): n is a, c, g, or t
  misc_feature (631)..(631): n is a, c, g, or t
  misc_feature (634)..(634): n is a, c, g, or t
  misc_feature (648)..(648): n is a, c, g, or t
  misc_feature (661)..(664): n is a, c, g, or t
  misc_feature (667)..(668): n is a, c, g, or t
agataatggaatattatttggtgttaaaaagaaagaaactaccacgccatgaaaagacatagaagaaattcagatgcacattactaagtaaaaaaaaagccaatctgaaaaggcgacatattgtatgattccatactatatattaccaatataacattttggtaaagacaaattatacagacagtaaaaagtaaaaggcaaaattatagagacagtaaaaaatctggaaaggctatatactgtatgattccatactgtatgttaccaatataacatttggtaaaggcaaaattatagagacagtaaaaagaatagttgttgccaaggggtttggggaaggagggatgaataggtggagaacagaggatttctaggacagtgaaaatactctgtatgatactataataatggatacatgtcattcatatccacatttgtccaaactcatagaatgtccaacaccanaaacaaaattaaaaaaaaccctaacatatagactctgagtgacgatatggatcaatgtagtttcatcaggtgtaataaatgtaccactttggtgnnggacttggatatgagggagctatcatgtgtgtnggcangaggtagatgagatactntnnaccnttctctnaantttgctgtgaagcntaaactgctcttnnnnatnntataatttacattg

SEQ ID NO: 481462 - DNA, 620 bp, Homo sapiens
  misc_feature (465)..(465): n is a, c, g, or t
  misc_feature (498)..(499): n is a, c, g, or t
  misc_feature (532)..(532): n is a, c, g, or t
  misc_feature (537)..(537): n is a, c, g, or t
  misc_feature (555)..(555): n is a, c, g, or t
  misc_feature (557)..(558): n is a, c, g, or t
  misc_feature (562)..(562): n is a, c, g, or t
  misc_feature (569)..(569): n is a, c, g, or t
  misc_feature (572)..(572): n is a, c, g, or t
  misc_feature (586)..(586): n is a, c, g, or t
  misc_feature (599)..(602): n is a, c, g, or t
  misc_feature (605)..(606): n is a, c, g, or t
agataatggaatattatttggtgttaaaaagaaagaaactaccacgccatgaaaagacatagaagaaattcagatgcacattactaagtaaaaaaaaagccaatctgaaaaggcgacatattgtatgattccatactatatattaccaatataacattttggtaaagacaaattatacagacagtaaaaagtaaaaggcaaaattatagagacagtaaaaaatctggaaaggctatatactgtatgattccatactgtatgttaccaatataacatttggtaaaggcaaaattatagagacagtaaaaagaatagttgttgccaaggggtttggggaaggagggatgaataggtggagaacagaggatttctaggacagtgaaaatactctgtatgatactataataatggatacatgtcattcatatccacatttgtccaaactcatagaatgtccaacaccanaaacaaaattaaataaatgtaccactttggtgnnggacttggatatgagggagctatcatgtgtgtnggcangaggtagatgagatactntnnaccnttctctnaantttgctgtgaagcntaaactgctcttnnnnatnntataatttacattg

SEQ ID NO: 481463 - DNA, 314 bp, Homo sapiens
agacagcctgggcacataacaagacttgtctgtatacgaaatttaagaattagcctggcatgttggagcccacctgtggtcccagctacttgggagactgaggtgggaggattcttgagcctgggaggtcgaggctgtagtgagctgcatttgcaccactgcactccggcctgggtgacagaacaaaccctgtctcaaaaaaaaaaaaaggaaagaaagaaaagaaaattttggaatggacttttaataagcgggattggtcagtcgggggatgcgagggtgagtgcgtcggaagttggagttggctaggcaga

SEQ ID NO: 481464 - DNA, 400 bp, Homo sapiens
  misc_feature (31)..(31): n is a, c, g, or t
  misc_feature (85)..(85): n is a, c, g, or t
  misc_feature (111)..(111): n is a, c, g, or t
  misc_feature (117)..(117): n is a, c, g, or t
  misc_feature (220)..(220): n is a, c, g, or t
  misc_feature (271)..(271): n is a, c, g, or t
  misc_feature (321)..(321): n is a, c, g, or t
  misc_feature (334)..(334): n is a, c, g, or t
  misc_feature (367)..(367): n is a, c, g, or t
  misc_feature (388)..(388): n is a, c, g, or t
  misc_feature (393)..(393): n is a, c, g, or t
agaagtgatgttctttaaagaccagattctncatgcgcacgaaatccgttcttacccggaagttgaacctccaatttcatttctngttttcctggccacaacttgccaaantgggcnttgaagcttgcttacgaatttgccgacagagatgaagtccggtttttcaaaagggaataaagtacttgggctgttcagggacaagaatgtgctacacggatanccccaaggacatcttacagctccttttggcttcccctaagaactggtgaangcatatcggatgctgctctttctgaggaaaaacacttggaaaaaacctancttccttggttgntaacaaatacttggagggtatgatgaatataancggttctaatgggttccaggnttatncccaaaa

SEQ ID NO: 481465 - DNA, 300 bp, Homo sapiens
  misc_feature (32)..(32): n is a, c, g, or t
  misc_feature (66)..(66): n is a, c, g, or t
  misc_feature (99)..(99): n is a, c, g, or t
  misc_feature (108)..(108): n is a, c, g, or t
  misc_feature (146)..(146): n is a, c, g, or t
  misc_feature (158)..(158): n is a, c, g, or t
  misc_feature (285)..(285): n is a, c, g, or t
cttcctgctgctgcgggaccttctgcggcgangagaagaagaaggggcccaaagtcaccgcaaggngtattttgacctacgaattggagatgaagatgnaggccgggngatctttggctcttcggaaagactgttccaaaaacagnggataattttgnggccttagctacaggagagaaaggatttggtacaaaaacagcaaattccatcgggaatcaaggacttcatgatccaggcggagacttcaccaggggagatgcacaaggaggaaagagcatctacggngagcgcttccccgat

SEQ ID NO: 481466 - DNA, 217 bp, Homo sapiens
agctgctaccgttttacggaagcagatagtgaggaaagttgagcatcatgacgtgcagtccgtggacagcctgtggctacaaaaaatgttgagcctgtagatgccgtcggaaatggtgaagggagactcgaaggtactcttgaggcttgtagagagggtaacatatgagacccagataaaattgtaataagcagtgcttgaattatttggttacggt

SEQ ID NO: 481467 - DNA, 685 bp, Homo sapiens
  misc_feature (46)..(46): n is a, c, g, or t
gaagggtgggggacatgctaggagagggtaggggtgagaggtcggnataggccaggagagagagagatcagtgagtgggagatagagctagagtggggatatgggattgggtagatagggggctatctaatcttgtgagaagcgacagagaggagaggtctggaacagtaaagagcttgtccttgcattacagccatccactatgatgggatgtatacccttttgtgagagcttgaaaatagcaatttatttctcattcataagcctgagtgcaaaatacccttaagtggatgtctcaattagcagagactccaaggtcatataacacccagagcaccgcttcatatctgtgttctttactgtattgtagactcagttcgtccttattagaggtagagttttagccaagaaggaaatctcaccatggaactacagaagtgtaccagagaaagtctctctaggaatagactaatctaacctcaggcactttaggaaaactgaagcccagagaactcaagttcctcgcctgaggtcacacagctcagtatcatcaggaacagaccagtcctcagggttgccttcctccacttcagtgttgttgccatgatagcacaacaaagtagtgcagatactctttcagaagtgtgcgtttggaaaattgctagcctgagtacatttctctcta

SEQ ID NO: 481468 - DNA, 1420 bp, Homo sapiens
acgccctacctcacattcctattgacatctgctgcagatcacacccttgtgatggacaaactgctcaggtacagtcccacccaccacagcctccttgtcctgggcacgcaggttttatgcctcccatgatttggagtattgtggccctgtacatagacgagctgccgacgactgatggtgacatattccttcagccatgtgacgaacaggatgtgtgtgacggatctcatgcacttgacactcgtgcgcaccgcataccccaagaagtcaagtgtccactcctatcagcacaggccacaacacaaaaccctgtgtctctgtattatctagtccacagccagacatccgaccacaggatcgatgagttgcaatacaggaacctcacgacaggcatcacatcacccgagcgtcaaccattgccatccactcacaaatactgcccttatcaatgctacacaagattaccattaaaatcatacccaggaccccacatcgaacaccttcgctgcttgtgcatggcacacatgcataggaaccaacgaatgccatagagaccgtgcacaatgcaattagaattaggaatcagctctatatcctaattgcaacgtcaacacctaactggtatcaaacggacttggatacgcagagacaccactcgctcctgtagccatccttgtgtgacatgtcaacacacttccggtccatgttacgacactcacacagacaactctccatgcccagttgctcgccgagccacccatattccatgaccacctgagaccatccgcccagttgcgattactcatacatctacctaccctagcataaataccaaccactaataagacacaatatacaatatatctactacatcttcaataatttctaaacacacccagcactatacttgatcacccaaagaacatactacacaatcaaatcaacattcaataacacaccaacaataatcccaacacataacaccacaacataataccatccctcaatattctataccaccacattgtcacacttccaaatcttcatcgccatctattaaccaacctcaactaaacacctaaccgagtccaccccaaaaaatcaccatatacatcttctcaaacacaaatgcatgtacatcactcacatcactccacttttaacattcactacaactctctaactctctccccccctaacaaacacgaattacaatagtacatcacttcccatctctataccaactatcacacaaacatatactaatctcacctgccatctaacacattaacaataactacctactaacacacacacttcaacccttatcttacaactcacacccatacacacttctatttacacaataaattacaccccaataactaacttacaccttaataatattccacaacatctg

SEQ ID NO: 481469 - DNA, 572 bp, Homo sapiens
ccctgtgggaatgtcacaggttggagtcatagggtgtgtagcctttccagattggcctttcactttgtgatctgcatttcaggtttctctatgtcttttcatggatggaaagctcactcatttttagcactgaatagtatttcatggtctgcatggacgtgccacagttcatttctccaatcatctgccaaaggacatctcggctgcttccaagtcgtggtgattgtaaatgacgctgctatcatcatccaatgcattttaagtcttccctccactttagccattctgcgaattccacttcacgctgacatcacaaagacaggacccttttatgtgcatttttcccagcatccgtgggtgacaagtttgagaggcacaggcagcagcggccgctgcttctgttggatccaggagggaagggaggttctgagctttggagcgggaagtgaggagcctcagctgtccgcacccttttgcctgttgtgggcagcgtggtcatcacaccaaccttcacatccaacaaatgcttgcagaactgacaggcacatggcacgagcacgccgcctcgtgcc

SEQ ID NO: 481470 - DNA, 221 bp, Homo sapiens
aacctactacacatccacaaaaaagaatgaattatcagcatttgcagtgacctggatagactggagactattactttattttattattatactttaagttctggggtacatgtgcaggacgtgcagtttttgttacataggtatacatgtgccatggtggtttgctgcacccctcaacccgtcatctacattagatacttgtcctaatactatcactcccc

SEQ ID NO: 481471 - DNA, 1968 bp, Homo sapiens
tctctggagccccgtgcttgttcctgtattgtggcacggatttgcgtgctctgacaataatcctgcataaactcctgtagatgtctggtgtagcggctctagctagtgagctgcaatactgggcatgagttggatagctgccggtcatagcgaactgggtccattgcagctagatcttacacgaaggactagtatactggggaccccacatcttgtgaggcacggcctcatctgcgtctcgaaaattttgcggccaactccggaggtccctaccaagggtactatatcacaatcgtttcttatgacttctccatcgggtctagcgcaccgtgcaccaattgttgttcatatccattcttagctcagtttcacccttacagtattatttagtcagccagagcagaattacgtgctgtagttgcatgacagtattgctagtgacaagctagaatagaagctggtatacccactgtcttggcttatcgtagcatatctgacctgtagccttacaactctactgtgtaatccagtatttctcacccctgacaaaattcaaaagggatgagcaatgttctgttcccaggcatttcctcccaaagaatgaggtgagtcggcacgtgttgatgacgtggggcaacgcggaggactttggcactctggcaatttacggcccctatcacgctggcgaatggaccaatggtggcgttcctcaacgaattgaatgtttgtgggggccacggtaggtgctttaatccacggggtttgaacacgcgttgagccaatttaagtgggccttgtaccgaagaagagcgcggagcaaccactgtgacaacactctcgtgtgtacactgggtgcgacacacccaaagcaagctgtcgtctagcacacctcagcgtctatgatgtgtagtcgcttgacatgtcgtatcctgcttctgctacatatactactgtcagatcagaggacacgagcagacgcgagacggcgccaagcagacgacacgaggacacaggcgcgggaggcgggagtgcaacgagagaggagagcagagggagaagggaggcagagcggaagagagcagggaggcggcgggcgacgaggggcgagagacgcgcagagcggaggcgagcgagagccgcgaggcgagcagtgggagagcgagggggcagagcgaggcacgacgagagcaagccagagaggagagacggacgagagggagagcgcgacagagcagcggagaggcgcaacgacagagaagcgaagagagagaaggagagaggagacgcggagcaacgacggacagagagcgacagggagaaaaaagaaggagcgggaggccagcaggacaagcagaagagagcacagcggccagaagacaagaagagagaagacgagaaagacgaggaagagcgagaggcaaagaagcagggagaacgcatcactagccaaacagagcgaagaagagaaaagaacaaggagaagaggaagacgggaggagagagcagaagggaagacggacaaggagagcgaggacagaacaacaaaaggcacggagcgcggaggaagaagaagagcgaccaggcaaacacgcgcgcggaaacaagaggcgcggacgaggccagagaggaagaacacgaacacaacagacgaggcgagagcacggcacaaacgaacgacagagagggaagtcgcacgcaagagagaacaacagcacagacaacggagagagcagacgacagcgaacgcgaaaccggcagcgagcacgaagccaaggagggaggacggcagagagagaacacagacagacacaagagcgagagacaaacaagagacgcaacggcggagagaagcgaagaacgaagagagaccagagggcagcgaagaggaaccagctgacagagcagccaaccgagcgagcgagcgaaggaacacgagaagaccgaacaagagaacacgaaacagagacc

SEQ ID NO: 481472 - DNA, 1062 bp, Homo sapiens
tgtgagcttcagagggctgtgctgtaggcgccacccactttcctctcaagtacaggcagcaagagagacagggactctcacctcccagtggccctcagaaaatcagaggtcccgggcaggatgttggcatgtggtccactggctcctttaagaaaagccaggtatcctcagagacccgcacataaggtcagtactctctcagcagaccaatccatttctccccactaagtagcatctgatggcgttagatgctaagactctgtcttcagaagtaataaaaaataaaaataaaaataaaaaaggcagtcccttagtgggagggtgtttggcatttcatctgaattccacaatgaataatttatatgaaaattttatcggagcccagctttccacaataaacgttccctgagaacacacgcaaatgcttctgcagccatctctctctctgctggattgggctgacggcccaaatcagatctgagttgctgcatcacttatttacaaaaaatatcataatcttacttttatgtgcatttttcccagcatccgtgggtgacaagtttgagaggcacaggcagcagcggccgctgcttctgttggatccaggagggaagggaggttctgagctttggagcgggaagtgaggagcctcagctgtccgcacccttttgcctgcaacacaacaattaggagagggactaggaggaaaggagccacctggtttctggggcatagaagccctatgcagccacgtgtcccgagcagagttaggtggggagggggccagaaggagacctcagttattcagcgtcaggagggggggtccagagtgtggcttggggacagggagacccagcttgaaccctcctcctagctaggttatgtggcttctctgagtccttgaccttatttggataatggaaaaaagagaacccacctttcaggactgtcctgggaatgtactgacctgttgtgggcagcgtggtcatcacaccaaccttcacatccaacaaatgcttgcagaactgacaggcacatggcacgagcacgccgcctcgtgcc

SEQ ID NO: 481473 - DNA, 825 bp, Homo sapiens
gctgctgcaaatttctgtttcagaagggaaaatagtgcatatcatctataactagtgaaaatgtctactatgatgagtgtatattagtgaaggtaatgccaagtgttctaataaaagaaacccaataatataccatggcccagcacagtaatgctttgtatgttgctggaataaagtccagttgggtattcctgatcagtcggtggctctccttcaagctgtggttcaggacaagcccatttcctgggcaacagggccccttcctgggtcatctccatccagtcattttatgtgcatttttcccagcatccgtgggtgacaagtttgagaggcacaggcagcagcggccgctgcttctgttggatccaggagggaagggaggttctgagctttggagcgggaagtgaggagcctcagctgtccgcacccttttgcctgcaacacaacaattaggagagggactaggaggaaaggagccacctggtttctggggcatagaagccctatgcagccacgtgtcccgagcagagttaggtggggagggggccagaaggagacctcagttattcagcgtcaggagggggggtccagagtgtggcttggggacagggagacccagcttgaaccctcctcctagctaggttatgtggcttctctgagtccttgaccttatttggataatggaaaaaagagaacccacctttcaggactgtcctgggaatgtactgacctgttgtgggcagcgtggtcatcacaccaaccttcacatccaacaaatgcttgcagaactgacaggcacatggcacgagcacgccgcctcgtgcc

SEQ ID NO: 481474 - DNA, 1204 bp, Homo sapiens
ggagagagagagagagagagagagagagagagagaggatggctgccctggaccagcaagttactatgtgactatcattgatgccccaggacacagagactttatcaaaaacatgatctacaggggactatctcaggcgtgatcgtgtgcgtgtccgtgattgttgcgtgctggtgttgggtgaatgtgaagcgtggtatctccaatgaagtgggcagacccgagagctagtgccctttcgtggcttacacacgtggtgtgtgaaacaacataaattgtcgggtgttaacaaatagtggattccacgtgagccacccatacagcacagaagagatatgagggaagagttgtgaagggaacgtcagcacttactattaagaaatattggatacaaccgcagacagagatagctatgtgtgccaatctcgtgggtgggaagtggatgacaactatgctggagccaatgtgctaatatgccttggttccaagggatggaagagtcacccgtacaggactggcaatgccatgtggaaacacgctgctatgaggctctggacgtgtatcctagcaacaactcgtccaagtgacaagccctcggcgcctgtctctccaggatgtctacaaaagtgggggtataggatactgaaacctgttgggcgagatggaagagtgggtgtactcaaaccggatatgggtggtcaccctgtgactccgagtcaaagtaaacaggggggatgataaatcgtgtcgaaaagtgcacctatgagggctgtgagtaaaaggatcatacgtgggggaaaagagggggagtaaagtgtcaaagatttgttttgacagggagatgtcgtgaggaacgatgttgggaaagaaaagtagaaccccagggtatacagcatggctcacagtgcacggaatgatcattccgaaagacccagagaaaataaggcgagattactccggttgcttggtgatgcccccgaccacacaagagtagcagaagagggcgaacgagggaaacgagacggagtgtggaaaaagggggagagagccatatactgagtctgaggaatgcaaagaatgggatggacccgcgatagaagaacacacggaggaagatgagactaaaacgggcggtatggaggagtttgcaggcttccgagattactcctcgtgtcatgccacttacttgtgggaggatcgtgaga

SEQ ID NO: 481475 - DNA, 455 bp, Homo sapiens
  misc_feature (10)..(10): n is a, c, g, or t
  misc_feature (55)..(55): n is a, c, g, or t
  misc_feature (70)..(70): n is a, c, g, or t
  misc_feature (207)..(207): n is a, c, g, or t
  misc_feature (413)..(413): n is a, c, g, or t
tagggcatgnccaccccaggttgttaaacatgtataaagtacctccctttttaantgcctgaaattgtanccccattgtatggacatactgcattttgtttatccctgtcacccagttgatggatatttggattgttacccagcttttattaatagttattatgggctgggtgaggtggctcatgcctgtaatcccagcactttggnaggccacagtgggtggatcacttgaggtcgggagttcgaaattagcctgaccaactgaaaatacaaagtggtgaaacctcgtctctactaaaaatacaaaaatttgtgggcgtggtgcgcacgcctgtaatcccagctactcaggaggctgatgcaggagaatcgcttgaacctgggagacagaggttgcagtgaaccaagattgngccactgcactccagcctggatgacaaagtgagacttccttt

SEQ ID NO: 481476 - DNA, 935 bp, Homo sapiens
acccaggtagactaacttaatgagcatctccaccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttccctttctttttcctttttttttttttttttttggtggggcttgggggtaaggatgctctgatctggactattggacatgaacacaaagttgctagatgctctggtggatttccagcagatggggagggggggaaacacagcagttctgggtaaagtccttggtaataatagttggattttttaattcgagagaatcttcatttcctatgtatgctttttccctttttgggcccagtttccttatacacttggctggtaagatgggcttatttggcattcattgcagactatggtggcaagtctggtttcatctagtaaaactggaaaatttttgggttaaaaaaaaaaaaaaaacaaaaaaaacaaaaaaaaaagggggggggggaaaaaaaataccccggggggggcccttttaggctcacccttttttggaccaggggggcccaaaagggagggcgaataaaaaacacacagccggcgcggggtaacacacgtcccgcgggaacacgtgcgcgcgggcgcctgggagagagcccacttggcgggggacctttgcggcccaccccacgaggattaaggcggggaaattaaacttcgggtaggggacccccgcgatttctcgggaaaattggcccggtgttagaattagcgttgacaaagcgcacacacaacacatcacaaatatggaaaagcacctcccacatcgagaagcaatatcaaccccagccacaatagcgcacc

SEQ ID NO: 481477 - DNA, 168 bp, Homo sapiens
caggtagaccagactgcagactaatgctgtcaaacacctctgtttctaacgaatgcaccgtctctctccgatgaccattttgacagggctccctcaaaaggtgccctcgccgcttccctgtatgtgatattactaaactgttatctcttgttctccacaccgtgacca

SEQ ID NO: 481478 - DNA, 944 bp, Homo sapiens
acccaggtagactaacttaatgagcatctccaccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttccctttctttttcctttttttttttttttttttttgggtgggtttggcgttaaaatgttgcggatttgaattttgaagataaacaaaaagtggtaaaatagcctgcgttgtggactacccagaaagattgggacatggggggaaacacagcagttctgggtaaagtccttggtaataatagttggattttttaattcgagagaatcttcatttcctatgtatgctttttccctttttgggcccagtttccttatacacttggctggtaagatgggcttatttggcattcattgcagactatggtggcaagtctggtttcatctagtaaaactggaaaatttttgggttaaaaaaaaaaaaaaaacaaaaaaaacaaaaaaaaaagggggggggggaaaaaaaataccccggggggggcccttttaggctcacccttttttggaccaggggggcccaaaagggagggcgaataaaaaacacacagccggcgcggggtaacacacgtcccgcgggaacacgtgcgcgcgggcgcctgggagagagcccacttggcgggggacctttgcggcccaccccacgaggattaaggcggggaaattaaacttcgggtaggggacccccgcgatttctcgggaaaattggcccggtgttagaattagcgttgacaaagcgcacacacaacacatcacaaatatggaaaagcacctcccacatcgagaagcaatatcaaccccagccacaatagcgcacc

SEQ ID NO: 481479 - DNA, 273 bp, Homo sapiens
  misc_feature (17)..(17): n is a, c, g, or t
  misc_feature (21)..(21): n is a, c, g, or t
tttttgggttttttttngggnggggttttttgagacaaagtttgggtccagcctagggggcagagcaagactccgtttcaaaaaaaaaaaaaagaaaacccagtttatttgcatggtggttcaggacttccaaagaaagcatgggggtcagtagggggtaaagtagataaaaagtagggggttgagggtgcagtgagccatgactgggcccctggactttagcctgggggacagaatgagaccccatttcaataaaaataaataaagatttta

SEQ ID NO: 481480 - DNA, 156 bp, Homo sapiens
ttttttcagggcaaaaaatttttttggaacaaaaaaacgaacaactttgggatgtttttaagcaaaaaaactccctgaaaaaggatggggatgaattcccccccttccaattttagggtttttttggaaaaaaaaaatgggaatttcaatcctgga

SEQ ID NO: 481481 - DNA, 333 bp, Homo sapiens
cgtcgacatacgaacactttatagcggctgcagccactcgggaatgtcctgtatcccacatcgaggtcgtaaaccctattgttgatatggactcttacaatacgattgcgctgttatccctatgttaacttgttccgttggtcacgcttattggatcaattgacatatagtatgttcgctttgactggtgaagtcttatcatgtactgatcgagaggttgggttctgctccgagggtcgccccaaccgtaaattttttatgcatgtttgttactttagcgacctgtgagattgttatgtcctaatatgcattaataaattaaagctccatagg

SEQ ID NO: 481482 - DNA, 233 bp, Homo sapiens
ccatcctagtcctcattgccctcactctccctatgcatccttgatgttcctcacgaggtcaacggtcacgctgttagcttcgcatctgtcggcgtcaatggtgctgagactaggaatacaccgacgacggcggactaatcttcaactcctacatacttcccccattattcctagaaccaggcgacctgcgactccttgacgttgacaatcgagtagtactcccgattgaagcc

SEQ ID NO: 481483 - DNA, 1249 bp, Homo sapiens
tgccctctccgctagaaggtggataatcgagcccgggttcaccagaaaggaagtagtcccaataagttctcttttaagggtagtgtgtatcgtaaaagaaggtcacaaaggaattgcgctaaaccaggaagccttgttctgtagagccacacaaaaccgtcgtggaaggggatttccccccccatggggtcccaacatgaaccccactttttcctcttggaaaggcacaatgttggggaattaagaagaaccgggtaatgtaaaggtatttgccgaaacggttcaaacaaacttctcccaaaggaccccccctgtagggggggcaccacccacgggcttccaccgggaacctttgtttggggggagcctttcccaccgggaatttgtcccccgagaagagggttgaaagagtagtgtccttgggccacacctggggtaacacccttagttttttctggctttgggcctctctctcgtgtcgttttagtgttccctcggcgtaactttgtgcaccctcctttaaaagccacgaggccacgtccaacgagaggacaccaggcacttttaaaccacggagggcacactcggggtaatagaagagcggatcttgaaagggcctctggtgggtctcgggggggtatagagcccacagccccactttgtacaatttgtcttaaaaattgccacgctatgcctcttgaaggttaaacacactcttaagagactttggagaccacacatgggctataaaggagaagccactttggccacaatagttgtaatgtaataaatgttaaatttataatagtagaaaaatatgatttaaaattttcctcctcgggaataatgtcacaaccctcgccccacgagatatttcacaacctctcgagaggagaaggcccacgaaaggtgaaattttgggagagaacactatagggtatagaagaagagggtttggcgtatattaaacgcagcactttggaggggcccaccggcttcacctccacggagcctcgctggggcttgtgtaaccccaggaggccctctttaagtattcttttgtacgcttttcacccccacacccccaagtcctgggagaaatgccaggccaccactgagacatgggagaggcccagatatgccttgaccagaaagggtgattttgaggctccagttaatatttccaaaattgtaaccgtagccaaaactgcattggtatttagaaaaataaaaaatttcccaaaaagta

SEQ ID NO: 481484 - DNA, 834 bp, Homo sapiens
  misc_feature (551)..(551): n is a, c, g, or t
gtaatctggaacgactctcttaatcctccaccgctacagcgaaagaaagtttatcaaaattttttaaacctgtcttgaaatgacatcatattctaatcagagatttgctgaagcttcagagatcacctgccaaacacacgctagaacctgacagcatgtcacaccaggatgttgctatgaggacagattcatcaaagatgactgacgcggagtctggggtcgccaattttgtccctgctcaagggcaggccgccggaatgccttaccagacatccagagttcagctgccacagacggaacctcagatttgcccctcaaactggaggctctctccgtgaacgaagatgccaaagagaaagatgaaaaaacaacacaagaccaattggaaaagcctcaaaatgaagaaaaatgaaggctcataatctatcacgagtgctgaatttctagcatgttgaaagacttagagggtctagattcttgagacatttaatcctggtgcgaactgtggtaacattgcacccctaagcagcatgtgtatattagataattgngctgggatgcaactcactttgaccgcaatgatgatagtccaaggaaagccctttaacaggcaggttccttcccaaatacactgaaagaaaaggttacgaactaattcacgctacaccaaattgctttccgcctgtctagtaaacccaccaaatttgcactgttctcttttgggatcccttcagcccggagtagtttttaatatcaattttaatcggcatgcggcaatcatttcttggttaccgtaactagacacttaagtgctaaaaccttcttgaactcgcg

SEQ ID NO: 481485 - DNA, 381 bp, Homo sapiens
  misc_feature (26)..(26): n is a, c, g, or t
aatcccatcctgggcaacaagagtgnaaactctggtcccaaaaaagcaacaacatacaaaaaaggctgggcacagtggctcacgcctgtaatcccagcactttgggaggctgaggtgggcggatcacctgaggtcaggagtttgagaccagcttgaccaacgtggagaaacctcgtctctactaaaaatacaaaattagccgggcatggtggcgcatgcctgtaattccagctacttgggaggctgagtcaggagaattgcttgaacccaggaggccgaggttgctgtgagccaagatcacgccgttgcgctccagcctgggcaacaagagcaaaactccgtctcaaaaaaaaaaaagtcgacgcggccgcgaatttagta

SEQ ID NO: 481486 - DNA, 203 bp, Homo sapiens
ttttccccctttttttcccccccccaaaaaccccttcaaggggattaaggttttttcaaaactggtcagttttgggcaagtaacccctgtttttttttaaaaaacttgggcccttgccccgggcccaggatttttaaatttagcccataaagcccctttctagggggtaaaaaccgggccattttttttttcgccccccccta

SEQ ID NO: 481487 - DNA, 165 bp, Homo sapiens
gcggtccctgtagctgaatgtctttctcacactcaacttctaattgcacaaagctcaaactcctgctgctcgcaccctgctttgagtatgcacctgggtatgacttaaccctttggctgctttcaaagtgggatgaaaggtatccttaggatacagtcagggaga

SEQ ID NO: 481488 - DNA, 287 bp, Homo sapiens
gatctgctcgtgtgcactgattccgcgtgggaccccgctagatcactgcggactcgtaatggccagagaaagccctgcgccatcagcaacacactccaattgttgactcccctttgtggtgtacccgaattgctgcttataccaacagctaatgtggattcgtgctcatgatcttgcaacagtcttgcacacgaatcctaaactccaccactcctcccattccagcttcacactatcagaataatatccaaataccagattattgtctttattacttttatttcttc

SEQ ID NO: 481489 - DNA, 1032 bp, Homo sapiens
  misc_feature (36)..(36): n is a, c, g, or t
  misc_feature (51)..(51): n is a, c, g, or t
  misc_feature (74)..(74): n is a, c, g, or t
  misc_feature (79)..(79): n is a, c, g, or t
  misc_feature (93)..(93): n is a, c, g, or t
  misc_feature (118)..(118): n is a, c, g, or t
  misc_feature (129)..(130): n is a, c, g, or t
  misc_feature (133)..(133): n is a, c, g, or t
  misc_feature (153)..(153): n is a, c, g, or t
  misc_feature (156)..(156): n is a, c, g, or t
  misc_feature (177)..(177): n is a, c, g, or t
  misc_feature (219)..(219): n is a, c, g, or t
  misc_feature (291)..(291): n is a, c, g, or t
  misc_feature (476)..(476): n is a, c, g, or t
  misc_feature (1028)..(1029): n is a, c, g, or t
ttgttgttgttgtttttgagacagggtcttgctctntcacccaagctggantacagtggcatgatttcagttcnctgcngcctcgacctcccnggctcaagtgatcctcccacctcancctccagagtnnctnggactacaggcagtgtgccnccncatccagctaattttttaaanttttttcatagagacagggactcactatgttgtccaagctgntctcaaactcctgggttcaagccatcctcccacctcagcctcccaaaatgctggattacaggcatgagccantgtacccagccaaaatttttttcttttttaagtgaattcaacaatttctgtgagtggctctttgcatgaacactgtgcaaggtgttggagaaatccaaagctgaccaaaacatggtccccaccttttgagcttaacagtctgttctggggaacagagattcagccaaagtcaagaaacactgatnccagctagattatctgtctgtgctgggtgtctataagtacatatgtggatatgggttcatttaatccctaaatttagtaccaaaccagcattaatatctaattataaatctaattgggctaaatttattatggcacatgcttgaaaaaactattgtctctattgtaaattttttcctcatgaaccaggtgtgacctgcacactatttacggaattatccaaaacagactattctgttccaggcttcagaatgttcttgactctaagaaacttctgtaacagttgattggtgttggacagacgaaaacgggggggaattcttcaggagggaataatccttctttcattaaagacctggggtgggagaataaaatgaggggtcacatgcgactgtgctgttggatagtggagcttgttagtacatggccctgcttagaatgtggacagttgcgttgccaccctggagtaatagggggagagaggcagaagctaaatacacgattagtggggggagatcttgtcttgtgtgtgtaacagtatattatatgggggnntac

SEQ ID NO: 481490 - DNA, 172 bp, Homo sapiens
cgtttgtggagggcctcatagtccccctgtcacccgcatggtagactcagagataccccgacgccaggagcattatatcagcctggagcgcatccctcgtgaccacccctacatccagtacaacctgccggtggatgaataatagcagttcgatagtacaacctgccggtag

SEQ ID NO: 481491 - DNA, 832 bp, Homo sapiens
  misc_feature (214)..(214): n is a, c, g, or t
  misc_feature (249)..(249): n is a, c, g, or t
  misc_feature (291)..(291): n is a, c, g, or t
  misc_feature (305)..(305): n is a, c, g, or t
  misc_feature (324)..(324): n is a, c, g, or t
  misc_feature (326)..(326): n is a, c, g, or t
  misc_feature (331)..(331): n is a, c, g, or t
  misc_feature (333)..(333): n is a, c, g, or t
  misc_feature (347)..(347): n is a, c, g, or t
  misc_feature (349)..(349): n is a, c, g, or t
  misc_feature (355)..(355): n is a, c, g, or t
  misc_feature (361)..(361): n is a, c, g, or t
  misc_feature (372)..(372): n is a, c, g, or t
  misc_feature (376)..(376): n is a, c, g, or t
  misc_feature (378)..(378): n is a, c, g, or t
  misc_feature (394)..(394): n is a, c, g, or t
  misc_feature (396)..(396): n is a, c, g, or t
  misc_feature (417)..(417): n is a, c, g, or t
  misc_feature (458)..(458): n is a, c, g, or t
  misc_feature (467)..(468): n is a, c, g, or t
  misc_feature (481)..(481): n is a, c, g, or t
  misc_feature (487)..(487): n is a, c, g, or t
  misc_feature (489)..(489): n is a, c, g, or t
  misc_feature (494)..(494): n is a, c, g, or t
  misc_feature (498)..(498): n is a, c, g, or t
  misc_feature (528)..(528): n is a, c, g, or t
  misc_feature (584)..(584): n is a, c, g, or t
  misc_feature (595)..(595): n is a, c, g, or t
  misc_feature (802)..(802): n is a, c, g, or t
ccccgtagtgctcggggacccaccttccacctagcacgggttcgttcccctctcccggcctggcccgggctccccggtggccgccgccccctcgccgcccccgccttctcccggggagggggtcaggtgggcgggcactattgttgtaggagccggcgccagattcctcagccgcgctcggggtgggaccggctgggtttgggggggtggggtngggggagcggtgatctgagctccgagcagctggtnttcgcggctcgctccctccttcgcactctctcgctccctgcngccgcccgcagtgncagggctcggtggcatctncngggcncngcccgcagtccttncncctacntccagnccgctcccgcncccngnaccgctcgctcccccnanccggactcccccatgtatgangactcctacgtgcccgggtttgaagactcggaggagggttnaacagaatnntaaacaaaaagcncatctntngactnaaangtctccctggaggaggaccgggagaatacncggagtgaagtagagaacaaggctcagcagaagctcgaaaaggccaagcacaaacntgtagcatttncagtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgccttggagagcatccggctcaaacangagcagaaggccagggagatctggggaacc

SEQ ID NO: 481492 - DNA, 1015 bp, Homo sapiens
  misc_feature (422)..(422): n is a, c, g, or t
gacgtctttctccagcccagaacactcacagccccctgtccagatcaggagagctcggaaaggcaaggtacagaggttcacggatcttcctgctccctcgtggacccaagggctagcaatagtgagatgctccgatgggacgagaagaaaatcattatgactcctggggactacatgatttgctgcgcacagaggctgatggaacaaccgagggcggagtagagacagtgatggctggtgttggtatgcaaacgggatgaggatgacgcgtcctcgtgtgttgacgtacgtggtagcctagaagaagaggggacgatctgtgcccctcgacataaaaaacaactagtaatgttgacgacgtacattctcgcgcagaactcttgagaaggacaaggactgcattgataaagggggaactcaanttgaacgaagactctcggtgcaccttacgtgaaggacgatagttgactccaaaaagccacacatgaacaaactgcggagccctagagggactaacagcaactgagttggagccacatccttcaattacgtggcattgctactaattcgtcttcgcggaaggatggcactggacgcccgtgcacgtcgtggggtattgaaggacactctttatggcacccaacaaggtaaacacaagggaaggaatgggaacaggacctaggctggacttacttcgcaagcacggcgtagggttcccaaaagggatcgggggggacacacaatcaagtgaaagtcgtagggtaggagtagcgaccccagggaccaggatacggtggaagatacgggtagaccgcttaacgggcagaaccggacaaaacccgaaaggaagaagattaagcaacagggaggaggacccccagaagggaccaacgggaggccggaggtaagaggacccggtgtaactgtgaacccccaaaagcatgagcggtaacgacgagagaacaaggggcaaccacggggaacgcgccagaggcacgggagaaacggaagcaag

SEQ ID NO: 481493 - DNA, 211 bp, Homo sapiens
  misc_feature (23)..(26): n is a, c, g, or t
  misc_feature (47)..(47): n is a, c, g, or t
  misc_feature (135)..(138): n is a, c, g, or t
  misc_feature (140)..(140): n is a, c, g, or t
  misc_feature (143)..(143): n is a, c, g, or t
  misc_feature (150)..(150): n is a, c, g, or t
  misc_feature (180)..(180): n is a, c, g, or t
  misc_feature (191)..(191): n is a, c, g, or t
  misc_feature (195)..(195): n is a, c, g, or t
  misc_feature (199)..(199): n is a, c, g, or t
tttaatttgtttgcattaatttnnnntcatttgtcaaaatgcttctnttgttgccacagtaaagaacagtttttattgttttgtaagtaaaattacgtagctgattttgtatgtaaagattaatttccataatannnntnatngtatgtntactgtgatcttaatgggcagggttaaganagttatttaanatanagtnacctattctact

SEQ ID NO: 481494 - DNA, 180 bp, Homo sapiens
agttaacaaaacaaacaagaaaacaaacaaaataccaaaaacaaacaaacaaacaaaaacctcagcagttttcattgtgagcttatgtgaagccttgacctgcaaaaagggagcgttaagtcatggagagtgttgagatatcagtgtgggagagaaaaagttgatttttccgtgcatgac

SEQ ID NO: 481495 - DNA, 889 bp, Homo sapiens
gccaagacagtgacaatccctgcggggcatagccacagcattcctggcacaggccctgtacagctacaccggacagagtgcagaggatgctgagcttccctgagggggcactcatccgtctgctgccccgggcccaagatggagtaatgacggcttctggaggggagaatttgggggccgtgttgtgggtcttcctccatcgcctgtctggtggaatgagcatgctttggcctcgcgccgagggccaccttgaacttctcttgaccctgaacagatgctgccgtccccttctcctcccagcttctcctccacctgcacctacctctgtgttggatgaggccccctgacacctgtcctgcctgggggattcatggagcgctacatagttgcttagttgtcgtccatatgagatatattggcatactggtggagattgtggcttctagtgtacctgtaactcaaatagtgaacattggtacctgtatatgacaaagccctggacttccctgggttcctggactatgatggcaccgtacgtactcaggccgatgcagtgcaccgatctcccaccgcccggctaagggccccggatcctgaggcgagcctagataccactcacctgaaggcctaggcaagccttgagcccacagtcgatgctgcatgtccctatcttgcaagctgtcaagaccacagacatcaatgatccagagcagcacaggcaaaagctgacactcgcacctgtattatccaagcctctatcttccgaggggtgcgaaacttggccccgttcccattactagagcctggagacgcaacgccttattgtgtcccacttgctgctatcgatcgtctaggaccgggagcctacctcgtctactggtatgagcct

SEQ ID NO: 481496 - DNA, 136 bp, Homo sapiens
tgcggatgtaggacatctgccgctcttcccacattctttcatttatatggtttttctcctgtgtgcaccctctgtatgcatgtcacatggttcaagttgccagcttgaaccttgacctaatgcatcaagaattgct

SEQ ID NO: 481497 - DNA, 185 bp, Homo sapiens
tgggtataactaaatagggcgtcaacagtgtctgttcggcctaataatgtgcctcctgcataatagctgtgatcgttacggttaataccactgaaaacacgcccccccatattttgtccaggtttcaaaatatcagctgcatttagtgttttcattgaaacgactccagccaatgccgtcgacgc

SEQ ID NO: 481498 - DNA, 662 bp, Homo sapiens
gggggaggaagactctatctaaagcactgaggagttttggtccacacgctcctgctcctgactcaccggtgaaaactctcgccgaggaacaagtcgagcaggaagcccacgcgcaacagccacggcttttaaggataccggagaaacacccgaggagccggtggtggcatttcaccgaattcgaggggggtaacaagccgcaccggaaaatccttgaaaaaggtgtgtgctgacttgaaaagaggcgcaaaacaaattaatttgaaagtgataggaccaggtcgactgcctaccaagactatgagaatcattacaagaaatactccttgtggtgaaggttctaagacgccgaatcgatcccagatgagaattctcaagcgactcattgacttgcacagaccttgtaagaatgttaagcatattactcccatcagtattgagccaggagttgaggaagcagcacctttgcctaaacttaacataactatttgaccaattgatagccatgtgcgcaatataaaaaacacggaatacctgcaaaggggggtgaaacccccattgtaccacccccgtttataaaacggggacccggtttctttgccggcggcccggcacaaggacttttaatttagcattaaaaagggcggcccaatagagccccc

SEQ ID NO: 481499 - DNA, 1233 bp, Homo sapiens
gcgtgcgtgcgctggtgcccagtgactgccccgatagaccccgtggacgcgcctcaaaccctgccaagtacatcccgtgtggacacgtgacgaccgcgctgctggtacggctccagcaccctcttacttcgtgttcacgatgcccgtggattgacacgagctagtgtccccagctgttacccgtactacaatggcatcatacttcctctttgtacactggcacaacttacagcatggccactttcatggaccctggtgttaacccccgagacggatgaggatgaggacaaggaggacgacttccgggctccgactgtacaagaacgtggactgtgcgaaggtatccatggtccagcactgacagtgagtatgtgccacagatgccacttctaccagaccagccagcagctgactcccacatgcaagcagtcatgttgacaatcatgagataacgaggactcttgaccacacactgacccctgagagtcaacaaaactgacatacgaggacgatcgaacaacctaatcgcatacttcctctcctgtatcctgcctgatccactcagatgacaccaccactgcgttggagacagacacaatagggccctatcgaaccctaggtacaaacagttgcttagaaaaacaacggacatagacggagagcttagagacgcacagaagacaacaacaacccatacacacatagggctaagtcactagagtagttggccagagcctacaatccttaccataacccctgatacatatggagccgtacaaactagtgccttatccaatgatgagagatgctgggctccaacaacgagagaagacggacaaccaaacaacaacgagacaaaggtagaactgggacaaaaggtatcaccacgagccggattgatagaaaaccactttaaaccacccagaaggatgacaagtaagggaacatttgtaggaagaccacgagagcgctaggcgccgaatcgaccacacaatgaacagcccccccagtgactacagagattgtgtggtgaatacacaacaacgcggaattggacatgacatcgaggaaggcaagaattgaacgccaagacatagtccagaaaagggccgagaaacaacagagtaaaacggaaaaagtaacaggagaaaacgatccacagcgctcatagtagaacaaggaatagacaagaatggaccgagtaacagatgaaaagaccagcagcaagcagaa

SEQ ID NO: 481500 - DNA, 1068 bp, Homo sapiens
gctgggaaacagctgaccaggtcaaggtcaggcttccgggacacgacagggagtgttggggatgatggctcatctgggtcagattgtggggttcggtggggacctgtcggcagggggtagatccaaggcagctgatcctgaatgccagggcgagagcaagcttggatgccagcctgcgggcagtgggacccagtgacatactgtaagtgcgcaggtgggacgtggctcacgcatttgggctcccacgaaagctcagctctgctgctagcgaggaaacacgctagaccagcatgcgggcaagactcgcggagcagtacgcggcaccagggccacacgactacggcaatggctcccagcagacagtcctgcgaggccacgcacacgaacgatcacaggcagtcggcaactgagcaagggcagcacctgcgcgatcacgcgcgcactggcccctgcggcgccgccacttgaacggctctgggctgcacctcaccatcgcaatcgctcaccgcaaacagctgcagcgctcgcagccgtgccacgcactcggtggcctgcactgaccgtcgtacactcccgcgggcacctcccgcgccacggcctgcacgcgctgcgaccgcgactcgccatcagacccccccagcgcagcatcacgaacgacaccagcgctgacggcccacccgcacactgcagtacccgctcgccacatcattaacgaacacaaagccctcagccctccatttcagcgcctgcgggcgtgtcgcgcaccgcacgccacataaccggccctaggtcgcgctcgcccaagccataaccctcccgagcggaaccggccttggaggggccaacgagccggaaaatacccccggcaggggccccccccgggcaacgctcccgacagcgccccggcccagccgcgaagccccgacacggccctaggcgagctggctggacggcaccctagcccctgggcgcccagccaccaactgcaaccagccaccgcccctcccacccagcacaccccaccaacccacccccgcgcgccccaccccgaggcggcgcaccccaaga

SEQ ID NO: 481501 - DNA, 131 bp, Homo sapiens
gctctggatcaagatcccatgcacagactacatgggcagctgtacctttgaacacttctgtgatgtgctggacatgttattcctacgggggggccctgcccagagcccctgcgtacctatgggcttccttg

SEQ ID NO: 481502 - DNA, 245 bp, Homo sapiens
ttaggcgcgtcttggtcctctgtatattgtaatgcagcaggaggcccaacatagaacatactcgcagtactcggctgtgcaaaacatgtgtgctagcgctgaagtacaaatgggaaaacgtgattcttatatgttataactaaatacttagaacacgacttggctcctaccaagcatctggactctcggtctcagtactggagtgtctcacccatgtggccccacgcagaatgcgcctaaatcat

SEQ ID NO: 481503 - DNA, 153 bp, Homo sapiens
  misc_feature (19)..(19): n is a, c, g, or t
  misc_feature (42)..(42): n is a, c, g, or t
  misc_feature (67)..(67): n is a, c, g, or t
  misc_feature (118)..(118): n is a, c, g, or t
  misc_feature (120)..(120): n is a, c, g, or t
tcagtcaccgtatttgggngaaccaagcaaacaatccctganaattgcagatacaatacaactgcanctaaataagagtaggtagcgtggggcagaacgagcgtataatcggaaacangnatatgcagactcaggatgcacaccgcaagtggc

SEQ ID NO: 481504 - DNA, 427 bp, Homo sapiens
atcaactcgatgagctggagcagtgatcggcacgaatgaacgtgtcggccgccgtctcgagactgagattcacgttttctgaatcgatccaggcgaagaatcggcgcaatgcactgatcttgttctgcaccgagaagcgacttccgccaccagcaaggtcgtcagtcatgtgctcatgcagctgcgtcaccagctcgaaacgttccggcaagggactgccgagttcgccctgcgcgatctggcggcccacatgcttcacctttgctgctgcacctccgcgaaacagcagcggccggaggtcccagggcgtttcagtggccccatactcaagcatcgggaaagtgaggtcgaattcggaactatccatcgtgccgcgccccagcgccgatcccgctaaatgccgccatgaagctatttgagagggctt

SEQ ID NO: 481505 - DNA, 851 bp, Homo sapiens
  misc_feature (295)..(295): n is a, c, g, or t
  misc_feature (302)..(302): n is a, c, g, or t
  misc_feature (305)..(305): n is a, c, g, or t
  misc_feature (308)..(308): n is a, c, g, or t
  misc_feature (345)..(345): n is a, c, g, or t
  misc_feature (355)..(355): n is a, c, g, or t
  misc_feature (372)..(372): n is a, c, g, or t
  misc_feature (431)..(431): n is a, c, g, or t
  misc_feature (454)..(454): n is a, c, g, or t
  misc_feature (465)..(465): n is a, c, g, or t
  misc_feature (469)..(469): n is a, c, g, or t
  misc_feature (476)..(476): n is a, c, g, or t
  misc_feature (486)..(486): n is a, c, g, or t
  misc_feature (521)..(521): n is a, c, g, or t
  misc_feature (529)..(529): n is a, c, g, or t
  misc_feature (542)..(542): n is a, c, g, or t
  misc_feature (545)..(546): n is a, c, g, or t
  misc_feature (556)..(556): n is a, c, g, or t
  misc_feature (576)..(576): n is a, c, g, or t
  misc_feature (582)..(582): n is a, c, g, or t
  misc_feature (596)..(596): n is a, c, g, or t
  misc_feature (600)..(600): n is a, c, g, or t
  misc_feature (605)..(605): n is a, c, g, or t
  misc_feature (609)..(609): n is a, c, g, or t
  misc_feature (612)..(612): n is a, c, g, or t
  misc_feature (633)..(633): n is a, c, g, or t
  misc_feature (643)..(643): n is a, c, g, or t
  misc_feature (654)..(655): n is a, c, g, or t
  misc_feature (660)..(660): n is a, c, g, or t
  misc_feature (691)..(691): n is a, c, g, or t
  misc_feature (699)..(699): n is a, c, g, or t
  misc_feature (710)..(710): n is a, c, g, or t
  misc_feature (717)..(717): n is a, c, g, or t
  misc_feature (738)..(738): n is a, c, g, or t
  misc_feature (748)..(748): n is a, c, g, or t
  misc_feature (774)..(774): n is a, c, g, or t
  misc_feature (781)..(781): n is a, c, g, or t
  misc_feature (819)..(819): n is a, c, g, or t
tgcctagtgtgggatgtaagcgcggaggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttccccgtggccngcctgcntancancgcccgcccccctactgccccgcctccacccgcccangactcccganggccgcccgtccgaccntgtcccctcattatccctcaggagaaagggggggttgtcttcccagccagttgtagctngggttgaaagaaagagtcttccngaattgttcantatnggggaanaagctcttcnagctcagcttcactttactattcaaaagggattcngggtgccncaacaattccaangtnncccttctttncaagctgttcaattcaacangggcancccaaaattttggnacancgctncccnggnggtgtgggcctttttagcttngtcgggtttngggggcacctnnccaanggcccccttgggggtcctcccaggggaaatngtccaacncatccgccccnttgttcnttgaaggaagtcaagtgcccntgggggtaangttggttttgggggccccaaatgggngggaagncaagaacaagcttggaagggttcacccttggggcaacngggcaaagggggacaaaacggaagggaacacg

SEQ ID NO: 481506 - DNA, 291 bp, Homo sapiens
tttttttttcccccccttttttttctccccaaaaagaggggccccccccccctggggggggggggggtcccccccccccgggtttggggggtcccccccggggggggggggcccccccccctttttttttggcccttttttttttttctttgggggggggtcccccccccccccccggggggttttttttttccccccttgggtttttttttttttggggggccggggcctttttttttttttttgggggggggccccccccccccccccccattttgggggggggtttta

SEQ ID NO: 481507 - DNA, 351 bp, Homo sapiens
gggtgatctagcaggatcttccgcgtacagttgcgggacgaagttgatttacgccgataatattatagtgaatggttttggggtaggtttggctagggtgtagctgagaataggggaaatcagtgaatgaaggctctattatgggaatacaggtcctattgataggacattagtgggagttgggtacaatgtagtacgtgtcgtgtagtacgatgtctagtggatgagtttgctaatacaatgccagtcaggccacctacggtgaaaagaaagatgaatcctagggctcagagcacttgaagcagatcacttcatcgcaactggtacggcgggggcaactggtacggcggg

SEQ ID NO: 481508 - DNA, 419 bp, Homo sapiens
cacgaggagagagagtagagagagagagttagagagagagagagagagagagagagagagagagagagagagagagagagagagagtgagagagagattactatgtgatgtatttatatttttagtcctgagattgttacttattttacatacctaagcataattattttccccaccatctatctaacctccttaccccctctactgactgcatgtaacactttgtcaatctcggaccttttatatttatttattcatttttttaaatagagggtctcactctgtggtccatgctgtagtgcattctcttgatcatatctcactgcagccttgaactcctgggtttatgcgatcctcttgcttcaacctcccgtgctgccattatatgtgtgtgtgagctatcacacctggcctatctt

SEQ ID NO: 481509 - DNA, 306 bp, Homo sapiens
tatgcacagtgtcagcacatgactcttctttggtgggcacttcccagacggatgctgaaattgtctgctaggggagtttcctaatctgtgccgtcgcccacagagaaggcctggtgggcattgagatcaacatgggactgactaagtacataggacacaatatggacaagtgaggggtgagctaatggaagaaaggagcacacaatgattgagaacccagtgctgtactaggtactaccagctgccttatctctgtcatcccggtaacaataatggaaggtgggtcctgttatccccctgtgaatg

SEQ ID NO: 481510 - DNA, 686 bp, Homo sapiens
  misc_feature (40)..(40): n is a, c, g, or t
  misc_feature (197)..(197): n is a, c, g, or t
  misc_feature (205)..(205): n is a, c, g, or t
  misc_feature (247)..(247): n is a, c, g, or t
  misc_feature (267)..(267): n is a, c, g, or t
  misc_feature (274)..(274): n is a, c, g, or t
  misc_feature (343)..(343): n is a, c, g, or t
  misc_feature (430)..(430): n is a, c, g, or t
  misc_feature (436)..(436): n is a, c, g, or t
  misc_feature (470)..(470): n is a, c, g, or t
  misc_feature (473)..(473): n is a, c, g, or t
  misc_feature (477)..(477): n is a, c, g, or t
  misc_feature (479)..(479): n is a, c, g, or t
  misc_feature (487)..(487): n is a, c, g, or t
  misc_feature (494)..(494): n is a, c, g, or t
  misc_feature (511)..(511): n is a, c, g, or t
  misc_feature (544)..(544): n is a, c, g, or t
  misc_feature (547)..(547): n is a, c, g, or t
  misc_feature (550)..(550): n is a, c, g, or t
  misc_feature (626)..(627): n is a, c, g, or t
ctggaaccccaaccttctatgacccccaaaaatgtacttngtggctttagcataatttataaaggggaagagggaaaatactgaaaaaggccactatttaatggtgaaagaatgaagccgtagaggtcccaaccagcctagggccaaaaaagaaaattaaaaatctgcacaaagcaagccagcctctcactcccganagtaaggnatttaggcgccaacctggtgagagtcctcagcgagccctgtnaggtcaagtacacataaggntgttggnagtcagccgcacgtagacacacacatagaaatgggcacatgcccacatacacacccgaaaaagggagantttactggattacacaacagtaaagtaaatttcatttttcctaagggtttgtgccaagttgaaccagacccttccagccttggggtntgggtnactccacccagaggctgccactcctgtcggtgtngtnacangnctgcaccnatacgcngtatcccaaagtgcatnaacgaagagcaagtctggcttctgacacgtgcngtngcncccaagaaactaagttggcttctgttcaaatggccactctcctgccggactatgctttatcaaagggataaaaaanntactttattctgttagggactgcaccagttcatccactgagtattttgctcggtccacc

SEQ ID NO: 481511 - DNA, 81 bp, Homo sapiens
gttgaggacacggctgtgtattattgtgtgcaagaggggagtccgtatagtagcagctggtacggagcctggggccaggga

SEQ ID NO: 481512 - DNA, 403 bp, Homo sapiens
gctgaggcaggagaatcgcttgaacccgggaggcagaggttgcagtgagccgagattgtgccattacactccagcctgggcaacaagagcgaaactccgtctcaaaaaataaataaaataaaaataattaaaaaaaataaaacattttaaaagtcattgaacccaagaggcagaggttgtagtaagctgaggttgtgccactgtgctccagcctgggagacagagtgagactcagtctcaaaacaaacaaacgaaaacaatgaccagtggcacatgcctgtaatcccagctattcaggaggctgaggctggaggattgcatgagcctagaagtttgagactataatgagccacaattgcaccactgcactccagcctgagtgacagtacaacctgtttcttta

SEQ ID NO: 481513 - DNA, 1496 bp, Homo sapiens
  misc_feature (1448)..(1448): n is a, c, g, or t
  misc_feature (1473)..(1473): n is a, c, g, or t
gtgcaatcatacttctatacctcacattaggcgcgtgacccgactgtcgaagaactcgaatgagtgtgccgagattcccgtgagcgatgcttggcactccagataggacaaagccgcattctgcagatggcagaacttactaatggagttcagcatgattctatgaatacttggttactgcgatccgtgtggtttgctactcgggtttcccacatacgattcacgacagcttctaccggaagatacgttcgtatcatcatgggatcacacagacaaactgaaagattcacatgaaggccactcgtaatgccttgtggaattggcatagactattagggctttcctcaatgtgtgtgcggaagcaatgtgtccctagggtcccgagcctcgaatctcatttgcattcctagagcaagggaacccaccagattttcttctggaagcgaatactcaggtttgcacagaggaactgctgcattggacttgagggtttttccttatgggggaatttcgttacacagcctttcacatttactttgttatcgcacctattgcaggctacattttgtgcagcacaagcttttaggccttttggcgctttggagaaaggttcctcagtgtggaccctttgggttctgcctttccacaattgccaagaactgtcctaggtttaggaagatttaagacgccaaagccgtcgaaagattttcagtcggtgtatttctaccacacacgtgtccgattgtgaaaacaatctataggagcaacaccccggttttgctacagcgatttatgtcggcccgtttactatttcttgccgttaggaatacccaaaaaagccccaatatgggctggcctatgagcgcgcattggtggttaggccgctaatcatcaagttggtccgaaagggcgggcgttcctccaaattcggataataacaggcagtggccctgtggaaacgcgaccctgtgaatttgccccacttatcctttggacacaccgcaaccacccaaatggtgtgcacattcacgcagtcctcacagtgtcccccagttggtttcactatatggcgtggtgcctctacccatgtcactctttggccatggcacatacagcactttaccaaacacggaaagtgtggtacctctacctattaagcggcgccgtttgctgcgatatggggtcgaaaccgcttgacccctggatacgatgggccataggcgtttatagtcccctttagcctaggagaacattttcggcaaactaggcgtctgacaacgcggtacgatagctttggccgactcccacttatatcgcggcaaatatgtgtggcccgcccaactaacttttggcgcagtctcactattttactcctgtttccaccaccccttttggcgttttaacttacacctttggcaacattcggtcgctggtagagcaacgccgcnacaaagaagaaacgggcttataccnccggggtgtgggcaacacatacc

SEQ ID NO: 481514 - DNA, 1627 bp, Homo sapiens
  misc_feature (706)..(706): n is a, c, g, or t
  misc_feature (718)..(718): n is a, c, g, or t
  misc_feature (786)..(786): n is a, c, g, or t
ggctggatgcaaaagagaaccagagcatcagagccttcaatagtgagcataagattccctatgtgcgactggagcgactcaagatctgtgctgcctcctcaggagagatgcctgtgttcaaactgaagccacagaagaatgatcaggatgggagcttcctgctgatcatcgagtgtggcactgagtcctccagcatgtccattaagcggccaccagaagtggagggcacatctcctgaagaacacagactcattcctcgaaccccaggagccaagaagggccccccagccccaatagagaatgaggacttctgtgctgtttgcctcaatggcggagagttactgtgctgtgaccgctgccccaaagtgttccacctctcctgccatgtgccagccttgctcagcttcccagggggagagtgggtgtgtaccttgtgccgcagcctgacccagcccgagatggagtacgactgtgagaatgcctgctataaccagcctggaatgcgggcatctcctggcctaagcatgtatgaccagaagaagtgtgagaagctggtattgtccttgtgctgcaataacctcagcctgcccttccatgaacctgtcagccccctggcccggcattattaccagattatcaagaggcccatggacctgtcaatcatccggaggaagctgcaaaagaaggacccagctcactataccancccagaggaggnggtatcagatgtgcgcctcatgttctggaactgtgctaagttcaattatcctgactccgaggttgcanaggctggccgctgcctggaagtgttctttgagggctggttgaaggagatctacccggagaaacggtttgcccagccaaggcaggaggactcagactccgaggaggtgtctagtgagagtggatgttccactccccagggcttcccgtggcctccctacatgcaggagggcatccaacccaagaggcggcgacgacatatggagaatgaaagagcaaaaagaatgtcatttcgcctggccaacagcatctctcaggtgtgagagccaaaaggagactgggcactctggcagctgttgtcccatactgtcgaccattcctccccatcttgcagcttatcctcttcagagtgtggatggtagatgagtcttgttgaactgtgtagtgctcttctttgccatttgcatctacagcatttatttgggagctgtagtacatccactacagagaagatttcagtaataaacaggaaagaggaaggtatttattattaccagagtaatcagatgtataggctccattgacagacacacctggttaggctcgggaaacctatttccttggtgaattttattctgcctgggaaagcagacccgtctaaccttttagtgtccagggctcaggagccatgtatacatctgaactcctcctgggctcagaagtgggtaaaagcaagggagagaggtttagcccatatggcaggactgtgatccctggcccagcacacgcaaagactgtcactgttagactttgcttgtcctgtctggatagaggcaccttgccatgtgcagactagtggaggcttctagaggcataggtctcaattgtgcctatttgggtctaa

SEQ ID NO: 481515 - DNA, 568 bp, Homo sapiens
  misc_feature (70)..(70): n is a, c, g, or t
  misc_feature (376)..(376): n is a, c, g, or t
ccactgaatcctgagtgattgcaggcttatcagacttgggacaagttggagcccacgaagccaccgtggngaacaagctcaacattccccccttttcctttggggtggtcatccagcaggtgttcgccaatggaagcatctacacccctgaagggcttgatatccaagaggaaactctgcattctcgcttcctggagggtgtccgcaatgttgccagtgtctgtttgcagattggctacccaactgttgcatcagtaccccattttatcatcaacgggtacaaacgagtcctggccttgtttgtggagacggattaccccttcccacttgctgaaaaggtcaaggcctttttgggtgatccatctgcctttgtggntggggccccctgtgggtgttccaccccaaggggctcctgttgttgctgcagccccagctaaggttgaacccaaggaaaagtcggaggagtcggacgaggaaatgggatttggtctctttgactaatccccaaaaagcacccaacttagccagttttatttgcaaaacaaggaaataaaggcttactttttta

SEQ ID NO: 481516 - DNA, 512 bp, Homo sapiens
  misc_feature (511)..(512): n is a, c, g, or t
gtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaacttgctcgttgtcatacccccaatgtttctaagatttaagattctccgttactactgatcctacggtttaacatatctttgaaagatttgtattaaagtgtgaatatttaagaagataatatgttatactttctagtaaaatgtaaactcgtgaaggatacgttatataactgacagcacgatacctggtaaccacctcaaagaacttccatattatggagagatttttattgcccctatgtgtttggaatctataataatatagagtaaacagtacggtacattaaactagatgttgtttggctaaaaaaaaaann

SEQ ID NO: 481517 - DNA, 1165 bp, Homo sapiens
agcgggtgctgattccggggcagcgagtcgtcggccgtcgcgctcgaagcttccgcccgctgccatgccgcggtacccgggccgtaccgcgtcatggggccgctccgggcctgcgagcgcgatcgtcagctgacgcgtgcggcgcgtcgccctggcacctggcgcgtggtggcctggctggtgacgcacgcgattgatcgctgtctgttcatcgaatgctgctgcatcgtgctttctaatggctcatagttcgtgtgcagcgcggaaattgcgagctcaacgcatgcatcgggccttcaactacctcgggccaagacccacacctttcttgtcaaactgcttgattcgcttttcagggactgttgtcaaagcgaggcaccattgattccctcaccgttgcgtgttttcaaactattgccgcataaagatcacgcaaaaagggggacaatgtgaactgtattaaagaacttcctggggaacatttggaggggaaaacaggtacccggcggtatgcccccgactagacattagttaagaaagagtccggcattagcatttggctacgatagggaaaggttgaatgcctgcccatagttcaggttcgttaccatgttggatatggaattagtcttgtcttgaaccccaggagaaggcataagaattttggacgcgcccatcctataagaaagcggaataccttcctagaaaaagaccttttatctgtgggaacgaaaataacctttccaaagcttggcaatgggtgtgcacattccccagggattgcatataacgtcccatagagtgttaacccaaaaggcggaaaacactcttttccagggggaaagccattttcgaagattagaagaataggacaccaccttggaatttcgcacgaacagcaggttgaaatattccttgatgccatagacccaattaccgagaggaaaccacgaaagaaagaaatcctgaagttgccgttaccttgccagatcctttcttaggcaaagaaagatataaagtgcgaaccaaatttatttagactcaatttcaaggccctttaaaaggtgggcttttcatttcaaaaacgaacttccggaaaggtccactgaggaaacaaacctgtgagaattttgcactgacaagttcactcacactttgaaaaacg

SEQ ID NO: 481518 - DNA, 400 bp, Homo sapiens
  misc_feature (212)..(212): n is a, c, g, or t
cctaatattgtaaagcactagaaaccaattttgtatacctccaaaataaaatttggcactcttataattaaataaaaaaatttcccacaacaagtttactgttcataaaattgccgtagtacagggctaggcatggtggctcacaccctgtaattccagcactttgagagaccaaagttggtgcatcacaaggtcaagaggtcaagaacatncctggccaacatagtgaaaccccatccttactaaaaatacaaaaattaggtgcgcatgctggagtgtgcctgcagtcctagctactcaggaggctgagacaggagaatcgcttgaaccccaggagtcgaaggttgcagtgagctgagatcacgccactgcactctagcctggtgacagagtgagactc

SEQ ID NO: 481519 - DNA, 416 bp, Homo sapiens
agcggagaggcggctccgggacggcgcgaagcgctggtggcgtggcccgggctgcgtgcgtgtgcgcgcccgccagctgctccggagatacgataagacatgaaaatctgtggattcttagtaacatggagaagaattgcatttgtgtgaaacacacagaacaagaattgtctgcaagaggatcatatctaaggtgcacgtttttgcgtgatacttcattatctagctctgaacacggaaggaacacagcagggggtgccgaacaagcaccaggaacccctgaataacttccagtctttgttgccgtaaccgttccagcgataacgatgctaggaaggcacatagtgacgagaacacgtacgacgtgacagggacagtgctgctcaagtagtgcatggcgggcaaatacggtccag

SEQ ID NO: 481520 - DNA, 103 bp, Homo sapiens
tctagaggatccgatatgtgttatacatgaagtgcagtgagcagcagtgttatgtagaaagctgtgaagtatgcagaagatctagctaagatgatgagggcgg

SEQ ID NO: 481521 - DNA, 613 bp, Homo sapiens
cccatgactgcatctctctgatccacctgacattcaccccatttccccatattacaagccactagcccatctcttagaacctctcatttcctttccattgtagaaatctatcctcaaggaaataacttctcagtgttccatctgctattctatctgctattctgctactcctcaaggatcattcaggcccctcccttccctacacatcaagctcgaggatttgcccccgcccaggactggcaaattagctttactccagcatgctcccggagtcgagcaaaaacgtaagaatggcctccttaagtctaaagttagaccattttttcaccttagaattaggttagaaggccttttccttacggggctcgtgagagaggccacgcgacagcacatttcttcccttctgtcagacataagttcctcagttttagcccttcccacctctatacagtctgataacagaccaggctttattagtcaaattagccaagcagtttttcagtttatatcccttatagtcctctgtcttcaagaaaagtagaacggactaaaggtcttttaaaaacacacctcaccaagctcagccaccaacttaaaaagaactggacaatac

SEQ ID NO: 481522 - DNA, 1185 bp, Homo sapiens
tcatacactcccctccccccttttttttttgtagcgaccccccccccaaaaaagcgcgcggccccccctcctctccgcgcggggcgcccgcgcgcgcggggggggcgggcaggagggtgagacagaagagaggggggggggggtgacacacacaaacagcgcgcggggggggggggggggcacgagaagaggggggagaaacaaatatatataaaccacgacgagagagggaaacgagagagggggggaccccgccaccgccggcgcggggcccaccgagagagacagcgcgcgcgcgggcgccacgaggagggcgcgcgcggcggcgctcctcacaacacaccgccgggaggggggcgcttcgagaggtgcgcacacacacagagagggggcgagggagaggagagagagagagagtagtgtacaccacaccctcttctacgccgcgcgcgcggagggggagagaaccccccacgagagagagagaaaggaggagaaaagaaacacaggcgggagggaggagggaaccaacaaaacaataagtagaggaggcgggagggagagggcggcgacaaaacaaacagggaggaggagaggggggggtgttactcctcccagagagggaaaacacaaaaagagggaggagaccacagcgcggggaggagggaggagggaaacaagggagggcgtccggtgggggcaaaaggaggagggacgccacacccacggaggcgggagaaggggagaacaacaagcgctgtgaagtgagtaggggagaaagaaagaaagaaacataacagatgagaactccacatatagatgggggggtcgacacagcagagatgtataaacataattaggatttgaaggacctcccatcacaccagcggagggaagaaaatcagcggtagctcccaaaaaaaagacgaaaaagacagcgcggagcaaccaaaaaccgagaaaaaacacaaaacaatatacacacaacacagacaagagaaactaataagtggagtatgtgaacgcgaggaagcaataaaaaatactgggtggagaccgaaaagagaaacaaaagagtagcgcgacggcagggaatccaactaagcatacacccagcaagacagaggccgcttcctcaccacaacacacatctagtggggacgcatccaacagaataatgaagac

SEQ ID NO: 481523 - DNA, 139 bp, Homo sapiens
gcacagaggaggagctgaggtccaagggagacaggcaagatatttgtcagcaccgagttcaagttttacaactgcagtgcccaccaactgtgcctgtcctgtgtcaacagcgccctcctctgccacctcctctgttcca

SEQ ID NO: 481524 - DNA, 490 bp, Homo sapiens
  misc_feature (396)..(396): n is a, c, g, or t
  misc_feature (405)..(405): n is a, c, g, or t
  misc_feature (462)..(462): n is a, c, g, or t
  misc_feature (469)..(469): n is a, c, g, or t
tccactgagactggagtgcagtggcaagatcatagctcactgcagcctccaactcctggggtcaagcgatcgtcctgcttcagcctcccaagcagctaggactacaggtgtgcaccacctttcctggctaattttttttttattttttgtagagatgggggtctcactttgttgcccaggctgaccttgtacttgtggcttcaaatgatcctcctgccttacctcccaaagtgttgagattacaggcatgagccactgtgcctgggccaaaaaacattttaaatcccttgtctggggggtcagtcctctaaaacatccctcagatttcagatagtacttttcaaccctgttcctaaacataggcaggttttgcagtaatcttttaggaatataggnttgttcaantaggaggatgggtttttaaccccacatgtttttcataggggggacattatttatttnggaaccntaagggtaggacatgtttatt

SEQ ID NO: 481525 - DNA, 294 bp, Homo sapiens
ctggtctgcactagaggatcccgcctaagtggaactgctccggctaagtggaactgctccgcatcccacaggcccagctctgatttcagccatagctgtgctggtcaggtccctgtgaactcatcccaaccaaacccatctggaacagaagcctcacatttctctgcagttttctgtcctagggatttctccaagaagaaggcactcggcagtagccctcacccacacacaatcatggtggagaaatatgggagactttatatgcctggggggcaaccccggagcagttccact

SEQ ID NO: 481526 - DNA, 277 bp, Homo sapiens
gttcatctagaggctcccccatgttggcgatgtgtcggtgtgcacggactgatgctgtgcgtgggggggcatggggcagtttcctttggtgggcccaggacttcggccccatccgggcctcccctccctgctaggaggcaatcgtcacgaccaagctgctggcctccagtcccatctcccccaacacttgtgcccccaaaaagtgagccagggcacctctgtttcctgctgtatatggacagccgatgcagcgctttgcccatgacctcccttgccc

SEQ ID NO: 481527 - DNA, 481 bp, Homo sapiens
atattgtccaaaaaacccgaaagaacccaagtcgacctaaaggcagtgattcaagagaaagaaaaccccaatgctgccaccagagctttttggaaaaaacagaatactggccgccttgtaaccttctcaaaacgtcaggcctggacttaaaaaattttttaaaaaccccataaagtagtccaggggcggtggctcacgcctgtaatcccagcacttgaggaggcagaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcgaaggttgcagtgagccactgcactccagcctgatgacagagcaagactcagtctcaaaaataaataaaaataataaaacctcaaaaaaaa

SEQ ID NO: 481528 - DNA, 135 bp, Homo sapiens
  misc_feature (60)..(60): n is a, c, g, or t
  misc_feature (85)..(85): n is a, c, g, or t
gatcccagtaaggaaggcacataagttgttcttcccagtgcacacaaagatatgacactncactgtaacctattaagtgtgcaangcattatgtctaaaaacaaaaatgtacataccctaaaaaatactttttgc

SEQ ID NO: 481529 - DNA, 108 bp, Homo sapiens
ctgggtcgagtctattctttgtggaatttcagctaggaatgttattccggtacagatgtacacagtcaaaaagattatgagctgtttgacgagttctgaagtgtgctg

SEQ ID NO: 481530 - DNA, 122 bp, Homo sapiens
gataagtttctggaaagggaggggaggcagacgtggggcatgccagccgtgctctctcccccattcttgtgcatgcaatatctctcatttccctcagttttcctgcaagaatgttctctctc

SEQ ID NO: 481531 - DNA, 205 bp, Homo sapiens
  misc_feature (24)..(24): n is a, c, g, or t
  misc_feature (173)..(173): n is a, c, g, or t
acatcatcctgaagaaagtaatgnggaggacatcgacacatttcccaaagctgggttcaacatcaagacctggagcaccgaggattcaagctgaacatctgggatgtgggtggcagaagtccctgcggtcctactggcggaactaattttgagaagcaccgatggcctcatcntgggtagttggacatgcgcaggaccggacagg

SEQ ID NO: 481532 - DNA, 1076 bp, Homo sapiens
  misc_feature (267)..(267): n is a, c, g, or t
  misc_feature (299)..(299): n is a, c, g, or t
  misc_feature (380)..(380): n is a, c, g, or t
  misc_feature (387)..(387): n is a, c, g, or t
  misc_feature (456)..(456): n is a, c, g, or t
  misc_feature (559)..(559): n is a, c, g, or t
  misc_feature (582)..(582): n is a, c, g, or t
  misc_feature (589)..(589): n is a, c, g, or t
  misc_feature (593)..(593): n is a, c, g, or t
  misc_feature (610)..(610): n is a, c, g, or t
  misc_feature (629)..(629): n is a, c, g, or t
  misc_feature (639)..(639): n is a, c, g, or t
  misc_feature (652)..(652): n is a, c, g, or t
  misc_feature (654)..(654): n is a, c, g, or t
  misc_feature (657)..(657): n is a, c, g, or t
  misc_feature (675)..(675): n is a, c, g, or t
  misc_feature (678)..(678): n is a, c, g, or t
  misc_feature (681)..(681): n is a, c, g, or t
ctgagttctatctttaggatttatctttaagagcaaatttctggtcagctgtgctcctgcccacacctacctccctttaaatattttaggttgcagaagcacagctgaccagaaatatttaaagggaggtaggtgtgggcaggaggaggaatgataaattgggccaggcaagaaaaatctagcttcatataatttgtctgggactatacaccctatataatgttagttttacagaagtaatatgacttttgattgctacataccacnaagagtttatgaactgagatcataaagggcanctgatgtgtgaagaaagtagtcagtacatcctggctcatgctctgaaagaatatccagagaggctctctcaaagatcaggnagatgtnttcccatgccatgcaccctgcttcccagcatttctgcatggtcaagtgagctttatgctcatgagcttnaagtatataattatccaggattttaaatcctcaacttgttctagctgtgatccctcaaagttgggtcatacgttagtgctagatactagaaattttcactttncactgatcagagagacagacatnaaaaacnaaantagaagaaggaagcttncaccctgcagcttcttagnaggaacaatngtcttgccaaaantnttntcccttttctctcccatnttnttntaccaatccttcttactcttgcagtgtgacatgcttctctctgtagatgttaacagttatggcctattttcctcgggacacttaatcgaagcaatcagaacacacatatgtaggggaggtaaaccgtggccgaacagtcgtgatccatcaggttagccctgctgtagggcaagggagccagattcagctgcctttgactgcccttgatccgatatctgattacccgtgttcataggagttatcaggtaagggctcagctctgcacggcatgtaacaaaggaagtgttaaaaaaaaagaaaaggttggctcaaggggggctgtgggggcctttggggcacaccgtcctcgttgatgcgttaagatgcaattaatctgaataccaaattaaatgtta

SEQ ID NO: 481533 - DNA, 157 bp, Homo sapiens
gaactagtctcgagttttgttttttaaatacagagtcatgttgtttctgcactttatatagcaggaagacattatcttagtaggcaattgtaacacttttttgacagtaacccatttcagatttgacatactgcaataatggttgtctttaaaaaaa

SEQ ID NO: 481534 - DNA, 89 bp, Homo sapiens
  misc_feature (13)..(13): n is a, c, g, or t
  misc_feature (19)..(19): n is a, c, g, or t
cacgatgtaatantttaanaacggcaatttaaaacataggccgcttggaggtgtttgcgttttcggttagagataaagcaattttttca

SEQ ID NO: 481535 - DNA, 214 bp, Homo sapiens
  misc_feature (57)..(57): n is a, c, g, or t
  misc_feature (107)..(107): n is a, c, g, or t
atcctcccaccccagcctcccgagtagccgggaccacaggtgcttgccactgtgacnggctaattttttaattttaactttttggtaaagataagttgttgcccagntgagtcttgactccgggttcccagcaatcctcccaccttggtggcctcccaaagtgctaggattacaggcgtgagccaccgtgcccagccaacaccacaaaatatta

SEQ ID NO: 481536 - DNA, 210 bp, Homo sapiens
ttgggagaaaaaaaaaaagggttggggggaaattgggggtaactgggcctttaggtccgaaaggaatttttgggttcttggggcccttaggtggcccaagctggcccaaggttttgaaggcttttaggttggccggtatgccttctcccatactcctggggttttgggggggttacctttggttattaaacctggccggttttttcccca

SEQ ID NO: 481537 - DNA, 229 bp, Homo sapiens
cagctacctgggacctggaagccccctccccactttgagttgtccccgcctttttggacggaaccaacgtactttttacataaatcgattgatgtttcatgtttccttaaaatgtatgaaaacaaactgtgccctgacccccttgggcacatgttgccaggactccctgaggctgtgtcacgggcacgcattttcaaccttggcaaaataaagtttttgaattaactga

SEQ ID NO: 481538 - DNA, 736 bp, Homo sapiens
ggatttcttcgagacccagcgtcccgcttccataatctcgctttcccccccggcgtcaaagtatttagcgtgactcgccccactcccggaagccatatgaaatgattttcttcagatgctctgagcccttaggattcatctttcttttcaccgtaggtgggcctgactggccttgtaataccaactcattcactagacatcgtgctacacgacacgtgatctacgttgtagctcactttccacgatgtcctatccataggagctgtattgtgcccatcataggaggcttcattcactgatttcgccctgattctcaggctacaccctagagcccaacctacgcccaaatcccgtgtcactatcatattcatcggcgtaaatctacttttcttcccgacaacacatttctcggcctatccggttatgccccgacagttactcggagctaccccgatgcataccccacatggaacatcctatcatctgtaggcgtcacttcatttctctaacagccagtaatattaataattttcatgatttgagaagccttcgcttcgcaagccgaaaagtcctaatagtagaaggaccctccataacctggagtgactatatggatgccccccaccctaccacacattcgaaggacccgtatacattaatttagacaaaaaaggaaggaatcgaacccccccaagctggtttcaagccaaccccatggcctccatgactttttcta

SEQ ID NO: 481539 - DNA, 397 bp, Homo sapiens
agagcaggttcccgcagtggcctgtcctctacggctcaccacggcacaagccttcccagccgttccgcccgcgccccccatctcttcctgtctaacttggtgaacgatgcctgagctgtgaggacagggcccccacaggggatggtttcacgagtgtagtcccggaggccttccctttacagctctcctccagccctgggcacatagcataggctggggacacagcgatcctggcctgagaatagaggggaggtggccaagcccgcacaggtggggtgctggggctgcatgcattattgccctgcgtcccttctctttggggctcctttcccctctcatacatgatatcgctttcaaattaaatatcgctgtatgtctgtaaatccacaatacatat

SEQ ID NO: 481540 - DNA, 419 bp, Homo sapiens
gctataatagttttcacatgtgacatacctcctgtttttccaatctatctaagcaccctgtactaatccataatttctggctccatcaggagagatataagggatcagaatcatctggttctgacctcatcctgtatgtctttgtcagcacttcatttgtaaaatattcattgggttcaaagtgaaattctaagacaaaactcataggctggccagcatctgagaacttcactttaatatgtttcaagtgcttcagaataggttcatcgtgttcctgaaccatatcactgagcaagtcaacattcttaaaaacagttaaccaaaattcaggaattcctttggggtcttctttttcttcatcctttttctcatcttcaatcttggccttttctttcaattcctccgaaatctcatcttct

SEQ ID NO: 481541 - DNA, 1117 bp, Homo sapiens
  misc_feature (62)..(62): n is a, c, g, or t
  misc_feature (135)..(135): n is a, c, g, or t
  misc_feature (188)..(188): n is a, c, g, or t
agatctgcggctgtgatgacgtagagcgactggtacggtaagatggaattgcaagaacacgncagcacgagacagcaagacggacgaccggggcggatggtgttgatccatgcaacaaagagaagggtagttgtntgcaacctcgccgagcatatttcccgggagagaaagcggttgctgcccgctcnccctcggtggggacctcgcgtctctcctagtttgtgccacacgaagcgcgcttgggtgggtgtccaatataagcagctggagacttgacgctgagcgacgtgcaacgcaaagcgattaggcgaaagcggcgccaagcgcaccggtgtgcacggtgtgccgtccccaggaccgcgtatcgcgttgccgcagaacacggtttgtccggggaacccgagcgccaggccgcctgggtacgcgcagacccacagagagagttcccctagaaccaagggcccacgaagcaaggggtggggacaccagacaacagccgggggcgccagaacgccgtggctgacgagaccgctcgccgggcggctaaaggtgggacaatgtaacaactacggggggcgcgggccaagcattaacagggcgaagcagacccgttgttcggaggacacgccggactccacggcgggttggcgaacgcagagacaggagcgtccctctcaatagtggagaactcgcgcgtgtctcccgcgaccgcccttcggggtggttgaagctaaaacatgggggcctctaccaaagaggcgtgaaacccctgggaacacacagaagttgtttctgcgggaacagagatgatcggcgccctctgctctgcaggaaatagaggtacccaccagatgacacccgcatgtggcaaatatgcctgggcgcatggaccctctcggggcacagtcagagcatgtgtcttccccttccactgggcacaaacaaagttcaaagaaggcgctgttcactggaaacgggctaaacacaaagaaagagatgtgtgaatttaggcgtagcgaagcgagctcccgtgcattatgcgggcaaattttatccttgatcttttttcaataaaaaaactttgcgggggaaaactttaaatacacccccacataca

SEQ ID NO: 481542 - DNA, 645 bp, Homo sapiens
ctttcgctacgtgggtttgtggtgggggcggtcgaaagggtcgtgtcgcggcctggtgatcccgcccgagtgtcgggggggaacgccgtgtggcccccccttctcgcggggtttaacctccggccccgcggattttggtatacccgcgctccccaacttattggctggttatcttcttcccccaagttccttgatgtgctcgcggggcgccctcgagatactccttgtgcggagagggataaccggcgcgccacaaacatcttctgttggtaggcgcgtgtccctttgtttatcgggatggttttttccgcgatcgtggccgtgcccgaacaaatcatgccgcgggatttcgtcccctctttcccccggcgggagatattcatcctctggtcgaaccaccgcgggagaaccgccccgttggttctctattaccgatagactcccaagataaacaaaacaaccaacttaactcgggtgttggtggtcgcgggcccctcgtcaatatccccagtatctccccgcagaggtccacagctccgcgaaaccacgccgcgaaccatgtggaggcacgcagctcttcaccgcaatccacaatggcccccgccttcccccccgggcccaaaagaaactttttttccaacaaca

SEQ ID NO: 481543 - DNA, 277 bp, Homo sapiens
acacactttagatagagtctaggagctgctagctcccatgtaatggcgcctactccctacgtcacaaatattctcagtgatttggtttcacctacaggaagcggccacattaagtacccacgggagctttcaataaccaacctttacttcccacacaatgctagcccacaagtggactagagtggttactggacacctgaactcggccattctctgcctgtgattgtttctgggcttacgccaagctgagctatgtgccctctctgccctcctttct

SEQ ID NO: 481544 - DNA, 333 bp, Homo sapiens
  misc_feature (102)..(102): n is a, c, g, or t
  misc_feature (333)..(333): n is a, c, g, or t
agccgggtagatgaaggagttgctgaccatcgcggcattggcaccaggcacaaacaacatgctgcggcgggtgcgagttttacgttgttgcagcgaagcganaatcattggcaatcctcccatggcagagccgggataccgctggcgcgtgccagcagggcttccagtcgtgcacgtaaaatgcagtccagtgcgcctttgtcatcgacattcagctgtacgccgcgcacgttgtagcgggcgagaacgtccagaatggtggtgcgaattgcatcgccaaactgtttctcaacgctgctattgatttgcaggtcgatatcctgcgtatcttgn

SEQ ID NO: 481545 - DNA, 1046 bp, Homo sapiens
ctcaggcggagcggcccgtgcgctgtttttctgagtcggggtggcctggcagccgggcgaggacgagggtcggcgggggctgccccgtggtggtggccgcatgctgggagcctgggcggttgagggaaccgctgtggcgctcctgcgactgctgctggtgctgctgcccgcgggatccgggacccgggctcgggtggccgggtgccggctgcgtggggggcggtctgccgagagcgtcatttgggcggtcaacgcgggttggagaggcgcatgtggacgtgcaggggatccacttccgaaaggaccctttggaagcgccggtggtgggccgagcctcaagacttatggcatgaaattgccattcctgcgttccaaccctgagggaaccaagatcctgtatcaaaactgagcggtacaaatgagggagcacccttgggctacggaggtgcccatcacggcagggacgggggactaccgttgcgtgggttcttctgacaatttcgcaggagggtctactttttgcaccaggccccacgccacgcaggggtattttgaagtgtaccgatttgaagtgggccacgttgtggttgacaggcgccctgggcatactcttggactcgtgtgggacatgcagagctcaccgattgaatttatccttattgagcctccgcaaagggggcacgcctgacgttgtccaggggagggtgctccaccttcagagggcaacactctacatttgaggtttggcaaggggttctatgacaatcccaaggtcttgtgcaccctatcattgctgggacaggtgattattttcaaagtcaggctaatcgggaattgggacacagagcgaggagacaagcagagaattgctgaggccatctcaaaacacgccattagacggtgggcaggccgaaacaacctaatctggaaagagccttgtccacggtgcttgagttatcacctttgccccggctgaaaagcttccaagggggggtggaaaccatgtgttcttccgtgcacaaaaaaaagctctttgggaaaagcgt

SEQ ID NO: 481546 - DNA, 1420 bp, Homo sapiens
  misc_feature (402)..(402): n is a, c, g, or t
  misc_feature (492)..(492): n is a, c, g, or t
  misc_feature (551)..(551): n is a, c, g, or t
  misc_feature (611)..(611): n is a, c, g, or t
  misc_feature (652)..(652): n is a, c, g, or t
  misc_feature (758)..(758): n is a, c, g, or t
  misc_feature (1128)..(1128): n is a, c, g, or t
gtgtgtacgacattcaagtgggtcggtggattgtattgttctgtcgtgcagtagctgattgttagagtacaagattcctgtcatgagtacacgtgtgacatgatctgttaatcgtgtactttccaataggattacagagcattactcggatataacatttatggagaaaaggatttaatactaacttacgcgacagtacgttatcatgtacactctacgaattaaacatattctatggaaaataactatgcaaaaaggtctaattgtatccacattgtgttatggtcggtgaaaggacacaaaaattagtgtcctcagtaatgacttagtatggtagcaatgtatgcaataggtaatcatactagaactacgtagagttttttggggactaggagtagaccntataagggcatgggtatgataatagaggaagattgcatgatggttcagtgggatgtcctttagaacagataaccacaggaaaagtatagnacactcgttccttatatgggagttgtatgtggcttctagaaatcttgtcaggagacatngataggtgacgtgggctttcaatatgcaaggtagcctttgcgcaaatataggcaaccatnaataatgcattgttagcatagctgccagagtttagtcgtgntatagctcttacacaatagattcagattggtgagttgattttagaacaccagtgtaaataaggggtttggaatacgagggaatatatagggttggaaaggacaaantataatagtcaggtgccaattatccgtttttaattatgaagacttactaaatatcttaagactcctaaggaatatcttaggaggtggggcaagttccaaacaaattgatagagtgttaagagatggagattaaagcataactttaaaagttcatggtggagaaggtaactgaacgggaatgcaccgaatccatattttgaacaccattttggaaaaatttgacggtcataaaagtaagcatgggaggaagtaagtggaagcggtgtttggaaattagcaattgcgagggtctccaaattgccattggcttcttcgaaattacaatttatggagagcgccttctgagtttctataacattgctcatagttnggacgcagcaatggtacaagaagacaagaaggttcacaaatgcttaatagatcacttggtgtgatacttgggcgggtgaattggcataacgtttgtctaaggaaagcaaagactctttggaatgtgatcatctccaatcaatttgagagagttaattaccttcgagagtcgagcatttgaagacacgtaaagaggatagatccgaacaaaagttgtgacgatatggaaaacactcaccaaggtatcagtgggcgcaacgcgctctcagagatccatcacatgtatgagatta

SEQ ID NO: 481547 - DNA, 117 bp, Homo sapiens
gatgtccttattcgtgttgccagcatataggatgaactttatttttacattgtcgtacaattcattggtaaacttaaaacaatacaaatacatgatttgattgttgtcccagaaaag

SEQ ID NO: 481548 - DNA, 850 bp, Homo sapiens
gcccggcggcctcggcaagagccatgtgcggattcctcgtcccgcactgtccctgtcggtgaagtgacttggtccccgcggcgccgtggccctcgggccctctcgcacgtcatcgaactcgctgctcgcgagcgtccggtaggtccggagagaggcgcagtatgcttggtcaggcttgaagacctggtccacggtcatctccaagaatcctcggcgtcgctcactggacaaggcgaccgaccaatgcggttgggcaggggccagcacaggttgcgtgcgcccccgcgttaatcgactcggaagcaggcccactggtttgagaatgtcaacgcaggggagatcccagccgaccaggaggggcagaagagatgggcgtttgacattgtggcgcgaggttctcgcaagcgctacaaacaatctgcgagagatacaagccgatttttaggggccaaggtggggcgccaaggataaagacccttgctatattatcccaaaagtagactctgggtaggtaatttcatccccttcgagaaggagaaaagaacgatttgtcgaggacagattccaccctagactttgagtgatccagagcagaacaagcgcgcttacggggatcgggcgtcaattcaatgtggggaccctctcaaagcctcccaaaggtctcgccaattcccgtcctgaggcaacaaggcgatggcaataagctggggttgaacttaaaaccgggaatgtaactacctcgttccaggtgggagaaagcaggaggaataccctcagaattggggttggtgcctcgagggggcgcaaaagaaaccacctccgccatcgattcccgccaattcccggtcga

SEQ ID NO: 481549 - DNA, 232 bp, Homo sapiens
agtccgctcatgccagcacatcaggctaatttgtacaattatttgtagcagatgtggtcttcctatgtttcccaggctggtctcgaactcctggtctctagtatcttcccgccttggcttcccaaagtgctgtgattacagacgtgagctaccccactcagctttgtttccttcatgtagcccagagggcgacatctattagccccatttttacagatttagccgactgagt

SEQ ID NO: 481550 - DNA, 695 bp, Homo sapiens
  misc_feature (597)..(597): n is a, c, g, or t
cccagcgcagaagggtggcagcaactcctccaccctgcggtggcggctgccagcaaactcgatgcaatgggaagcgggtgagcgagatgcctgcatgccaagcggttgcggctggacacgggaccccagatgcctgtctgggaagtcgacatccccagccaccatcaggcaagacaacacctcaatcatgcggcgactgtgcagtgtgactgagtgatgccgtgcgccgctacctgacgcggaagccctagtgaccactaatggacctgctgaaaaatgttccagaccaagaagactagggctgatgcagcgagtcagacagtgaacgtgttgtgccacgagtcctcaagcgattctagaccgcgagcgcaagatgatcaaacagactaaaagtgcaacttcatcccatccaaggcagtgagggcttggatccacatacagttggctcttgcctcctcgcagaacttaacggctctcatcttgccccgttcggcgcatccttagagattgcagtgctctgtgcgctaattacgatgggctcttgctccttcctagagacttacaggtcgtctgcgagtgtagcacctttcgaaccantccttgactttgcttcccctggacgtccgcagtggtccccgttagtataggcaaattgctgggaagaacgtttaaagcccattcttcctgcctctggg

SEQ ID NO: 481551 - DNA, 723 bp, Homo sapiens
aaagtctgcaaccagaatctgcatgcaatgcaaatgcaggcaggcattcacttcggcacttcagaatggcattggctcatttgtggaacaagactgtgatgccttacattagcacaacaccagctaagctcaggaacccttgcacaagtgaacagaactgcaccagcccattatagctcacaaaaatgtgctcactcttactaataaaggagaagtcattcaatgcaacttgtcgggaacaaccagcgccatcatctggcaaatttggcattctcccagacaggtggttatcgatgcccatcatgcacagttgcagtttgtggatcactgattggctggaggaatgttacacggctgctggtgttttccaccagatgccgggtttcactttcgctggagcatgggcaaaacttggtgcgcatcgctattacccaaatgcatgcgccaaatgccgaccttggaacacatcaatcatgtacgacacatgcagccaattcatttatcgattaattcacttcctatttgctccactctctgttcccaagaaaactggaggtgaacacatcaaatatttcaagaaaaaataatataggcaagttcactggaagaactttcaaggtcctgcttacaaaaaggaagctggaacaacaacttgatccctaaagtaaggcataggcaacgattatctgcaccatactgcaaaagtaattccaatgatcaccg

SEQ ID NO: 481552 - DNA, 681 bp, Homo sapiens
  misc_feature (78)..(78): n is a, c, g, or t
  misc_feature (104)..(105): n is a, c, g, or t
  misc_feature (114)..(114): n is a, c, g, or t
  misc_feature (200)..(200): n is a, c, g, or t
tttggaaccgcggttgtttaaaagcctgagggaacctggaggggggctcccactctctaccttctttcctccgagttngtgactccgagatggacaaagtgtgnngctgttttnggaggctcccgaggcattggcagagctggtggcccatgttaagtggcccgagaaaggcataccgacgtggcggcacatgtgccagnaaaccgtggaagggcgccaaaggccgcgcgcgcggtgaccttcggcggagaactcattgggcatttagctgtgatgttgctaaagaacatgatgttcaaaatacttttgaagagatggagaaacatttaggtcgagtaaatttctgggtaaatgcagctggtattaccagggatggtctttagtaagaacaaaaccctgaagatatggtatctcagtcttcatactaacctctgtgggttccatgctgacctgtaaagctgccatgaggactatgattcaacaacagggagggtctatggtcaatgtaggaagcattgtgggcttaaaaggcaactctggccagtccgttatacaggtgccagtaaaggaggatagtgggatttccacgtgctctggctaaagaggtagcaagaaagaaaattagagtgaatgtagttgccccaggttagtgaaaactttattaaaataacttgattatga

SEQ ID NO: 481553 - DNA, 207 bp, Homo sapiens
  misc_feature (14)..(14): n is a, c, g, or t
  misc_feature (100)..(100): n is a, c, g, or t
atcatgaatttttnctccagaacgactggaggaataaattacaaaacctgagaggacccacaggccccctgaaggaagcagatggctcctgcaggacccnggagacacaccaaatactgtgttagtatttacttatagaaatgcaaaatggtctggaaagtctcagccatagaatcaaacaagtagaagaaagaaattcagagctcg

SEQ ID NO: 481554 - DNA, 152 bp, Homo sapiens
acctgacgagttggtggcatgggaaggatgtgggtctctagtgcctctgcccatgctcagcagcagcaacagcaacaacctcctggtggccttgccgcccccacaaccccgaggtataaagccaggtacacgaggcaggggacgcaccaagg

SEQ ID NO: 481555 - DNA, 298 bp, Homo sapiens
tgatgcgctggatagtcggaactcgcgcgcccacactcagactcctacaaccacgcaagttccttcttgacccctggtgcctcctaccctatggacctgactggtgcactggtttcacttgtgtcggtgtcggcccctcaccaatgcagccacgtcatgtcattagtcatctggcacacagactaacaacagcagagacttgcgggttctacccagtcagaagatcacaccatggagactaactactagaggacttgaaagagcactgaggggacacaaaataaacttcaccttccat

SEQ ID NO: 481556 - DNA, 122 bp, Homo sapiens
tgtggtacctctcctgtgtgatgcgcgatggtgttcctgacctgtgctgacgcgctgactggaatcggcctacgcgctgggctccaccaatgtgggaatgtgatgctgggacatctgtcctg

SEQ ID NO: 481557 - DNA, 117 bp, Homo sapiens
tcagctggtccccggtcctaagctggactcctcctacacaaatttatttgagcgttattttgggttttccccacgcccctcaatctgtcgggctagtcggggacgtgtcgggctagg

SEQ ID NO: 481558 - DNA, 226 bp, Homo sapiens
  misc_feature (113)..(113): n is a, c, g, or t
gcacatgaaagtagtccagatgaaccacaacgaagatgggtgggatacatctaaatgctgtgctcagagaggaatagcggcgccaggtgaacacccagcatttcacaccgaanggatctcagcacaggagtccgagcttccacctcaggaaaccagaaaaaggagcgaagtcaacccccagacccaaggctccattcctgggaagggcccagcaaggctgcaaaca

SEQ ID NO: 481559 - DNA, 899 bp, Homo sapiens
  misc_feature (23)..(23): n is a, c, g, or t
  misc_feature (91)..(91): n is a, c, g, or t
  misc_feature (98)..(98): n is a, c, g, or t
  misc_feature (110)..(110): n is a, c, g, or t
  misc_feature (122)..(124): n is a, c, g, or t
  misc_feature (126)..(126): n is a, c, g, or t
  misc_feature (222)..(222): n is a, c, g, or t
  misc_feature (243)..(243): n is a, c, g, or t
  misc_feature (307)..(307): n is a, c, g, or t
  misc_feature (363)..(363): n is a, c, g, or t
  misc_feature (379)..(379): n is a, c, g, or t
  misc_feature (387)..(387): n is a, c, g, or t
  misc_feature (409)..(409): n is a, c, g, or t
  misc_feature (423)..(423): n is a, c, g, or t
  misc_feature (479)..(479): n is a, c, g, or t
  misc_feature (491)..(491): n is a, c, g, or t
  misc_feature (526)..(527): n is a, c, g, or t
  misc_feature (546)..(546): n is a, c, g, or t
  misc_feature (563)..(563): n is a, c, g, or t
  misc_feature (781)..(781): n is a, c, g, or t
  misc_feature (795)..(795): n is a, c, g, or t
  misc_feature (807)..(807): n is a, c, g, or t
  misc_feature (824)..(824): n is a, c, g, or t
  misc_feature (834)..(834): n is a, c, g, or t
  misc_feature (899)..(899): n is a, c, g, or t
aggggtgtatttggggtaatgtnggggacataggaaagatgacatggccagggcacaattcttctgtcgtggggaagagggatgaaaaganaagaatnggtgttggagcnggggtggaagannngnggggggcactggctgcattcccccgcccccaggaagcacctctaggccctggacccctcgctcaccctggcccctaagactccatctcttctctgnctctggccctcctggctcttnctcctgctccccttgactttttcccctgacagattctcaagtaggacgatgttcagggcctgancccaaccccccataccaccttatgaaggtacaacctttgccggccctgcttctgcncctcctcaaacctcancgcttttnctctttgggacagctctgatcnccctccttcctctnctccctccccctggtaaaaaaaaggaaaagaaagcaccaattccctggggaggggntgcagacagctnggggagaggactggaaggagagaagaggaccgttnngggaagaggctcacaagtncctgggaagacagggcntgggcttacagagaggtgagggggtacgggcagtggctgctcgtgtcctctgccacccctgcccactgtccaggggacttcaacacaaccgaggggacaggtttgtgtggggtcaggtctgatagaagaggagcaggagaaacaaatcgttaaaacctagcgaattcccctaagaaaacatttcttcctcctttccttctggaggctccttggttggnaggaaataggagtnggtgggaaaganggggggagaggagcttntaccaagggntctactccattctccctctccccgcaacaacttgggctcacagggttggaaggagtgctgaactn

SEQ ID NO: 481560 - DNA, 1850 bp, Homo sapiens
tctccctgtctgctggaaaaaatggcttcccgcaaggaaggtcaccggcttcttacgtgccaccttcttctccagcttccaccgcccggcgccagcgagggaaagaggcaaaggacaaaggcggctctcgggagaatttccgccggtaaagcaagttgcaatatagagtggccgtggtggtacttaaagaatacactcaaactatcatcaagcaaaacaaggaacagaggaacacgtgacaagtgtgtgtcacagacggagaggtgcttataggggctcgtggatgtgctcgaacagaccatcggatgtgagaacaactccacaccaaaagtgaaattatccatatatcgccctctgcagagacaaaacacaagaaagaagaaacgaaagtcgacatagcacttatgagtactagacgacgatcacaaatatatctcaagaagttgagacacaattgaacctgcgagggagcgccatatctcgccccacgtgttcacaacatgtggaggatcacaacttctctataaaacaggtagagagacaggagaggaatatcaccagaggaacacaccacaacaaataacccatccatgtgaggactctaccaatctatgagagaataataaacccccgcggaggggtacacctccttctgcgtgggaaacatatcccatacaagagatgaatacagactactaacccacaaagagcaatgttgacgcaacatgtggaggacaggagacacactctgtggaatccgagatatcatctacaagatcttcgaagatagaactccccacgattattgaaaagcaaatgttgaggcgacacgaaagagagaaaactccttatcattacttgaacaaaaataaaaaagaggggacatacttaccaacagaacacgatagaaatcttccacattaaaaaaaccattggaaatgtgagcaacatgtcattctgtggaacacagagagaaacacaccgcgacgagcattcttcaccgccccccacgtgaaacaataagcacaagttttcggacaaaacacaaacaggcaccacaacattttattcacaccctcttatgtgagacactcaaaccaactcggcttcgaaagaaaacacaaaaagcgattccaccaataatatgaggaaccaactaaccaacagagcagacaagccaccacagtaacgagacaacaaccagagagggtcccacaaatgattgtagggggaagccaaccagacacaacgacaacgacgagacagccccaacgagcgtagagagcacgcgaaacttaaccaacgtactagcaaacgtaccccaacccaaaccagtcgcaacacagacccgaacacacactaatctgtggagagcacaaaaacacacctcaacaaagagtagagctggagagggacacaagaaggcgagcacaactcaataggccagaccagaaagacatgcatacactaatacacagccaacacacgagaagaggaagcgaaatcaagagagagacaacaaaggacgcacggagagcagcctagtagttgcagtcagctcatacagagacgtgagaacatacgtgagagagctagcagacgatagaccgcgcacccacgagcgacagacgcgaaatacagttcgaacacgaggcaggcgcgacgacagcatcgcattcagcagggacaataccacctacagacagacatgcatacaaccaatgagataatggcgactgacctaacctagcgaaaagacagcaagagcctcagcatgaacttagtcatgccacggcgccactcaacacaatccgactcagagcagcgcgaacagcagcagagagcggacg

SEQ ID NO: 481561 - DNA, 904 bp, Homo sapiens
  misc_feature (44)..(44): n is a, c, g, or t
  misc_feature (84)..(84): n is a, c, g, or t
  misc_feature (86)..(86): n is a, c, g, or t
  misc_feature (270)..(270): n is a, c, g, or t
  misc_feature (277)..(278): n is a, c, g, or t
  misc_feature (287)..(287): n is a, c, g, or t
ggcacgagggagtgtggcactttggcggggaaggggcggctcanccctcgggccctcgcccgccctctccgggtctggagcgtntnctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagangaggaanngccccaaancaagccgcgcccgtggtgcgctcgctagggatgcccgccgaaaggatcccagaaggggagcgcgtggacttcgatgacatccaccgaaagcgcatggagaagacgacctgctggagctgcagaacactcatcgatggtacatttcgagcagccggcaagacagcgcggaagaggagcctggtaagccatgaaggagcgcacctgagccggccgccggtcagacgagcgccgagcaacacagcgctcccggaactgcagaagcgaacgcgaagcgtcaagcataagactgcgcggacacacgacggaatcatactagccctcggcgcaaccccgcagtaccctgggcaactaccaggcatgcgcacagatgacggacacgcacaagccacgcaggccacagaagacgagccaaaggatggacggccaacccagaacagaaccgggcgcatgatccccaaccacgggaggccacaaaacgaggaacgagcaaacactagggaccaacggacaggaacccgagcgccgaaggacacaggcgggacgaaccgggggcgagggcacacaaaaagcaggcacaatccgcctccgggacgctaacaacggccccaggacccagg

SEQ ID NO: 481562 - DNA, 88 bp, Homo sapiens
tgacaggcttacacaaaatgcagctaagtcaaagttgcggaaccgcacggctcttaagaacacagggtttcccctgaaattcctctcg

SEQ ID NO: 481563 - DNA, 498 bp, Homo sapiens
  misc_feature (44)..(44): n is a, c, g, or t
  misc_feature (254)..(254): n is a, c, g, or t
actgagtatcttggtagctgacagcctcttcctccctgcttgcncaagtcctgggtaaaaacctcagacctcacagattgttgaaacaattaaataacagtacatattaaagcactctataaatggtaaagtactgtacagatgttaatttaatatccactgatatttcttctgtgtccattttgaaagccacttgctgcttccattgccagtaggttcacttaaatttaaaaaaaggaccaacctcattaccncacccggttacatttaaagtgaatattcctgagagtttggagacccaagtatagttttattatctttctacatagaaaacctgcttttaaaaaatgatatctagatattatttgtaaaatgtataagattattttatgtttaagctaattatattattaaggtaatatagcccagatgtgaagaatgtaatagtagatgtaaatatacactagagtgcttactctgaataaagaataaactttt

SEQ ID NO: 481564 - DNA, 889 bp, Homo sapiens
gggacgctagtaaccatgggcttgctgacttagccaaagaagagttaagaagaaaatacacacaagtatacagactagttcctagtttcttagacttatctgcatattggcataaaatcaaatgcacattgtgctcttcatttaggatgctttcattgtctttaagatgtagttaggaatgtcaacagagcaaggagacaaaaaggcagtcctggaatcacattcttagcacacctacacctcttgaaacatagaacaacttgcagaattgagagtgattcctttcctaaaagtgtcacagacaagcatcagcagataagttccgtatttcagacatgggatcacgaggacaacgagcacaggcacagtgatttttttccacaagatctgtaatgttcatttccacttatcaacggcacatcacacacaatgaaaaacattatctggatatcaaaagcaaataaaaacccaattcagtctcttctaagcaaaattgctacagagcagatgaaccacattcataaagtaatctttggctgtaaggcattttcatctttccttcggagtaggcaaacctattttacacaggtaaaacactgctggtgaaccaggggatgtcgcatcggtgattacgggaggcatatacgaattgaaagactgcactattaccttatgttgacacaaattagaagttttgggaccacatcgccctggctgcaccagggcggtcctcactttggaccgtagtggttctttcaaacaggttattccacagaattcctacaggtattacaccctcacgacaaggattatagtattcaagattctgacatcgaggagttcccataggtccagaattgggtcaattctaatccctaaggcactatcc

SEQ ID NO: 481565 - DNA, 131 bp, Homo sapiens
  misc_feature (67)..(67): n is a, c, g, or t
cgatctttttacgcggctcgatctgactacgcgggtcgatctgactacacggttcgatctgactacnctggtcgatctgactacggcgggtccatctgactacgcggctcgagcggactacgcagggcgac

SEQ ID NO: 481566 - DNA, 403 bp, Homo sapiens
  misc_feature (51)..(51): n is a, c, g, or t
  misc_feature (65)..(65): n is a, c, g, or t
atctgttattatttcaatgtttattgaggacccataatgtgctacacactngttttgatcccaanataaacagtctgcaaaaagcaatatggctgtggttgcttcagatttccaggtcatggggaccagttgcaagggaagcatgagtgaccggataaatattaatgagcatcatgtggatgagcatagggaacctataattaaggtaatataatttaaactatatttaggaggaggatgctgtctgaggtgttgattataacccaggaaggagatccgtaggtcatagtaaccaagtcagaccatgctggggaccatctgcaggtgtgttggaaacaaagtatattttcatgctattgaatgtatattgggtgaaccaatgaataaacgaacaattttagca

SEQ ID NO: 481567 - DNA, 390 bp, Homo sapiens
  misc_feature (110)..(110): n is a, c, g, or t
  misc_feature (199)..(199): n is a, c, g, or t
  misc_feature (204)..(204): n is a, c, g, or t
  misc_feature (241)..(241): n is a, c, g, or t
  misc_feature (303)..(304): n is a, c, g, or t
  misc_feature (310)..(310): n is a, c, g, or t
gcaggaagcgtcagcccccgagcgcctctggttccccgtcttctagtgcctctgttgcccccgcctctatgtgctctggtcgcggctcttctgatgcgggtaggcttttnttctgcctggcgtcccctccctctgtcttcggctcccgggggaggagagagccggctgttccctgccggagtgggccggggctgctggnccccnggctctgtccctctgctctcggggccccctgtcctgnctctctcctggtggtgggccctctgtgctcttctcttcctgtcggctctctctcctcgctgnncctggntgggctttgggtttgccgggggtctcctgccccgccggctgcgcttgctgcctctggtttgccgccgtgttgcaggcgcc

SEQ ID NO: 481568 - DNA, 175 bp, Homo sapiens
tagagtattcccgacaggaagccaaagtgaactaagaagattcgttgaacataagagtacttctttatcccgagagataagtttctaagaaactctctaaagaggttaagaacatatgagaatcacacagtgggaatcagtttggcgcagtggctcatgcctgctcatttcagcc

SEQ ID NO: 481569 - DNA, 252 bp, Homo sapiens
cacgcctccctccttcctggcctcccgggagctgcgccctttctcactggttctctcttctgccgtatccgtaggactctcttctctgacctgagtctcctttggaacctctgcggttctattctcgctttgttcccaggagtagctcttgttctggatgttcgtctctcgttactagcgtgtcttgcgacggctgttgttggacattggagcgtgtagcgggtctcgctcgtagcagtcgtaccgtgcatg

SEQ ID NO: 481570 - DNA, 122 bp, Homo sapiens
ccgtatcaaaccctacagcccaaatgccatccctagttttgcacctagaagtttagccattaattgtgttcatagatttagggtttagggtttcgatgagggtttcgatgaagggtttcgat

SEQ ID NO: 481571 - DNA, 1044 bp, Homo sapiens
gtgtaccctggacctgtcctgtctcctcgtgctttgagatattgtatgtcttccttggtacaaatttgggtgtcaaccctttcatgttcttggccgctatgccaggtgcaatggctcaactttttcacccgaagctaaagggtagaacttcattacggccttaccatggtctaaaggtgggcttttgctttgttgatccctgaaaacggtagcctggggtctggttctgggctctctagctttgccttcccgcctcctcgggatgtcccgtcgcatggcccctgtcgattcgatgccggcaccagagtcctggggcagccataggcaagctcatgcaggggctctgtatcactggtcaccaagcatgatagcagcagcaaggacacgtgatctccatactggtcactgccaaggtgccaacccttcatgcccaccatgttttcactgggaccatggtagggctgacctccgttctctgggggaacgtggctagagcttgatggtaacacagtctacacccgcatggtgctctttccatggtggatacctgctcatcttgctgatgcaaaactaggaagtataggctgcatctacggagatggcatttacgctggagagtgtgctttcgctgtctcctcagacctcagtgcacatgtgttccctccgccgcctcgtcttatcgtccatggactgtctttgcagctactccgcagtgtactttgagggtactgagcgtggaattcactctctgtggtattgctcattctgcgttctacactcatatgtaattaagaacggagttccacaaaggagagagatggcattccctgcatgtctgctgtgtccagaccagagtttctctgaggggaccgtgaccctaaccctgccagctcagcccatgtacacctgaccctgtaaatgagtggggtttgctgactgtaattcgctgacaccagtataaaccaaaagaactcttgggggctcagtgtgagagccagggttacctactctgccaagtgaaaacaaagtggctaggcatgatca

SEQ ID NO: 481572 - DNA, 212 bp, Homo sapiens
atcaatatcaggataatctgaccaccacaggtagacagattatagaaactagagcagaacatcacgttgagagtctgtggaagagctatccatagcagaaatggctggtacttcctcttaattccccccacccccttaatcagactttaaaagtgcttaaccccttcaacttgttattttttactttaagcatttagagctggtccgaacgg

SEQ ID NO: 481573 - DNA, 242 bp, Homo sapiens
cctctctccctcctcctcttcctcctattcttcctccttcttcccctccttttccatcccccaacttgccccatgtcccactcctcctcttctttaaaacaaggccctacctttatagcccagatgggccttgaactcactgtgtaactcaggatttctgtgaagcccaggttgctctggaatttgcaacccccagggctcagcctagagtgacttttcttttatggaagtccagtcgacgc

SEQ ID NO: 481574 - DNA, 364 bp, Homo sapiens
  misc_feature (105)..(105): n is a, c, g, or t
  misc_feature (128)..(128): n is a, c, g, or t
  misc_feature (132)..(132): n is a, c, g, or t
  misc_feature (138)..(138): n is a, c, g, or t
  misc_feature (142)..(142): n is a, c, g, or t
gtgttcagagtgcatgtccccttgtctaatccttgtctagttttccctttattcagttactgcttctaaagctggctatgtgtgcttaggccattccagactggnagccatgttgtctgcggaacggnggcntcattntttnatctttcgggggtttttgaatgcttctgcctggcaacatctgtgtcacgattcctgctagctctggttggctcctgactttggcttttttttattttttttttttaattgcagaagaaggtagtgtaaatgaggaaataaagaggggggtgacaagagttggcactctaccagaaccaggggacaggcgttcaagatgcataaagaggaagaaaagcagatg

SEQ ID NO: 481575 - DNA, 1278 bp, Homo sapiens
  misc_feature (25)..(25): n is a, c, g, or t
  misc_feature (36)..(36): n is a, c, g, or t
  misc_feature (53)..(53): n is a, c, g, or t
  misc_feature (73)..(73): n is a, c, g, or t
  misc_feature (100)..(100): n is a, c, g, or t
  misc_feature (112)..(112): n is a, c, g, or t
  misc_feature (120)..(120): n is a, c, g, or t
  misc_feature (125)..(125): n is a, c, g, or t
  misc_feature (181)..(181): n is a, c, g, or t
gacctcgcaagtggttccctcattngagtgctccgngcgcacagacccgcgcnccgcgcgtccgcgagcctcnccgagagccgtcccttcgtccggcccntggagcattgcngtttgtcngccgngtgtcgcagtgcgaggatggcgccgcggggtgtagctggtctctctgcgcaggccngagtgggcccagaagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtacgggtcctgcctcagttggcggaatggcggccacgggagccaatgcagagaaagctgaaagtcacaaaggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtcca

SEQ ID NO: 481576 - DNA, 461 bp, Homo sapiens
gcacgagccgagatcataacatatgagcaccgtttatatacccctaactttgaaagcggttctaaaagttcaatttttcaaaaaatagctgcatgatattaacgttacaagccaaggcaacttttttgccttctcggcattcgctcgaaacatcttgcagaagtgaaagagtagcaaaaattggaccctcaaccccctctataaggtattacctttttcctctttccttttgcagcggaaaatttcggagttttcaaagaacaactccggaataaggataaacttgtgattggctttgcagtagatgactgacaactcccgcaagaaaactgacccgtttttgattttgagtttgcttcttcttgtagttaaagtaaataatctgcaaagtgcggacatatgtgctgaaccactaaaattaaaaaaagaaggttagtattttgttatgcagttctcactat

SEQ ID NO: 481577 - DNA, 491 bp, Homo sapiens
ggaggagctgggaatgtcgaatacgagttggaaacagaattgttatcacagaataattagtgtaagagaaggttgatagtggaagtagggtagatccttaatgcaatatatgcccttttaagaggaggagaagggacgcagagatagagagggagaacacgcatgatgacaggagcggatagtggaggaatgtgcctataagccagacaaaactaaggattgctgctgaaaacggaaactaaaagaaaggtatgcctgttccagatactgttctctgacatctacactgggtgtcctaaaattcaagtcaatgctgacactaattacctagacttaatacagacccaacaaggaaagaatatttcacaaaactgccccatttcagacgtatatacagctggcctttgaacaacacaggctggaactgtgcaggtccacttatacacagactttttccaataaaagttacaccaaatatgcctgcctgtcct

SEQ ID NO: 481578 - DNA, 1428 bp, Homo sapiens
  misc_feature (25)..(25): n is a, c, g, or t
  misc_feature (36)..(36): n is a, c, g, or t
  misc_feature (53)..(53): n is a, c, g, or t
  misc_feature (73)..(73): n is a, c, g, or t
  misc_feature (100)..(100): n is a, c, g, or t
  misc_feature (112)..(112): n is a, c, g, or t
  misc_feature (120)..(120): n is a, c, g, or t
  misc_feature (125)..(125): n is a, c, g, or t
  misc_feature (181)..(181): n is a, c, g, or t
  misc_feature (1151)..(1154): n is a, c, g, or t
gacctcgcaagtggttccctcattngagtgctccgngcgcacagacccgcgcnccgcgcgtccgcgagcctcnccgagagccgtcccttcgtccggcccntggagcattgcngtttgtcngccgngtgtcgcagtgcgaggatggcgccgcggggtgtagctggtctctctgcgcaggccngagtgggcccagaagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagcaggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatccannnntgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcaggactttaaaattctaatggtagtcagatttcatgtcactaaacagaaatctgacataggacaagcaaccat

SEQ ID NO: 481579 - DNA, 1405 bp, Homo sapiens
  misc_feature (25)..(25): n is a, c, g, or t
  misc_feature (36)..(36): n is a, c, g, or t
  misc_feature (53)..(53): n is a, c, g, or t
  misc_feature (73)..(73): n is a, c, g, or t
  misc_feature (100)..(100): n is a, c, g, or t
  misc_feature (112)..(112): n is a, c, g, or t
  misc_feature (120)..(120): n is a, c, g, or t
  misc_feature (125)..(125): n is a, c, g, or t
  misc_feature (181)..(181): n is a, c, g, or t
  misc_feature (1331)..(1331): n is a, c, g, or t
  misc_feature (1370)..(1370): n is a, c, g, or t
gacctcgcaagtggttccctcattngagtgctccgngcgcacagacccgcgcnccgcgcgtccgcgagcctcnccgagagccgtcccttcgtccggcccntggagcattgcngtttgtcngccgngtgtcgcagtgcgaggatggcgccgcggggtgtagctggtctctctgcgcaggccngagtgggcccagaagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgcctgaantcacattactataaaccaaaacggccgcgtgggggcttntgaagttaagcacgttggcccaccttaaacgcatt

SEQ ID NO: 481580 - DNA, 751 bp, Homo sapiens
  misc_feature (25)..(25): n is a, c, g, or t
  misc_feature (36)..(36): n is a, c, g, or t
  misc_feature (53)..(53): n is a, c, g, or t
  misc_feature (73)..(73): n is a, c, g, or t
  misc_feature (100)..(100): n is a, c, g, or t
  misc_feature (112)..(112): n is a, c, g, or t
  misc_feature (120)..(120): n is a, c, g, or t
  misc_feature (125)..(125): n is a, c, g, or t
  misc_feature (181)..(181): n is a, c, g, or t
gacctcgcaagtggttccctcattngagtgctccgngcgcacagacccgcgcnccgcgcgtccgcgagcctcnccgagagccgtcccttcgtccggcccntggagcattgcngtttgtcngccgngtgtcgcagtgcgaggatggcgccgcggggtgtagctggtctctctgcgcaggccngagtgggcccagaagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtacgggtcctgcctcagttggcggaatggcggccacgggagccaatgcagagaaagctgaaagtcacaatgatgccccgggaataattcccccgaccatt

SEQ ID NO: 481581 - DNA, 139 bp, Homo sapiens
ggcgagcgccgggaggaggcggccggatcgagcgggcgcccgcgcgtgtggcgtgatgggaagccgcttgccccggcagattcgccttgcgttctgtcgcgctgcgcgatggaaagtcgaaagagggaggagaacgatg

SEQ ID NO: 481582 - DNA, 242 bp, Homo sapiens
  misc_feature (25)..(25): n is a, c, g, or t
  misc_feature (207)..(207): n is a, c, g, or t
  misc_feature (228)..(228): n is a, c, g, or t
tcctgctctgtcacccaggctgatngtataatggagtcaccacagctcactgcaaccttgacttcccaggctcaagctatcctcccacctcagcaccacttgagaggtggttaatttcccatagagacggggtctttatgttgcccaagctggtctccaactctccaattcctgggctcaaatgatcctcccaccttggcctcccanagtggtggggattacagggcngagcaaccacaccc

SEQ ID NO: 481583 - DNA, 331 bp, Homo sapiens
tgtgggtagcatcaatcaggaagggtccccagcgttggggagagccccaacgttgagaacaagtaagtgaacaattagttgtactgaaccacttgttacgaaacagctagatcacaaacaacctgtgtgtacaattacttccttacaaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 481584 - DNA, 885 bp, Homo sapiens
  misc_feature (1)..(1): n is a, c, g, or t
  misc_feature (147)..(147): n is a, c, g, or t
  misc_feature (580)..(580): n is a, c, g, or t
ncttgtttttctgtgcgttttgtggtttttgtttgttgtgtttgtgtttttgtttttggtttttgtttttgttgtggttttgttgtgtttgccccccgccccgctgtgtgagggcacgcggtcaccgagtgtgaatcacgatccccnctttaatgggtgctcgaaggaacacccactcacgcatttttagggggcacccctgagtaaggacctccgaagggatccccaccaaagttggggcacccaaaaaatccgagccttgttaagaacgcccgcgccccgctgaacttattaacgcgttcctcaaagagttatacgcaagcccttgggtggcgcattccgcccccaaggagaaaggtggtgaaacccgcgccttcgcgaagggccccccctccaaagggcacttccttgggctaacaccttgaggcaccccgcgtgggttctccctctctcgaacttttccaacacgcgaacacacccaccttcctcccaccctttgaaccctggggctggcacattgccctcacacgaccacctttgtcaaagctcacatttcctggtatatgagcacaccgaaatnttggctacacccacacacacagggtggtggaccctcacatggcccacacacatggcctcccaagagagttaaggacccctggacaccacccagcccccagccagagccaccagaaggaagaagaagagaaccctccacatgctggggagatccctgcccaccacatccagtctcccccacccaccacatgaatttctccctcctcaccgttgccctgtagaccccttgtaagaaggggaggggcctagggaaccccccccttgtcatgtacccatccaattaagtacccctgtgctccacccaca

SEQ ID NO: 481585 - DNA, 85 bp, Homo sapiens
gcggccggaccttgtcttcgaggaagaggacctcccctatgaggaggaaatcatgcggaaccaattctctgtcaaatgctggctt

SEQ ID NO: 481586 - DNA, 608 bp, Homo sapiens
gaaatttacttgcagcatatgtaagctaatgtatatactgtggtggacgatgaatacagctgcagatatcttcaacacagtatatgaagtattataatgactatggagatatcatcaaagaaacaatgaggtaaaacaaggcagatagacaacaatgcagtgtgctaagacccttatactcagtctgcaacagcttcctgtacatgaacatgatacacgacacaatggcctatcacatatttagatagatcatcctctacaataatagtggccataaacagaactatgactacgacgaaagaagaataaaaacaaaataggacatagactcacgaaagaaaaacgaagagaacgcccataggcacaatgcgtacacaaacagaataggccatcagcacacacaagccatatcacaaacaagaacgccctaaacatcccagacaccaggggagagaagcacaaatcgcaaccatatacaacaaaacacgagacacataacgccttcgcaatcacacacatggaacggtggaacataacaccaaaagtacaaaacataagactaacagaaccaaaagaacaaaacagaaaaccaggaacgaaacatggca

SEQ ID NO: 481587 - DNA, 210 bp, Homo sapiens
atggcagctcatttgaacacgagatgaaactaccttctgaattattattccagaccctcatcaggtagctcgtgtcatcgaactgttaagatatattgtttactaacttggttgtcacaattgtatcctagagaacactagcatctgcagaaactataattttggtacacaatgtatctctgcgcgagtccgctgcattgggttccggag

SEQ ID NO: 481588 - DNA, 214 bp, Homo sapiens
tctttcttcccaacttttattttaggttcagggagtacatatgcacatgtgcaggttttatacgggtaaactctgtgtcatgggggcttggtatacaatttatgttgtcaccccggtaataagcataatacctaataggtaacttttcgatcctcacccccctcccacccttcaccctcaagttaagccctggcttatggtcgacgcggccgcg

SEQ ID NO: 481589 - DNA, 329 bp, Homo sapiens
aaagccaaagctagctttggcccccaggtgggggaggtcaccctgctccccccccccccccaagttttaaggttttttcaaagggtggaggtgtggaaggagggggtgctctcccaactaagcccaaggcgggggcaaaggtggttttttggttcccttggaaaaaggttttggtgccctgatttatgaactttataaaagaggaaaaagggtttggcccttttttacaggaaggggactttttggaacaaagcgaaggaaattaaactttttataaaagttaaccttttggataaaaaacgattttttaacccttggggatatgatga

SEQ ID NO: 481590 - DNA, 164 bp, Homo sapiens
ttgaccggtaggacgaagtatgaacaattatacgcgtagcatacgtatagcgaggacttaaccctattccttctgcatatgaatttactaaaaattactttgcaaggagagccaagcgctaaagacctcccggaaaacagacgagctaccttatgaacagctaa

SEQ ID NO: 481591 - DNA, 301 bp, Homo sapiens
  misc_feature (3)..(3): n is a, c, g, or t
tantctgcgtcactcagctgacagctatcggagcagttcttcggatctcactgcagagcatgctgagcttcgttctgtgtcaagacgcatgctccttccgagggcgagtcttgggagcccactatgaaaatctccataaagagagaaaaatccagatgaagattcatcattttaattgatggattaacatgaagcagaatttcacaaaccggattatggcgatacaattgtatcgtttctgagtaaaatgtcgggaagtttcttcttggctcaactaattgtaacagttaggtctacctgg

SEQ ID NO: 481592 - DNA, 673 bp, Homo sapiens
ccgggtctcgaccgatattatggaattgtagtctatacgcgattcatagtatttaagaataattgacggctgttcacattgcaggcgctgagctggtccgcatttaacgcccctgatgttcatttatctgagctgttcttacaaattcagcattataccgacggggaatggcagattgtgaccagccggaggatgaacagctgataccgagacagctgatgagctacacatgcgaagattctagctaatgctagaggacgtaggtcaccagacgacgccttccgttgctgatggcagtgcaatacgggattatgtggtacccaccatgtgtatacaggatacatctgtcgactccgtaccttgccgccaagggacttgtatgtccctaacggctggaaacaccaattattgaagacaccctaatggagactcagaggagagcgatattgcataaatgcaggctcagagaagtttaagcactgcatacttagtctccatcagcagagaggctgtttaacaggctgcatttgtaatcaccgacagctgtaccagagcagcacatattaagtgactaacgattgttctgaaccagcacatagtccatgactctagagttcaacagtgatccatgagtactgcggactgcgcgacgcactgtgtaagcatgtggcac

SEQ ID NO: 481593 - DNA, 474 bp, Homo sapiens
  misc_feature (7)..(7): n is a, c, g, or t
  misc_feature (49)..(49): n is a, c, g, or t
ggaaganaatgtggtacatatatactatggaatactatgcagccataanaaagaataaaatcatgtgctttgactgggattacaggtgtaaaccaccgtgcccagccttaatctaggttttgaggccatgtctttttctttctatttctcttctttccttgtaatccgtagtcagttttacttaggaaaggtgggagggtggaaaaggaagaagagaaatttgaaaccgtgtgttcaatgggtaaactttgtaagagtccttttcaggaagatcgggagcatgtaatttaaacatgaaatgaaagcagaaaacatgcacctgacattgttacattagtgttgcaacattctcgtcatcttgcactgaaaaatggaaggaaaaatgcaccaagcaaagtgtattcagtcccctgatgtgaagcaaattatcaactccactgcacttcagcctgggcgacagtgagactccatgtc

SEQ ID NO: 481594 - DNA, 343 bp, Homo sapiens
taataaaccaagaaatttctttaatcattttttataaatggggttagtccatgaaaaatgttttccctccaaacagaatattttattttattgggtcacataaccctttcctaaaaaaaaaacactgtttttccccagttccaagaaactaaaaccttcctaaaacccctttatcgcctttcctaaaggctttaaatccccatcctaaagggaatttgctgtttttccgatgaaatccataaaacgttcttcagggcaaaaaaaaacccgtacccaacattggaaagatggcccccccaaaaaaaaaaaagaccagttctaaaattttgcagaaccttttcaa

SEQ ID NO: 481595 - DNA, 331 bp, Homo sapiens
atctctttcatccctaatcacccaatttgtataaaactcttccttaattcagaacaagtcaataatagcccagttctacacagtctatagaatacttacaaaccccggaagaaatatttgaagttaaggagtttccttaaaaaaaaaatgagaaaagagtaacaaaaggctgttgtttaataaccttatagttcaaattttacatttacaaaaagtaatatgtaaactctcctagtcagaaaacctactgggacctaacttacacttggtcttagccgaaaggatggacctaacacataaatattaccctttaaaagtgttttgggtgctg

SEQ ID NO: 481596 - DNA, 461 bp, Homo sapiens
cagagagactagtcgggagactactgcagtaatacaggtaaaagatgatggtgtccatttccaggtagtagcagtggacacggtgaaaagtgattggatttgggatctaatagagccaataaaatctcctagttggatttagatgggaaacaagagaggaggaaacttgactccaaggttttgggcctcccaagcaactagaagtatggagatgccttgagatgagcagactgtaggagtcatagttttgagtgcggaagatcaggatgtcggttttgggtgtgttaatgttccgatgcctatttgacatgggtctttcgaatacagcagatggatatgctaacttggagtttgcgtaacaaggctgggcctgagatccccatttaggtcggcgtatggtgtttccactgagtgagacaggattttaatgcgatgagactgggttagtgagtgtaactaga

SEQ ID NO: 481597 - DNA, 114 bp, Homo sapiens
cacgctgggaagctgccaggatggaagaaccagccaggccatgcctgcccatagctcagtggacccggacctcaggttgcccttgtctgcgaaagttgcttcctgatgcttcag

SEQ ID NO: 481598 - DNA, 472 bp, Homo sapiens
gtcgacactagtggatccgaagcagccccttctttgactcttgcattttgagtttttacagatgtttgtggagctcttactctgacatgcatttataattgccatggagactcagacaacgttgtagatcacagagtgaactatgctttttagtgtcaatgcatagcttaagatagaatgttttacttgttacataaatgctggttttctttcagatttcaggacatactttattttttccagagatagggtcttctatgttgcccaggctggctttgaactcctgggatcagtgatctcctgcctcagccttcgcggtagttgggactacaggccacgcaccgtgcatggctggacacgggatttgattgatggtaaacatccagctagctgagagatggcaaacctacagagagctacagttttttttgcactagaagtgaatggttccggggggattgtgattttttaa

SEQ ID NO: 481599 - DNA, 336 bp, Homo sapiens
cttgtccaataacctcagcgaattttagtatttttatgttcagacggggtttctccatcttggtcatgctggtctcttactcctgacctcaggttattcactcacctcaggctcccaaaatgctgtgattacaggtttgatccaccatgcctggccgatcatgtgatttttcttctcctagcctgtttattgtcacgtgattgcacttagctaatttttgaatattgatccagtcttgcctacctcggacttatctctgtctggtcatgtccttataattctcttttacgatatatgctgaacttgtactttgctagatattagtgtaggtaactt

SEQ ID NO: 481600 - DNA, 175 bp, Homo sapiens
tgtggatatttttccacagacttttaagaaaatgcgtagatatttataactggcaaacctaaagaaagggaaggtaaagtactttacataagtatttgcataaataaaaccaatggggctaattgtttaattcttaattcattgtttacttcacatttattattgataccgcgaa

SEQ ID NO: 481601 - DNA, 512 bp, Homo sapiens
ttgcgcgtcttctggctggtgtattttgtaagctactctaaattcctatttatagaaattgctggctgggcacggtggctcatacctgtaatcccagctacttgggaggctgaagcaggagaatcacatgaacccaggaggtggaggttgcaggagccaagatcgcgccatgcactccagcctgggcaacagagtgagactccatctcaaaaaaaaaaaaaataaggttgtcctctgaagagcaaatgtctcattccagttattgacccattcagcaggaatatggtggagtccagcccaattcaggtcagccatatccaaaagaccacaagttcattactaggttgagcaaaagagttttaatctataagcagaaagagcctctctggcagcagagataaaaaactgccccaatttcatttccatacttcagggaacagcaaatggaggattaacttatctaggacttgaattccttctttgcgaccaagtgattaaaagacggcaagcgg

SEQ ID NO: 481602 - DNA, 290 bp, Homo sapiens
tgatgctgacacttgagggtgcgtggccgaggactttcacagtctctaagcagctcccccaccctagacacggaggccccaaggggctgtgaacacgagtctgtggcgaagcaagtgaggcatcgctcggtgggcgctcttgctgggtgccccagccgcaggcgtgtacggactggacggcctgtcttttttccactggccccccggcatgggatgggccagggcgccggtccggtaaccggagtgcaagctcgaaagagagagagagaaaacactgagacagctttagt

SEQ ID NO: 481603 - DNA, 93 bp, Homo sapiens
aacggggcagggaaggtagtgtgaatgatgtaaaggtgtgccaaattggttctgcaaaattaaccttttttgaataaaatattcaattttcaa

SEQ ID NO: 481604 - DNA, 943 bp, Homo sapiens
  misc_feature (186)..(186): n is a, c, g, or t
  misc_feature (259)..(259): n is a, c, g, or t
  misc_feature (306)..(306): n is a, c, g, or t
  misc_feature (342)..(343): n is a, c, g, or t
  misc_feature (348)..(348): n is a, c, g, or t
  misc_feature (351)..(352): n is a, c, g, or t
  misc_feature (354)..(354): n is a, c, g, or t
  misc_feature (408)..(408): n is a, c, g, or t
  misc_feature (413)..(413): n is a, c, g, or t
  misc_feature (444)..(444): n is a, c, g, or t
  misc_feature (446)..(447): n is a, c, g, or t
  misc_feature (460)..(460): n is a, c, g, or t
  misc_feature (495)..(495): n is a, c, g, or t
  misc_feature (506)..(506): n is a, c, g, or t
  misc_feature (532)..(532): n is a, c, g, or t
  misc_feature (550)..(550): n is a, c, g, or t
  misc_feature (552)..(552): n is a, c, g, or t
ggttctcccaggccccaccttccatccagtgccctggaccctcggctgggtagcgccaccagagcgaccaaagtcccgcgccttccagggcgcactccagagccacaagagctccatggcggcggcgcgcaagcccaaaaaacctttccctggtgtgtgcacggaccgggggacttgcgcctgganaactatcctatccctgaaccaggcccaaatgaggtcttgctgaggatgcattctgtgggaatctgtggctcanatgtccactactgggagtatggtcgaatgggaatttattgtgaaaangcccatggtgctgggacatgaagcttcggggaacanntcganaannangtgggatcatcggtaaagcacctaaaaccaggtgatcgtgttgccatcgagccntggtngctccccgagaaagtgatgaattctgcaagnanngggccgatacaantctgtcaccttcatcttcttctgtgccacgcaccnccgatgagggnaacctctgccggttctataagcacanatgcagccttttgttacnangcttcctgacaattgtcacctttgaggaaggcgccctgatcgagccacttcttctgttgggggatccatgacctgcacggagaggcggagttaccccgtgggagcacaacggtccttgtgtgtggagctgggcaatcgggatggtcactttgctcgtggccaaagcaatggtgagcatgctcaagtagtggtgactgatctgtctgctaccgcgattgtgcaatagccaaggagataggggctgatttagtcctccagatctccaagtgagagccctcaggaaatcgccaggaaagtagaaggtcagctggggtgcaaggccggaagtcacatcgagtgccggggcaagagggctccatccaggggggcatttaagcaattcgtctggtgg

SEQ ID NO: 481605 - DNA, 354 bp, Homo sapiens
ttcctgtactcatgatgttcgcatcttgtaatgctttttggccatttgcgtgtattctttatgaagcgtctatccaagacttttgcagatctgtattttttttcttttaatagacaaagtttcactctgtaactcaggctggaatgcagtggtgcaatcacagctaactgtaaccttgaactcctaggctcaagtgatcctcctgctccagcctcccgaatagctaaaactacaggcattcgccaccacacctggctaatctttatttttgcagagacaggttctcactatattgcccaggctggttttgaactcctagcctcaagtgatcctcaggcctcggcctcccaaagc

SEQ ID NO: 481606 - DNA, 634 bp, Homo sapiens
aatttactccccatctagattatgtgcacaattttagttaaatggattatgtgctcaattgggggtttttttttggagacggagtctcgctctgtgcacccgggctagagtgcagtggcgcgatctcggctgcactgcagagctccgactcccgggttcacgccatactcctgcctcagcctcccaagtagctgggactacaggtgcccgccaccacgcccggctaagtttggtatttttagtagagatggggtttcaccggtgtgggccgggatggtctcgaatctcctgaccttgtgatccgcccacctcgggcctcccaagggtgcgggggtttacagggtgtgaaccatcggcgcccagacccgtggtgctcaatttcttaactaaggtgcacaatgggttcgtggtgaaaaacaagcaacgtgggctatatgctgggtagccagactaaggagagacttagatttttctggtcaagcagatggtgagggtaacatgtgtggggccaagcttcaggtgtaattactctggattgttactcttttctctttcatcccaagggttcagttcatattctttcttcagtactacaaagataccagaataagcgggcatagaaagcaaaggtgta

SEQ ID NO: 481607 - DNA, 429 bp, Homo sapiens
  misc_feature (429)..(429): n is a, c, g, or t
taataatacaataaaatgttcccaagtggtttaaagtcaaattttaactttgagaaatatactcaattcaagattgtaattaccaagggttatttgaaatcaactatacaaaacatttaaaagtgcttaggtatggctaggaattttctaagaacagggaaatggtttactacacaatgatagtcagaccacatacaaagaacaagaatccgtgcgtcctgcatggggacggttaatgctcagtatccattctgagaaagcagagcagaagctgtctctaatctaatctgatcttccaccagagtcttccttgttaacagtcagaagcacaagctgcctagcactcctgacagtctgagggtgggtagagtcacatgccagtcacactgatggcagaatttatttccttttagagtccacacaagtacn

SEQ ID NO: 481608 - DNA, 1379 bp, Homo sapiens
gcacagtaaatgttgcatccggagcgccagacgatgcaatgtatatgtgctcatatcaggtcacaatatgtatttctgtgctacctagaatcactagctcgtgaactagggatagcctgtgagcattactcacgcgggtaccatattagcgacccctggcgataaacgacgctatcgctgatacaaccgtgcacggaatgtaatatcttggacaagtcgttagcatgaatacctatcgccactgggttgcatatctgatacttcagtattgacgctgaacggcgctctctgtcacagtgtcaattaccgccgggatagccccccaaaagtggttaccaaaagttaaccagaccaaaaacgcacgttcactttgagactgcaacgcgggtttttcaatggaacgacgtgctcttacggcttgacacaacacacatttcattcgcaaacgcaaggacctaacaggatgtactacaggcacttccaactaatcaaagggcccatgaactaacgtggggccaacattgcttgcacatgacctgtcttaccaattccctgtatttccaacggccgcttcttttcccagtacttaatgcttctaaccacagcaattccactccgcgctgcggaccctttgcattgcacgacacgcgcaaaacggggggcgccttgctactttacacgcacttatatgaagttcccaagatacagagggctcctttaacacatgaacgaagaacttccctttcacacagggccctggccaggcctcagacaaacggttgcccactgtcctaaacaaggaccctctgacttgtgaccaaacccaaagactacggggttatccacaagaaaccacttgacagaacactgtgtgggaacaccatttgtttccccgcagtggattcccttttggtgaaccaagaaaggcccaattggcagggcattggggtttcaaacaacgaactcggttcctatcccaattatccattgggacgcggcatttgaatcaaggaagacattgttcgttaccacagtgggggggcaacgcaacatcccaggagaagttccgtggcaatttaaatgaatccacaaccaggaaagagacatttcaagggagaagggggaacaaccatggatgttacccttttaaagtggcaagtcgacccgtggaattcctgtagtatgcaaccttaaatctaccacccacattcacggatttcacacaacccttgagttagaatcttgttagagtcactatgtgggtaacattgggatgcccttggaaaatggatatatgcttacattatacaaacgtgactgaacaccccttaggcaagtttaccaacggcagatacaacaaagcacaactaaccataagc

SEQ ID NO: 481609 - DNA, 307 bp, Homo sapiens
  misc_feature (33)..(33): n is a, c, g, or t
  misc_feature (58)..(58): n is a, c, g, or t
ttttttttggggggggggtggaaggggggcttnccccctctttttaaggacaataaanaaggcgtggtttgggtttggtttttggggggggggattaaaaaaaccaaaagggggggtttccccggcccaaacccgggttttttggggtttttaaaaaaaatggggggggttttgttttaagttgggatttggggggggcgggggggttttccccccccggcttcgggggggaaggggggttttggtttttttaaaaaaggaaagggggggggggggtaattttttttcaaaaaaagggttcctttta

SEQ ID NO: 481610 - DNA, 408 bp, Homo sapiens
caaatttggttactttgcggcatgcaatgattttatgtacaattatattattaataacatacagtaagtcacattagaattagaggattttcccatacttttggaacatatccaataacacatttatacaaataacagcccaaagaaaaccaaacaccatttcacatttgataatgcttcctgagcaatttttgcaccaaataagccaaacgtcactcttgcattagtgcactgttgatgtcaaagccaattaattcttaatgaaatcttatagacaaatgtgttcaaacttaatcagtttggccataaggtaagtttctcataagcctttgataaccctttacacatttttattaaagagcaggtcataggcaggtttttgctcgaagaaaaaacctgttatgcttt

SEQ ID NO: 481611 - DNA, 474 bp, Homo sapiens
  misc_feature (35)..(35): n is a, c, g, or t
  misc_feature (39)..(39): n is a, c, g, or t
  misc_feature (469)..(469): n is a, c, g, or t
cagaggtcggcttcgctcaagtggcttcctaaacnaggngaagatacttgcatcttcttatttgttcaatttgcctctctggtttccagttgccctattagcaggcaatctagaacctccttcttaatgacccgctccagccaggtaggtcctatttgcaaacaccagattttccaggcaccgttagacactgatggcaccactggcttacaaaattcttttggtgcacctcccaggcttagggattattttccaaacacaactgctgaggccagattctgggcctggcctgtgtgtctagcatcaatttcccactgtgctcaaaccagtgtttccctctcacccaacaacaacttcctatacctttgtctggggagctcagacttggagtatatcaggaagggaacaggcatatgatttggatacagcaccacattctttcttggaccctggtccccagcggcctganctctg

SEQ ID NO: 481612 - DNA, 1186 bp, Homo sapiens
ggtctcagcaagagccttggaacactaggcagcagggtaccagtagtgacaaaggtggggtgcagagaccattgaggtacaacaacggtaacgaaggtgcagcgaaggcccgtgaaggcgaacgggagtggtcgggtgctcctggtagggatggtaggcaagggccatggctgtcgggaccactacagtgtggcttcctagctcgcgtagagcgccgaccttatgtccgtcactcagagacagctgtcgagctgatccgccgtaaggagaagttggctgccgaggtatcccagctggacctgacgtcacgtcttgtgaggagatcttaaggaggagggtctctgagagaggtacacagcaagaactctccccaggcacagctgttgtgaagactctccaccagcgtcataggcgtgtaggtgcaagaaaccctctgccatcagaggccagcttcagcctttgcctaatcaccgcaaggcgcaaagatggagaaggtaagacgggaaggagatgtctccccatgtaggcgtatttgaggacagtcctttccctgcagaagatctcaagctggggtccacagagtgggaaatgttagagtagggagctaggcaaacatgagcaggacaggtgagggccccacaggaatgtcagggctaccatcaggtgatggtcaggtggttgtttagactgtctctggtaaactaataattggttgcagccagcttcaagcaaggacagtctctctatagatacaaaacgccctgatctggtgaatcagcggttcccggatagatctcaaggagctgggcaagcattctggagcatgcgcaccaagaggcgaaatggaggggaatttaaccagtatattgaccctacattcctctgggaacgccagaactgggtaggggacaaatggctcaatgagatggcgcacttcagaatcacactgtgcatgcgaacctttacagatgttgggggtatccacattgggaacacgtttgaggaacatatgtggattgtaagttattcccgaacttcgcaattgtagctcgttaggtagagggctaaatctagtacgtacccgagagatcacttggtcgtcaaataatcacgcgtaaaaacgctttgtggatgagggaaattcactagcctatgcacagtcaagaacaagagcgaagagaagaga

SEQ ID NO: 481613 - DNA, 429 bp, Homo sapiens
gggagaaagaagaaatacttgaaatggtaatgacagatttctccaaattaatgtcagacactaaaccacagatccaggaatctcagagaatcaggacaaatgccagaaaaactacacctgggcatatcattttcaaactgcagaaaatcaaagataaagaaaaagtcctggaaggggccagagtgaaaaaaacacattacctgtagaggagcaaagggaagaaatgcacctgacttatcctcagaaaccaggtgagcaaggagagagtggagtgagatgtgagggtggagagagaaaacccaccagcctagaactctgaaccctgcacaattatcctttaaaagtaaaggagaataaagactttttcagacaaacaaaacttcagggaatttgttgccagtccgtttgccttgcaagaaatgttacaaa

SEQ ID NO: 481614 - DNA, 341 bp, Homo sapiens
  misc_feature (17)..(17): n is a, c, g, or t
tctcaggccttctgggnaggttccagcttttccttggatgctctcttctctctggccagctcaggctggagcagtgggtgttggtgccatcctgtggctataggtgataaaccaggttgtgttttgacccctagtcttgaatcctggagttctcacatgcgtggatttaaatgctgtgtctttctaagggcagattgtgcccattttccttctctgcctctcaagggactgtttgctgtgtttattgacttaccattaaaaaaaatcatatacattgatgaattagattgtactccataaattatatatgtttgaaaaataaagaatattttttcaatttt

SEQ ID NO: 481615 - DNA, 202 bp, Homo sapiens
ccgtactgtggtgtaccgtcacgtccgcaacctacaccacagctcagggcaacgccggatccttaacccactgagcaaggccaggatcaaacccgcaacctcatggttcctagtcggatttgttaaccactgcaccacgacgagaactccctacacccactcatttctgaagcgtgaatctcctcctggcactgaccaattc

SEQ ID NO: 481616 - DNA, 146 bp, Homo sapiens
  misc_feature (17)..(17): n is a, c, g, or t
  misc_feature (43)..(43): n is a, c, g, or t
tttgagaaagcgcatanagcacttttattgaataataaacttngactcataaatggtctggggaagggtcagcaacgatttctcaccaaatcactacacagacacaaagggtgagaaggctggggggaaagccaggaactgagatc

SEQ ID NO: 481617 - DNA, 199 bp, Homo sapiens
gcagagtcgcgacagaaaaatgacatttcctgtaagggtggcgccttactgaagttcgtaatcggcgtgtaggtgaattgacgtggttgggtccgtacagatgtctacagcgcttggaggcctgttgcgaggctcctttcagggttgagagagccttacaaaaagtgtgcaggcgcggcaaccggtttgaatcatctag

SEQ ID NO: 481618 - DNA, 701 bp, Homo sapiens
  misc_feature (1)..(1): n is a, c, g, or t
  misc_feature (8)..(8): n is a, c, g, or t
  misc_feature (10)..(10): n is a, c, g, or t
  misc_feature (26)..(26): n is a, c, g, or t
  misc_feature (39)..(39): n is a, c, g, or t
  misc_feature (55)..(55): n is a, c, g, or t
  misc_feature (57)..(57): n is a, c, g, or t
  misc_feature (69)..(69): n is a, c, g, or t
  misc_feature (161)..(161): n is a, c, g, or t
  misc_feature (174)..(174): n is a, c, g, or t
  misc_feature (176)..(176): n is a, c, g, or t
  misc_feature (204)..(204): n is a, c, g, or t
  misc_feature (225)..(225): n is a, c, g, or t
  misc_feature (228)..(228): n is a, c, g, or t
  misc_feature (238)..(238): n is a, c, g, or t
  misc_feature (252)..(252): n is a, c, g, or t
  misc_feature (375)..(375): n is a, c, g, or t
  misc_feature (397)..(397): n is a, c, g, or t
  misc_feature (422)..(422): n is a, c, g, or t
  misc_feature (444)..(444): n is a, c, g, or t
  misc_feature (474)..(477): n is a, c, g, or t
  misc_feature (491)..(491): n is a, c, g, or t
  misc_feature (503)..(503): n is a, c, g, or t
  misc_feature (516)..(516): n is a, c, g, or t
  misc_feature (535)..(535): n is a, c, g, or t
  misc_feature (543)..(544): n is a, c, g, or t
  misc_feature (551)..(551): n is a, c, g, or t
  misc_feature (612)..(612): n is a, c, g, or t
  misc_feature (664)..(664): n is a, c, g, or t
ngaaaacngnccagtttattattatnatttttgatggcnacagacaatgtgggcncncacacctagacnagcttttctggtggaagggcttgggcacagacagacagcagggcttctggttttccttttttttttttcctttttccttttttttttttttnaagaagaaagcananaggttgaatgggggggggggcttgcaanaaaatatccatttaaaaaaanttncccccaaaanacccccccgaaaanaaaaaaaaaaaccccaacaaaggtaaaaccccaaacaaaaaacaacaaaaaaggggcatgtacagaaaagggcctttggggaaagggcaaggggggggatttttctgggcactgacttgaaanacatttttgagagttttgtccntcttgttttatggaaaaaaaaggtnggcctttttattgcatgaaacnaaaattgggaaaggtagaggggcgtggacnnnncggggggggggtgnggggggccgggngatgccccccccnccagcccccggaaaaaganaccccacnncaagcanaattcccggcaacttcccgcccgcaatgcctgcccccccagcgtctcggagaaggggggancacacactcatcgtcatgcttggagaataattgtcgttctgaaaggagtggnggaagttcccccctagctcgccgtcatctcgaggggt

SEQ ID NO: 481619 - DNA, 176 bp, Homo sapiens
  misc_feature (142)..(143): n is a, c, g, or t
  misc_feature (151)..(151): n is a, c, g, or t
  misc_feature (160)..(160): n is a, c, g, or t
tgatcagaggatcgctttggcgggccttcctatatatcagatcttttttcttctttttctttggagacagagtctggtcctggtcacccatgctggagtgcagtggctcaatctcgggctcactgcaatctccacctcccannagttcaangtgattctncctgcctcagcctcca

SEQ ID NO: 481620 - DNA, 367 bp, Homo sapiens
gtcggcgactctaaggatcccacacgtaacgcttccccaacggtaactattcaccacacaaacgccagggaggaataaacctcctgaatcaatgtggagaatgacaatggatcctatttcaacggccgcgggtgcagtgccaatgttatcctggtcttcttgagaagggaatggacctggcgaaaagcgcactggacttgacgaacaaactcgtagacatagcgggtgaacagtcaaaggtcggaggggaagagcaacagccagagggtaagatcaatttttgagagcgtcgccaaacagaaggcggatctgttccgccttcttcttctctgcccggcgtccagcccgaagacgttacgtgtgggta

SEQ ID NO: 481621 - DNA, 233 bp, Homo sapiens
  misc_feature (50)..(50): n is a, c, g, or t
  misc_feature (154)..(154): n is a, c, g, or t
  misc_feature (161)..(161): n is a, c, g, or t
  misc_feature (188)..(188): n is a, c, g, or t
  misc_feature (220)..(220): n is a, c, g, or t
gtgacctggtgtctagaggatcccactttcccattagagtactgcacggncgaaggacaagttttggaatgcacagtattatagacaacaagcgaagcaaacaaaagttgatcctcacacatgccatcctcctgtgtcactttacagctgtttngtgtttnggttttttttccccagttatttattantgataataacttactttttcttacattctgtngtaaataaagtac

SEQ ID NO: 481622 - DNA, 405 bp, Homo sapiens
cgggccagtacggatgtggcgaagtcaagagaaccaatggcagaaggaggagtgtagagcttacatgatggagggattgttattgatggtaggggtgttggtagtgaaggataaagagtcaagggtgacttacggatggtgatgccaatcagcgagatggcaaggagtaggagaggaaaggtttttgaagggttgggaattaagagttatgttacctaagtgagaaggttcagtagacagttgtctatgtgagtatggaatgcaagggagatgttagggctaggaaagtgaacctcgtgactcctttaatgtgaccggcagagaccttcacaaatgcggtgtttgtgttagtaggtaagcctgatactggaagctaatttttatgggggaagggaaattgcgata

SEQ ID NO: 481623 - DNA, 338 bp, Homo sapiens
cagtcgtacataattgtctgatgacacgctactacaagggagtaaaaaagaaggccaggcaaggtggctcacgcctgtaatcccagcactttgggaggccgaggtgggcggatcacgaggtcaggaaatcgagaccatcctggctaacatggtgaaaccccgtctcaactaaaaacacacaaaaaaaaattagccgggcatggtggcaggcgcctgtagtcccagctagttgggaggctgaggcaggagaatggcatgaacccgggaagtgaagcttgcagtgagccgagatcgagccactgcactccagcctgggcgacagagcgagactccatctc

SEQ ID NO: 481624 - DNA, 287 bp, Homo sapiens
  misc_feature (12)..(12): n is a, c, g, or t
  misc_feature (69)..(69): n is a, c, g, or t
  misc_feature (103)..(103): n is a, c, g, or t
  misc_feature (191)..(191): n is a, c, g, or t
  misc_feature (207)..(207): n is a, c, g, or t
  misc_feature (227)..(227): n is a, c, g, or t
  misc_feature (259)..(259): n is a, c, g, or t
  misc_feature (265)..(265): n is a, c, g, or t
ctaaaccttgtnttggccctgggagtgtgatcattgtccattacagtctgggcggtgggaaaaagtttntgtattcttgaacacagagtgtgttattaatctntgcgattaaccactacaccatgctgcagcaagaatatctgctgtattgggcctggaatggaagacatagtcagtgggatttagcatgnggtaggggacaagatnccctacctctagttggctgnatgcagccaggtgagccaggtggaacagcttnccactnagggaccaggatgactggcaca

SEQ ID NO: 481625 - DNA, 463 bp, Homo sapiens
  misc_feature (339)..(339): n is a, c, g, or t
ggcactggtgttttttaaaagcgccccctgctctgccacctcccagtgattctgatatgcatctaaggttgaggatcaccgctttacattataaagtgctttcacatacatgattcaggatttttgtatgcacacagaaaggaaaaagaaacaccgttaatgactgttgactgtaaaagaaaataggaagaaacaggggtagtaattgtgaaaatgaaaggattagagaaaagtcaatttctagaaactggaggaaaaaaacttcacctttctaagggctaaaattagtcctatgcatatagaacattaaggagggactgtatgtccatatttactgcntatatatggaatagtttttagatgaccataaaattctcagaagagaagtctgaaaacagtcatttagtatttgatgccaattattcctaagatcatatgcttctcctctataaatgaaatatat

SEQ ID NO: 481626 - DNA, 280 bp, Homo sapiens
ccgatcactagcactcttgggaggctgaggcgggagcgatcaccctgagcgtcgacgagttcgcagatccagcctgatgacactggagaaaccctgtctctacttaaaataccaaattaaccaggcacatgcctgtaattcccgctactagggaggctcgaggcccagagaatcgcttgaacctcgggaggtggaggttcccctgacacccagattgtgcccttgtactttaccctgggccacaagagccaaacctctgtttccaaaaaaaaaaattaat

SEQ ID NO: 481627 - DNA, 437 bp, Homo sapiens
  misc_feature (414)..(414): n is a, c, g, or t
aacctcctctcctcccttggtcctaacaatttctcttcttgtcaaaccctagctgcggttttaggatcatgactgtttctttaacaataccaagacagccccgaggccaggaccatacctccatgtttgccattgtctcaacaatgtcttgtcaatgtgaggtcttttcgatgttaaaagatattgatttaccagaagcatttttccttaaaataaataaaaattaaaacttaaagaaagttatgggatttttgcaggcattttcagctgtagtcatgttggctagtctttagtgagatattgtactaccaaagtttggatacacaaaaacaatagaagatctacaccaaaattttaaataaaatatagatgacacgaggcatttcaggcagcagatttactgtagatgatagntttaccacatttcccagaaaatc

SEQ ID NO: 481628 - DNA, 712 bp, Homo sapiens
  misc_feature (712)..(712): n is a, c, g, or t
ggtgcgacactgaggcctgaagaacctgcggctggaggacagtgtgcaaatacacctgccgcgtgttgaacctgcgcgggcgccatcaactgccacctacaaggtggatgtgatccatgctggaccctgttccaatgccctgtgctcacatggcactgcacccctgtgaacactgactgtgtggacttcggtggggaccactgtccttccagtgcaattgtgctgcagctgactgtgaagccggtgatccagtggctgaatgctgctgtggagtactgtgctgccgatgtgtgccgctcacaactccaccatctgatgttggtggctgtgccaggacacgtttcgttgtgttgctttgcgccactggggtgactgttgttgtgtctggctggacctgactgtggcgtccctagcccttcgaagtaatgccttgcatccatcaagccctgttgccctgccacgtgcacgattgctgtgtcgcattgtaccattcttgcctttgtgacatgcccaaatcagcacaactcgaggggcctaccatggctttcccttgcaatgctgcccatttcacgtacaccacagtgctagcccaatgaccccaaatagaaccctgctcaacgtgggccagcctttgttggacccttccctccgttccctcctggcccacttatgcctagcctgttggcccagtgggccatctggaatcccaagn

SEQ ID NO: 481629 - DNA, 547 bp, Homo sapiens
cgctcaccgaattttgcacgagacacagatcactgtagactacaactccggggcttaaccaatcctggctcctctgtctctcaagtagcttagaccacaagcgtgtgccaccacatctagctaactttttaaattctcttggagtgatgaaggctcaccatgcgtgctagactcactgcattttttaaagtacatttttgtactcttttcacagtatgcggtcatcactattctatgatgaacagcgtatcttattcctagcttataggtttatggagagagagttcttcatattgatccttagagctttttatacattgaacatgctatggctttgcatatatagtatgcaattattccccaatttctgtattctttgagcattctattgcactttccagatagacattatatagcatacggatgccggattctcaggagactgcctcatgttgcacgctgagttatgaagagctttcttatgttaggattgacagagattgagccggacttgctagtaattgtgcgattcgtgacttacactttt

SEQ ID NO: 481630 - DNA, 340 bp, Homo sapiens
caggattctgatgctgaagtgaagttgaccacattcatggaagaaccttctgccctcgctttgcaggatgaaacatttccgcgcttggctctcattcttccacatgtgtgacttttctccggactgtgttgctatctggttctgcagtttgtagaaaatgtcctcctttgtgtctgcctcatctcgtacctttgtcctgaagtccctgcttttatggcagcccctcatcttccaagttttgtgtctcccctttacctaatgcttcctgtctcccatgcatctgtactccgttgtgcctcaaacacattactattattaaatgtttctctatcttgttaaa

SEQ ID NO: 481631 - DNA, 462 bp, Homo sapiens
  misc_feature (67)..(67): n is a, c, g, or t
  misc_feature (248)..(248): n is a, c, g, or t
  misc_feature (264)..(264): n is a, c, g, or t
  misc_feature (394)..(394): n is a, c, g, or t
  misc_feature (437)..(437): n is a, c, g, or t
aattatgccaggactgaaaaaaaagaaagaacattgcccatgtgggaaagtaaaatgaaagcattcnagtgtggttgtgctagcccaaccattaaaaatgctggaagattgacccccccaaaaaagtaaatatcccacggaggagctgtttctctgggccatccaattgggatgtctggagcccggattgttgttcattatggctcatgccctgaagccaggagagttcggtctggctagtatttgcnaacggaggaggaggtnttccgccctgctgattgagaagctgtagacaacctgttttaggagacagttccatgtgaccggctgaagtaaatgtgactcccttgggccaggttatattcagcataagctatttcattttttattattntctactaaaatttttaaaaaatcatatccaaaaaacacacttnaattacaaataaaaatttcttcttt

SEQ ID NO: 481632 - DNA, 574 bp, Homo sapiens
  misc_feature (1)..(1): n is a, c, g, or t
  misc_feature (42)..(42): n is a, c, g, or t
  misc_feature (44)..(44): n is a, c, g, or t
  misc_feature (70)..(70): n is a, c, g, or t
  misc_feature (96)..(96): n is a, c, g, or t
nggagcaattgattccaggtaaaagtggttagtccccagtangnccccactttcagtccaggagggcctnaagacaggggtccaggttgccagtcntgcagactggagtagggacttcgtggtgcatcttctggcctgcccatggaccaatcggcatgtacttcctcccctcggaggtccataaaaaccctgggttcagccagagtagggcagaggactgccagaggaccaagagggcagagacctatgggtcaacaagcctaagagaggagctaccctctctgctgatagttggagatgatggaacagccagttgcagaaaggacctaccctccctgctgacagctgcagagacaacctgtgggcagagaagagccaccctctccagggcctcctctcttctgagagctgcagacattaggacgatcagttgcagagaggagccatcctctccagggcctcctctctactgagaactgaatacctgatggacaacctgcctacagagaggaaatacccactggaggtctctgagctgttgtaacactcaataaagttcatctttgtcttgttc

SEQ ID NO: 481633 - DNA, 179 bp, Homo sapiens
ctgattgcgattcttgaatgtctctctcggcctgataattaagaagaactcgcgttcctcagataaaagttctcttttctcaaaaccatttaaatgtggtaattacgaattggcccatgaaggggcacgagtgcctatttagctcctcgccatatacttgctcattcaggagttgcatt

SEQ ID NO: 481634 - DNA, 505 bp, Homo sapiens
atacaaatatgaactattttagggatatagagaagaaaaatgtcaacataaggcaaaaaataagaagtcttaggtaaatttgtaaccttctgatcacaataagtgctttgggtcttctagctaaatatttttcagaactaaagggagataagtaaaagtttttcatctttaagatgtattaaagctttataatttaatacccaaatatagtccaaagaaatgtgtccttatcttaaggatgattgtcatcattgcatatgttatttaaatttagcacagttcttgaattatgaaaagtactgatttcatatatggaaagttatagtgtgaaagctaattcagtgcttgagactaatgaaatcagtaagcctgagatcataaatgataacagtcttcatttgaagtgtgtaactagtctttatttcttttggcagcttctgggctggctggctgagaaaatacctactcttcgttccacccccactcccgtaccaggggtaacgag

SEQ ID NO: 481635 - DNA, 165 bp, Homo sapiens
ttggggctccattcatgtgatatccggcctataggatatacttggcatccccaaggcatggggactgggctgggagcacttccctttcctccaacagcactgccacttgattgccggggaggaaattccactcttcttgggacggtcactaatctggcaggggct

SEQ ID NO: 481636 - DNA, 611 bp, Homo sapiens
cgcggtggctcacgcctgtaatcccagctctcagggaggctaagaggcgggaggatagcttgagcccaggagttcgagacctgcctgggcaatatagcgagaccccgttttctccagaaaaagcgaaaacaaaaaaaacaaacccaaagagacaaaaaaaacaaaaaaaaaaacaaaacaaaaacctctttgtggcgggcggccttgggccctgtggaaaaaggtttttatacacacaatcgcgcggtggggcgcgcggggggcccccaagataggccataggtgaaacaggtggcgccacaaagagcgggttcccaaagaggagaacacccgcggggcacagaggcacaagagggggagggggggaattctccccacaaaatacaacacaagcgccccgggggggggaaaccaccacgaaaggctgttcttgttgaaaacaaatatttctcaaaagagaggggggggcatcaccgaggaggcgccacaataacacggggggggactctctatattccacacaaggggggggtgtccccaaagagacgaagatcgctacagataatcctccacaatattaaacacccccccctgtcctcgggtgggttaga

SEQ ID NO: 481637 - DNA, 899 bp, Homo sapiens
ggcctgctacattgccccggtactggatgattgagaagcggagtaaggactatgtcattatagtctcggggatctactagggggggtgtgtagggtgtgctcctgagtacgtggaaactggattagatcgttagacccattagtactgtttggctagtagagcaattaaccgagatttcggcacactttccataatcggagttgtgggcgcagatttagccgagcgtaaagtgcaggatagaaagcttcctagggttgccatggacaagactgtgccgcattctcctgtctacaaagagtgcgcttggccaacgaacctaggacgtaaatgaccgtgatcgtcttgagaagctctgggcatggactgaaagtgttgtcactatctggtgcagagggagacacatctcccgcatgtaaggagatcctgatctttactccccttagacactaatgtaaaatgtcttgtgtgacagtgtcttggcaccagtgtctcgatggatattgtcgatgctggaaagccaagtgagtgagccaatcgagttttgggaatggcctgatgcggagaaggatcatgcggctaagggttgatccgcatgattgtgctgcgtaggaggcaaagttttgacttggtagcgctgatttgctcttgtcttccgcggtcccacaacgattcgtccataatgctagtagcgggcattgtttgatggggtgcctaggtcgattcgctactcctttgattcgctctgtttcgttgcctccacctgggggtccatgagtgggtcgtccttcggagacaccctgatgaagtttatgtccattccaatggagcttttggtattgagggttttttccaggctttgcatacccatgtggcggtcggtcccttattggtgttccta

SEQ ID NO: 481638 - DNA, 170 bp, Homo sapiens
  misc_feature (158)..(158): n is a, c, g, or t
acgttccagctcccttcaacagccattcgtgtttctcatccatctcgtttggcccatgggcatggcacacagcagcccgtggcagcaattggcagtcacaagtctgtcgtcgtgtggtggtcccagcatggcacgcccattccaccagtggggtcacngcagctcgcaat

SEQ ID NO: 481639 - DNA, 134 bp, Homo sapiens
gagtatgcgtcagacccaagacctgtgtctgtctgcgtgtgctgtgctttgtctcattgagcgacggcgcgggaatgtgggcggccggagtccagagccaggtcataagtctacaacactctggcatctgtcct

SEQ ID NO: 481640 - DNA, 1129 bp, Homo sapiens
gattttggatgatcggaggggagttgagagcctaggcgaggattgcttggagctgcattcatcagtcggagactccagcactcgacatctggatgccactaattctactgcatggttactccatctactggtgtgtgctccatgagccgctgactgatcaaggttgttaccatcacgatccggctaaaccggcatacctggtgaagtccctgtgcttaactacgttttatggcccctgtcagataactcgtggcttcaacgctgcatcaagtagactccgagttagaggccagcttaactatctagactaattgagttcatacctctggatggtcagtccatcgcgtctcaattgccaagatccaaggttcatcgagattagagggagcctattgtcatatccagtagttgcacttaggtagcgatgtactccacatggtccatccagttcttgatcactaatcggtcctggcatgttctccggtcagtatggcaactccaagacataagtctcagagtgcgttcccctcaagtctattgccccactagttgtggtcattccatcaatcctctcaggtgtagctaatgcgctctgtgtcttctggcaagttggtgcctccgagggctaggtagtacaccagggggtcccgaagagtcgggctcaacccaagcaacatctccaattcaagggaggaacatgtagttgatggcactaacgtgcccttccttgataaccctcgaccttgggggactggatttcatgtcaggctagacttatatcacggaggtcaacccctcaatgggtagacacaactatgttagggtacccagcgtgacattggtggtaacgtcctgaaggcactttgataggcagcgaatgtccgttaggtaacgtcaaggttagggacgtgccaagttgagcgacggagccccattagtacgctatgtctcgagcaccttgacgacaaaggctagagcctggagcgtaaggagccgcgtttaaattcgcaatggcaacgctgtgtgcttcatcacccgttaggaaggggcttggcccccggtgttatacccgggggttatgtagggcccaacgttggggccattatatggaacgagcaggaggaacagc

SEQ ID NO: 481641 - DNA, 180 bp, Homo sapiens
ttatggacgcttgggatacatcaggtcaaacttgtggtccagtgcgcagcccatgcctcagccatggctgtgagtagttgctcagcactgcacacagctactctagtaccttggccaggtctccacacaggcaccacagtgaggagagctggtagttagatagccaacctatgaaagcca

SEQ ID NO: 481642 - DNA, 329 bp, Homo sapiens
  misc_feature (167)..(167): n is a, c, g, or t
atctctagatcgctcaccacaatgatgggatctaaatcttcagatattacgtatgaggctatggagctgtttccctgaaatcttccacacggagaaaggcaagctcaacatgggtgggcaatgtggcaagatgagagagccagaagttggtttgggggtccttaagnaaaggcagagcctctgtgtgtaagacattagaaggcagagccggggaggtgcctggcgccaagccactgccttccggttgggggcccggaccgggaaagcttggtcttatgctagattcagaagcacttgaagaatggagggtgacacttttagaggactag

SEQ ID NO: 481643 - DNA, 108 bp, Homo sapiens
gcaatgttcagtctttgtatggtggaaagtggagctgatgaagtaaatttgcatggcgtgaccagcctgggcttaaaacaggctctggagtttgcatacacaggacag

SEQ ID NO: 481644 - DNA, 353 bp, Homo sapiens
  misc_feature (19)..(19): n is a, c, g, or t
  misc_feature (70)..(70): n is a, c, g, or t
  misc_feature (105)..(105): n is a, c, g, or t
  misc_feature (107)..(107): n is a, c, g, or t
  misc_feature (157)..(157): n is a, c, g, or t
  misc_feature (243)..(243): n is a, c, g, or t
  misc_feature (248)..(248): n is a, c, g, or t
  misc_feature (292)..(292): n is a, c, g, or t
gatacgatgtggatgatanatggttggataaagatgatagttatagatgataaaaaggcatacatgatanatacatatagatgacagagatagatagagatgatntntaacattgtaacacgtataaataggccacacataggtaggcagtgggtanataggaggtacatggatggatatgcgtatacatataagtatatgtcctgaagggacaacccggaccccaggctggccaggacagtncccangctttggtaacctcctcaatagacacgaagctgcaggttttcanctgcttacgccgggcaaactgtaaagtgctttaaatccctggaactaaccacaacggcagc

SEQ ID NO: 481645 - DNA, 192 bp, Homo sapiens
  misc_feature (115)..(115): n is a, c, g, or t
gacttgggttattccgtgtgaccgcggtggctggcacgaaatttaccaatcctggcgttcgtatagcttagtttaactcttcgtttattgcctaaaggctaatcacatgctgctntcccgctgcggcggtgtgtgctaggcataagcgcttttgcagctgccattgcctgcgatgcgttacatgacttgatg

SEQ ID NO: 481646 - DNA, 138 bp, Homo sapiens
gtcgtctcttctccagcagctccgccaggttcagccccatctcattcagcgcattgtcgatatcctgatagatgcccatcgacagcagcgcgttagacagggtgcggccgatcaggaactccatcgacaggtaataca

SEQ ID NO: 481647 - DNA, 824 bp, Homo sapiens
gtctccaggacatggttactatcctgtggctacctaatcctgtctcatggtcctcagtcacttcacacccatgatgtatgctaacacccttcggttatctgtttagaagggataattattgtttttttttgtttttggagaacagagtctcggtcgggtggccagggcgtgggaggtgcagtgggcaacgagtcgtgcgggctcccgtgaaacctcgggccttacgggtgtaacaggcgaattcttccgggcctcagacctccgcggaggggcgtggaaactaaagggcgagtgggccaaccggagtgcccgagaagagagatgtctggaggaaatttataagagggaacgaaggagtggccaccaagggtggggccgaggaagaggagggtcgaaacatcacgtgaacgcatcagggaaatgccgaccgcgaccttaccggacgcgtcacacacacaggaggcggggagagagtatacaagaggcgattggagaacacaacgcgtacgggcccgcgagacgacatacataaaagagtacactaaagatgtataaaggagagtacgaggcgggtggagagaaaaagcggtcactacaagctgcacacaggaagaggctgtgcgacagaggaaaatgtgcccgtgcgggggaccgcgagacaaaagaaagcaaatctcacggggcgtgatcgaagaaaaacgcaccaacgaggcaggggaaaacccccaacgggaggacaccacaccgcagaaagcgtagagggacaaacacaatcagaccacacagaccagaaatataaactcacactaacagaggaggacgag

SEQ ID NO: 481648 - DNA, 1132 bp, Homo sapiens
  misc_feature (571)..(571): n is a, c, g, or t
  misc_feature (1132)..(1132): n is a, c, g, or t
ggtgggacgcgccgagccggaggctgcaggatgatgcggtgtcgatggctagttatgtcagtcgcggcgagggaacaagctgcggctgcaagaaagtggtatcgcgtggaccagttcggacgaaggatacggatagaagatggtgtcgacgagctcaatgcgaggttgtgcctggtctcgaaagcccaagatgtgcagcttcctggcagtggtagggacctcagaagttgtctataagagatatgccagacctgctaacttactgctgcggccatcgagggtcaagacaatgagctcatcagactggagctgatccaccgataacgtggagctctgtagcacagaatactgtgggcagatgtgtgcgagctggacgtcatcttcaactttgagaaggcctatttcatcctggcatgagtccaggatgggggggggatgtccaggacacctccactttccccattttaccactgaaggttggagaagctaggaggcaggaagatgtgaaccagatgcgcgggtgctataaggcgttatagtccgctgtgctatgggagagctgatgttcaancaccagatgtccttacgctcgctaataactgtcaatatatagacatgtcaggtcacgcgggagacggtgtcagggggcttcttgtccgctctgtccattactagctccaagcttacccctaaggcagccagggttagttctactgcctgggaagggtggacgactggaaccccactatactccttgggctgcgttggggccttatccagtgcacggacggaacaacatagtcatctcgcaccaacctggcaactttgacggacgacaggctgggcgaacgagcacgacttacgggacccgtggcctggcccgagcacataaaccagcacgcgcaccaagacctccagggcacgcacagccccgcgcacagtacgcaaaagaccacacagcacaagggaaactctggagagcaccaccaaccccgacacaccagcgggccaagaacacacgcacaaccgccagcccaataaataacggccacaggcatcaaccgcacaacaccacgaacacaaagaaccgcgacgacacgccccaccccaccaccataccataactgcacgn

SEQ ID NO: 481649 - DNA, 2008 bp, Homo sapiens
tttggaggaacgggccatgaggcagtttgccatggatgcggctgccactgcggctgcccagcgagacaccactctcatcagacactccccccagccctcgcccagcagcagtttcaacgaaggcctgctggcaggcaaccacaggcaccaggagatggagagcaggttgaaggtgctccatgcccagatcctagagaaagacgcagtgatcaaggtccttcaacagctttccaggaaagaccctggcaaggctacccagggcaccctacggcccgccaagtcggtgccgtccatctttgcagctgcagtggggactcagggctggcaagggttctcaaccagcgagcgacaaactgatgcacctgcccgacagacagtagaccgtggaccagcagaagagcccccggccacacctcctctccctgcccacaccaaacatggcagcagagacgggagcacccaaactgatggccctgcagacagcacctctgcctgcttggcctcagaacccgacagcctcctggggtgcaacggtagccagaggcaacctctctggactctatagctgcaaccagagtccaggatctgtcagacatggtggaaatactgatctgaaggaaggaggccttggggaccctgaagcctggctcccccatggcattccagcaattgtcttcaaatgctgcacctcacttcctccaaccagcaatggttttgtgcaggagctcagagaggagcactccaggggagccagaaaaggctgcacccccagaagactgcttttttttgacctatatttctcccacgacaatgaggaaggaagaggtctgttgctggagcaggaaggggctgagccccctccgtcctgccagtttgtatttgggcatgaagggaaaggagactggattctgattcccaagaatggctggacaccagccaaatggtctgcagggataatcaggccaaaccatggtgttctgtggctaagcatggccccagccagccctaactgctctcagtccctcactgccttcttcagatcactaagacttgaatcttttggggaaccattgggagtgtgagcctttcgggagccaccagcatgtccccttgcttggagtaggttagaggccatttgagaggcccgcagaacagtgtgttttgtatataattctctttccttgggaacagaagactaagcatgctggttcagagtctccttccagagctgtgctgcctgcccctgcttgccacagttcttgaaacatttgacaggtctaccagatgtccctctgcctccagttcttggcggtgtttttttgatactggttgcctttcctctgttttaaacccctgtgttcaatgcccgtgggattcttgtcaccagcctttgttgtgaacggctccaccgctcctacccctgggacatcctgtcagtttggttataaactgagccagatgcgatgagccacaacaagcggatatctgtcatacccagccccaggttctctttgaagaaactggagacgttgttctcataaacgtgttcgttcccaccagcagggactgggagagggagctatgctgttaaaagtaatcggtgaacttaaagaaaagtccccactaggtgcccccatcacagaatggcacccaagaggctggctcctcgagctttggtgccccagccctgaagcagggccagctactcggaattaggcagcctaccagcagcagtgactttaacttctggtcttaaagtaacccccattcagctgaaaaagcgattggtggattgcagatctgttgtgttttctcttgttgttttgttcgttttttctctcattgtttgaagttctgtctgttgttccattcccatggttctccgtgtttcctttttaaacatttgcatttgctgggcaattgcgtatttttttaattccccttttcccctgtgtaaagctgagaaatacatctggttcatgtgcgttgtttacaaagataaaagttt

SEQ ID NO: 481650 - DNA, 879 bp, Homo sapiens
caggccattgagcgtttatcggatgcccactcccacatccggggtactggggctggacgatgccttggatgcctcgagcagtgcttcgcaaggcatggtgggtcatgctgtgctgtgcactggatgaggacatggctggctgatggatgcttgtgagagtgactcctggagaatgggagagacttagccagtgtctggtgcatgtcacttatttgcgtggcgcagcctgtgtgcaacttgtgagtgaatgactggccatctgccatggggcaatgtgctgcagtgccactggtgcactgacaacagccattcacagaccatctgccggcagtgaaatcttcatcccatggagatgagcaagacctgagagcagcatgactgcaaagccattcctgggacaggtccatacggactgtatcagcatcaatggaggagacggagatcatcgaaaggggagtgtgcgtggagatccagattgatctgaccagcaacagtgacgggctccaaggtgggcaaacatgacccatcaagaacacagagatggaagacccatcctacgacctgggccaccaaaatgattgaagttccctgaacaaatagacgaacgagtccacggccggtggaccgtgatcaacacatacgaacaagtgcgcgtggcaaaagaatctccaaagcttgggcccgctcccctcacagcgccgcccgcgagtaacgaacaggctattgggctcccagagaccacgtacgtgcaggtgaccagatgggggagctcatgaaacgcatggggttgtcacaacgatgtccttgagacgagatcgaggtataaattcgaacagggatcatgagacaactcggtacactggagcagtaaaccggacg

SEQ ID NO: 481651 - DNA, 664 bp, Homo sapiens
  misc_feature (31)..(31): n is a, c, g, or t
  misc_feature (71)..(71): n is a, c, g, or t
tagtgtaggggtgtgtttgttggtgtggggnagaaagggaagagaagagaaaaagggctaggcggcgacgnagaccttgtgcatgaataatttgtttccacactacagagtgggtaataagcagattagtaaaaacaattctgcttcacttcaataacagcctcctccaactcattttttctcaacaaacttatttttccagcagaagaatcccagacttcttagagaacccagtgactttttgcaccttaaatctgtgaaatcctcatgttttcttctgccgtatccatagttcaaacaaagatgaggcaaagctagacgcattcctgaaggaacccaagaaattcctctctttctctctctggaatgaaatgaattctctagaccaccagttctaaccttcaaaaaccaaacctgtttgtgagatctccttcaaatactactgtagaccccagtgtttattcattaaattttttaaatatttgttttatttggaatcaaagtatttgtaattttagtatttgtattaatatcagggagaaatgtttaaatctgtctatgccatatgtgcctctggcttattgcccaattaattgtagcctcaggctaaactttggtttctgtctttaatttttgtcagaagaaatataactgatctcaaaac

SEQ ID NO: 481652 - DNA, 1397 bp, Homo sapiens
  misc_feature (322)..(322): n is a, c, g, or t
  misc_feature (346)..(346): n is a, c, g, or t
  misc_feature (380)..(380): n is a, c, g, or t
  misc_feature (390)..(390): n is a, c, g, or t
  misc_feature (399)..(399): n is a, c, g, or t
  misc_feature (404)..(404): n is a, c, g, or t
  misc_feature (428)..(428): n is a, c, g, or t
  misc_feature (447)..(447): n is a, c, g, or t
  misc_feature (552)..(552): n is a, c, g, or t
  misc_feature (556)..(556): n is a, c, g, or t
  misc_feature (580)..(580): n is a, c, g, or t
  misc_feature (602)..(602): n is a, c, g, or t
atagataaagaaaatacatagctgttccagaaaacagaaatggataatttcatgaaccaaaagcagagtaatatactttagaaaggaagcaggctggaagacccacagttgcaaagcaaatagaatttccaactgcctcttgtagccccttcctggaagtagtcacagcccagggtgttcaacttcttcctctgtttttgtttgtttgttgtttgcttttctgtggggtttttgttgttgttgtttgctttttaaaaaaaatccctttccctgctttttgtcacagcagccttgtcacttcaaacaccgcaagtgttctttnaaaaaattatatcaacctttcaantaaaatgcaacatgtctgaaacttggtatctggngaggtgaganggacaaagnagccnttgttactgcacgttttcattctncaaacttcaccttgcacanagtaacagacaatgcacaaagccacttccttatggacggaaattctgaaatccttttatgcctggcctttccatccttcatcttcccctctcccatgctgtgaangatngtattggacatttttgttttaatntcagtgacaggggaacacaggnagctctaatatagctgtgacccagatgcttctgtttctagcatgtatttattttgcagcaaacatttacatccatgatgtttcactgtcttttgaaaataattaggcaatatctcatctgaggtaggatgtttctaggggttgtgttctgagggaggaaaactaatctgttctctttccactgcattctaggaacagtaagaggaccttgtgcatgaataatttgtttccacactacagagtgggtaataagcagattagtaaaaacaattctgcttcacttcaataacagcctcctccaactcattttttctcaacaaacttatttttccagcagaagaatcccagacttcttagagaacccagtgactttttgcaccttaaatctgtgaaatcctcatgttttcttctgccgtatccatagttcaaacaaagatgaggcaaagctagacgcattcctgaaggaacccaagaaattcctctctttctctctctggaatgaaatgaattctctagaccaccagttctaaccttcaaaaaccaaacctgtttgtgagatctccttcaaatactactgtagaccccagtgtttattcattaaattttttaaatatttgttttatttggaatcaaagtatttgtaattttagtatttgtattaatatcagggagaaatgtttaaatctgtctatgccatatgtgcctctggcttattgcccaattaattgtagcctcaggctaaactttggtttctgtctttaatttttgtcagaagaaatataactgatctcaaaac

SEQ ID NO: 481653 - DNA, 316 bp, Homo sapiens
accgccgctatccggtcaattatgctaatatttttggctgttatattttgtgattctgtaactctacagcactatcagatggcatgaaggacaagataaacttcacgtacacaatgggcacatataaaccatcaagatgcagtctaaccaactgatgtcccattgtcctggttcttcccagaagctggaaggtttccacagccaagatcagttaggcttaactagggcttcagctccttaactgttatttgcttaggcatgatcagctgagtcagcctggccttaagtaacttttaaaattgaaccggatagcttg

SEQ ID NO: 481654 - DNA, 162 bp, Homo sapiens
agctcgactctagagttatccccgcgctgggcctccatctctgcttgcacagaatctttcgcactactcatgctgtttcctcaaagaagctttgttttttgttaacgtattactcagagtcacccccagcctcttgtgctgacgggtgaagagtgggacggg

SEQ ID NO: 481655 - DNA, 1046 bp, Homo sapiens
  misc_feature (322)..(322): n is a, c, g, or t
  misc_feature (346)..(346): n is a, c, g, or t
  misc_feature (380)..(380): n is a, c, g, or t
  misc_feature (390)..(390): n is a, c, g, or t
  misc_feature (399)..(399): n is a, c, g, or t
  misc_feature (404)..(404): n is a, c, g, or t
  misc_feature (428)..(428): n is a, c, g, or t
  misc_feature (447)..(447): n is a, c, g, or t
atagataaagaaaatacatagctgttccagaaaacagaaatggataatttcatgaaccaaaagcagagtaatatactttagaaaggaagcaggctggaagacccacagttgcaaagcaaatagaatttccaactgcctcttgtagccccttcctggaagtagtcacagcccagggtgttcaacttcttcctctgtttttgtttgtttgttgtttgcttttctgtggggtttttgttgttgttgtttgctttttaaaaaaaatccctttccctgctttttgtcacagcagccttgtcacttcaaacaccgcaagtgttctttnaaaaaattatatcaacctttcaantaaaatgcaacatgtctgaaacttggtatctggngaggtgaganggacaaagnagccnttgttactgcacgttttcattctncaaacttcaccttgcacanagtaacagacaatgcacaaagccacttccttatggacggaaattctgaaatccttttatgcctggcctttccatccttcatcttcccctctcccatgctggaccttgtgcatgaataatttgtttccacactacagacagaagaatcccagacttcttagagaacccagtgactttttgcaccttaaatctgtgaaatcctcatgttttcttctgccgtatccatagttcaaacaaagatgaggcaaagctagacgcattcctgaaggaacccaagaaattcctctctttctctctctggaatgaaatgaattctctagaccaccagttctaaccttcaaaaaccaaacctgtttgtgagatctccttcaaatactactgtagaccccagtgtttattcattaaattttttaaatatttgttttatttggaatcaaagtatttgtaattttagtatttgtattaatatcagggagaaatgtttaaatctgtctatgccatatgtgcctctggcttattgcccaattaattgtagcctcaggctaaactttggtttctgtctttaatttttgtcagaagaaatataactgatctcaaaac

SEQ ID NO: 481656 - DNA, 103 bp, Homo sapiens
tgttagcatcatgtagttgccttgccctaaacgtcatacaggtatcatattagactcatcaggtagatgcccacctgatgatgaagaggtcatcgtcgacgcg

SEQ ID NO: 481657 - DNA, 574 bp, Homo sapiens
  misc_feature (28)..(28): n is a, c, g, or t
cagagtcatgtggtggcctggacattgnaagggagagaagtggatttgggagacattttagaggaacagtaagaggaccttgtgcatgaataatttgtttccacactacagacagaagaatcccagacttcttagagaacccagtgactttttgcaccttaaatctgtgaaatcctcatgttttcttctgccgtatccatagttcaaacaaagatgaggcaaagctagacgcattcctgaaggaacccaagaaattcctctctttctctctctggaatgaaatgaattctctagaccaccagttctaaccttcaaaaaccaaacctgtttgtgagatctccttcaaatactactgtagaccccagtgtttattcattaaattttttaaatatttgttttatttggaatcaaagtatttgtaattttagtatttgtattaatatcagggagaaatgtttaaatctgtctatgccatatgtgcctctggcttattgcccaattaattgtagcctcaggctaaactttggtttctgtctttaatttttgtcagaagaaatataactgatctcaaaac

SEQ ID NO: 481658 - DNA, 567 bp, Homo sapiens
aagggagctgaaatgggataatcgcttgagaccaggaagtcaaggctgtactgagccttgactgggccactgcactccagcctgggtgacagaatgagaccctgtctcaaaaaaaaaaaaaaaagggaaaattattagggataaagagtgggcatttaaatatgtgagaagggggcaattatccaaaaaacattaataatttcttaagtttatgcaggtaacacagcattctaaatacattgagacaaaaattttataaaactgcaagaagaaattaatcaaattttaatattatttaataatattttgggagatctcaacatcccttatattaattaacagctaatttcaacaagcagaaatcagggaaaaaggttcaactgaattagcactaacaattgaacagggatctaactggttcaagtaggcgagcagaaattaatttaattcaagttaacagccgagaaattacattatttccttcttcagagtttataatatgtggggaaccttatatgtggcaaaattagaaacacacaaatttgcgtgggggggctgttggaagag

SEQ ID NO: 481659 - DNA, 575 bp, Homo sapiens
  misc_feature (14)..(14): n is a, c, g, or t
accataaacaacancacaataacctagaaaatcccgattcgctatcaataaaaaaatttttcacggacacaagaaggaccttgtgcatgaataatttgtttccacactacagacagaagaatcccagacttcttagagaacccagtgactttttgcaccttaaatctgtgaaatcctcatgttttcttctgccgtatccatagttcaaacaaagatgaggcaaagctagacgcattcctgaaggaacccaagaaattcctctctttctctctctggaatgaaatgaattctctagaccaccagttctaaccttcaaaaaccaaacctgtttgtgagatctccttcaaatactactgtagaccccagtgtttattcattaaattttttaaatatttgttttatttggaatcaaagtatttgtaattttagtatttgtattaatatcagggagaaatgtttaaatctgtctatgccatatgtgcctctggcttattgcccaattaattgtagcctcaggctaaactttggtttctgtctttaatttttgtcagaagaaatataactgatctcaaaac

SEQ ID NO: 481660 - DNA, 191 bp, Homo sapiens
cgtggtcaggcactgaacgcctggtcatggcactgccgcctgatcaggcactgaggcctggtcagtgcgctgaagccgtggtcatggcactgacagcctggtcagtgaactgaatgcctggtcagtggtgtacagtgacatggcgtgtgggtggcatgcaactactggtattacgggacgtggcactgttg

SEQ ID NO: 481661 - DNA, 232 bp, Homo sapiens
cccccccccccccccccccccccccgggggaatcccgggggggggttccccccccaaaggggggtttttaaagggggttttgggcccccgcctttaaattcccatgggggttttttggggggaaaatttttttttttgggggggttttttttttttttttttttttttttttttggggttttgggggtttttttttttcttcccaaaaaaaacgttttttggggcccgccca

SEQ ID NO: 481662 - DNA, 134 bp, Homo sapiens
atgtgccggtgctgcatccggtggagtagacatcccctcacattccacaggccatggactcactttcgtaacaaactcctaccaacactgacccaataaaaaaaaatgtgggttttttttttattttttttttt

SEQ ID NO: 481663 - DNA, 506 bp, Homo sapiens
  misc_feature (493)..(493): n is a, c, g, or t
  misc_feature (498)..(498): n is a, c, g, or t
  misc_feature (502)..(502): n is a, c, g, or t
  misc_feature (504)..(504): n is a, c, g, or t
ggggaggtcgtctagaggtccccgagtgggtccctgcagctttatgaaaataatctccgagataaaaacaaacccgctagaacatattacgatgacatgcttgtttcatcaggtgaaaaatgtccattttgtggtgatataggacagacaaaaaatatagatcattttcttcctattgcacattatcctgaattttcggtgatgcctattaatttagttccatcgtgccgcgactgcaatatgggagagaaaggtcaagttttcgcagtagatgaggtacaccaagcgattcatccctatatcgacaaggacattttttttcgtgagcaatgggtatatgcaaatttcgtttccggaactccgggtgctatcagtttttatgttgaatgcccggcgaactggaggcaggaagacaaacacagagctcttcatcatttcaagctattaaatattgctaacaggtatcgtttggaggcagggacccactcggggncctcnaacncncc

SEQ ID NO: 481664 - DNA, 998 bp, Homo sapiens
gattcggagatggtcttggagagtatccaaaaggggtgtgtgtgtgtctgtagtgtgtgtctgtgtgtgtgtctgtgtgtgtgtctagtgtgtgtgtctgtggtgtgatgtctgtgtcgtctaaatatttgatgacaaataccatggtacatgtacgcacccagtatcctatccagtataacatattcttgtctctaagactcatctcaagccagcttggcatcggtaagcgaacagttagtcttaacacaggataaaacgtgcctactgataagggaccttaataatatttcctacagaacaacgcaagaacatgagaggaacaggggtacgtgtgatcactagtcatctcacgtactgcctatgtccaagaaacatacgagcctggtactgagtagacgaacaaataggttgccgtatggccaatactccatgatgggctgatgatcacctaagtgtggtgctaaacaaggtgagcctggactggcgaagagttcacgctttactcgctagacgaaaatcccacttggtagagacgtgaagaaacttcgactggagagtggcatagagacgacgagttgaagccaccgtctagggttggtgaggtggcagatatacaacgtcttgccacacttgggaattgcgttgtgcacgaataggcacgtgaagcgtatgccaagtcgctaattcccccttagagaaacggcaacagggtgcaaggtacggcgctgagcgagtcacacggaaggaaagagacaaatggatgcagggtgggtccattgaaacgaacaaggaaacccaaagaggcattattatccctatggggtcgagcagtataaattccagacacgaaaaatccacgaaagaaaaaactccgacatagaaaacggaacagggtcacaaccaataatggaacaggccaaccttttcacaaaaagcacccacaaaagatccaccttacaaaaaaccacaagcaagcgaaaaccccttacccctag

SEQ ID NO: 481665 - DNA, 423 bp, Homo sapiens
gagccttgctggtgcccgtctgcgcctggcgatcatgtcgtgaccggcgaggatgatcgggatcgattgttgctgaatggcggacggctcttcgtagccggtcgccagaacggcagcaacaatattcggattaagatcgagagcggcgaagccgccggtttcctgggtcatgggtctgcctctaggtgcatccgcaaagacccatgctccaaagctgcacatgccttgaaagaccgtcaggtcacccaggcagctttggcggtggggatttgcgaaaacgattgaaaaagaaaacgtgggaaggtccgcctagcggacgtgcagccgaagctggactcggaggatttgcaccacctgattttgaggtccgctaaaagaccggcgcgtactatacccgaaatcgtgcggggacgtgaggaatat

SEQ ID NO: 481666 - DNA, 135 bp, Homo sapiens
ggtgccgcccgctatctccaaatcggactgtacttactagctgagatttgcatttgggcagatctgtagtgccatgaagcgattctgtgtattgagttcgcaacggctaacctgggctgatcgggaacaagcgcg

SEQ ID NO: 481667 - DNA, 1062 bp, Homo sapiens
acaaaatgattgctgttgagcgtcttaggtggcagggctgttccctccaggccaatgcccgttcaaaccgacgatcattgtgcccacattaccctgggctggagagttggtttcaggttcctacaggagatagctttctttcccttactccctatctaacactttggctctgcaggcagccttgcccattctctaacggcctggcttacgaaggcagctgggaactgtcctgtagagagacgatcctagatagggtcatgcacagtgacgaaaccgacatctgacggaacaactggacacgacctaaggcagaccaggacacggaacgcacaacagacaagcatggggtcagacccataaaccacctcccaaaggctgtcatttcattggcactggaattttgctttatcagaagcaaggaagtacgggagtcattagccttgggcctgggaatctaagtgggagacaatataaattaggatccgattaattggcgattactaacatgtggaccaaaacgtttatctttagcacaactcaataaacaactggcatataatatagtcaaattacgagcataaccaatattgctagaggttggcactgttagtctaccagaagcgatacttttcaggcactttacgcacaatatccttaaagaagccgcgagtgcatgggctaattatcatcaatctccatgtacttgtcaaggacacatctacaggatcttatcgcggacctatatgaagacctaggaggaggtactaccttatgtccttgcaaactactacaggggaattctatatgaaaaaaagaagtatacaaaaacagacaaaccaagacacgcagcagcgagcacacaaagacaaagcggcagaccaacaacatacaaaaacaaaaaagacgacacagacacacacgaggcgaagaacgagagaacacacggagcagaacaggagagcaccacggagagagacacagcacaagaagcaaagacaaagaccgaagaacagaaaagcaagaaaacagcgcacagaagaagcagaaagagaccaatagaag

SEQ ID NO: 481668 - DNA, 243 bp, Homo sapiens
tgctgtgcgtgagagtaacagcgatctgcagtcgatggacacggtgctccatgagcatgtcagcactcgcatatctgcactgtttatgacatttagcagatctatgtataggtacagaacaaggggtttcgttaaactgtatcacatttatacttgcagaaatttatttcattgttcattagtcaggaatttgggttggttcaataaaatgggcaaaactgcaacacccaaaaacacaaacac

SEQ ID NO: 481669 - DNA, 4050 bp, Homo sapiens
gcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcacacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccatccaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccgagagttctaaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatcatttactgtgtgatcttcagtaagtctctcaggctctctgagcttgttcatcctttgttttgaaaaaattactcaaccaatccattacagcttaaccaagattaaatgggatgatgttaatgaaagagcttcgccaattaagaagggccatgtaaatgtgggtaacctgattgttttgtcaaaaatgctaaagcggggtggggggtggcgcagtggcttatccctgtaatcccagcactttgggaggtcaagacgggtggatgacctgaggtcaggagtttgagaccagcctggtcaacatggtgaaaccccatctctactaaaaatacaaaaatttgccaggcatggtggcaggtggctgtaatcccagctactcaggaggctgaggcaagagaatcgctggagcctgggaggcggaggttgcagtgagcagaaatcttgccactgcacaccagcctaggcgacaagagcaaaactctgtcaaaagaaaagaaaagaaaatgctgaaggagttactcagggtcaagaaagttttcagaatgtccgtaagataacatcatcatgggacactacctgttgctgggtgctctgcggcttttacactgatgctgattgtgtgagatccagaaaaagaaaatggagttctacatgcccatctcacagcagggtcatcaaatcctgctagtgacacagaagctgacatccagctcccacccgccttcctcccaggttcggggagcaggtagagtgggagccattaggtgggctctgccagtgttgtcatagagtggcaagtcctccatgggatgggagtggcatgtgggagccttctgcatcatgcactatgaaaaaagaaaatttactatggggcaagtggttcatatagttaagtgattgtatatatatatatatatatatatatatatatatacactatggggcaagtggttcatatagttaagttgattgtatatatatatatatatatatatgtattccagtgtagaaagtattggctgggtctgtaatcaagtattccacagaagtgccttcataggtgctgaaacaggattatgagagtgacagacacaggactgaagacagggagaaaatgtgcatggctgtgagaatatattgctttgattctttgacttctcatgatatatgaaaacaaataaagtgggggggggtgacttcaataatatcacgaacatatttaaaatgaaattctgagcatggagaaaaatttcaaattctggtataaacaaataatctaaaaatatagataaggaaaaaatgttttcatttttttggtcatattgatttgggtcatatatgattgaccaaaaaaaaagatatttctaaaatcctggtgctttttcatttaaaaatagacaaccaaagaggaaaatgaacaatgatggaaattcgtggaagaggaaactaaaatggcaaaatagcatattaaatggcactgagccttggtgtgatcaaaaaaaaaaaataaagcaaaatgagata

SEQ ID NO: 481670 - DNA, 4003 bp, Homo sapiens
gcactcaagcagagaagaaatccacaaagactcacagtctgctggtgggcagagaagacagaaacgacatgagcacagcaggaaaagtaatcaaatgcaaagcagctgtgctatgggaggtaaagaaacccttttccattgaggatgtggaggttgcacctcctaaggcttatgaagttcgcattaagatggtggctgtaggaatctgtcacacagatgaccacgtggttagtggcaacctggtgaccccccttcctgtgattttaggccatgaggcagccggcatcgtggagagtgttggagaaggggtgactacagtcaaaccaggtgataaagtcatcccgctctttactcctcagtgtggaaaatgcagagtttgtaaaaacccggagagcaactactgcttgaaaaatgatctaggcaatcctcgggggaccctgcaggatggcaccaggaggttcacctgcagggggaagcccattcaccacttccttggcaccagcaccttctcccagtacacggtggtggatgagaatgcagtggccaaaattgatgcagcctcgcccctggagaaagtctgcctcattggctgtggattctcgactggttatgggtctgcagttaacgttgccaaggtcaccccaggctctacctgtgctgtgtttggcctgggaggggtcggcctatctgctgttatgggctgtaaagcagctggagcagccagaatcattgcggtggacatcaacaaggacaaatttgcaaaggccaaagagttgggtgccactgaatgcatcaaccctcaagactacaagaaacccatccaggaagtgctaaaggaaatgactgatggaggtgtggatttttcgtttgaagtcatcggtcggcttgacaccatgatggcttccctgttatgttgtcatgaggcatgtggcacaagcgtcatcgtaggggtacctcctgcttcccagaacctctcaataaaccctatgctgctactgactggacgcacctggaagggggctgtttatggtggctttaagagtaaagaaggtatcccaaaacttgtggctgattttatggctaagaagttttcactggatgcgttaataacccatgttttaccttttgaaaaaataaatgaaggatttgacctgcttcactctgggaaaagtatccgtaccgtcctgacgttttgaggcaatagagatgccttcccctgtagcagtcttcagcctcctctaccctacaagatctggagcaacagctaggaaatatcattaattcagctcttcagagatgttatcaataaattacacatgggggctttccaaagaaatggaaattgatgggaaattatttttcaggaaaatttaaaattcaagtgagaagtaaataaagtgttgaacatcagctggggaattgaagccaacaaaccttccttcttaaccattctactgtgtcacctttgccattgaggaaaaatattcctgtgacttcttgcatttttggtatcttcataatctttagtcatcgaatcccagtggaggggacccttttacttgccctgaacatacacatgctgggccattgtgattgaagtcttctaactctgtctcagttttcactgtcgacattttcctttttctaataaaaatgtaccaaatccctggggtaaaagctagggtaaggtaaaggatagactcacatttacaagtagtgaaggtccgagagttctaaatacaggaaatttcttaggaactcaaataaaatgccccacattttactacagtaaatggcagtgtttttatgacttttatactatttctttatggtcgatatacaattgattttttaaaataatagcagatttcttgcttcatatgacaaagcctcaattactaattgtaaaaactgaactattcccagaatcatgttcaaaaaatctgtaatttttgctgatgaaagtgcttcattgactaaacagtattagtttgtggctataaatgattatttagatgatgactgaaaatgtgtataaagtaattaaaagtaatatggtggctttaagtgtagagatgggatggcaaatgctgtgaatgcagaatgtaaaattggtaactaagaaatggcacaaacaccttaagcaatatattttcctagtagatatatatatacacatacatatatacacatatacaaatgtatatttttgcaaaattgttttcaatctagaacttttctattaactaccatgtcttaaaatcaagtctataatcctagcattagtttaatattttgaatatgtaaagacctgtgttaatgctttgttaatgcttttcccactctcatttgttaatgctttcccactctcaggggaaggatttgcattttgagctttatctctaaatgtgacatgcaaagattattcctggtaaaggaggtagctgtctccaaaaatgctattgttgcaatatctacattctatttcatattatgaaagaccttagacataaagtaaaatagtttatcatttactgtgtgatcttcagtaagtctctcaggctctctgagcttgttcatcctttgttttgaaaaaattactcaaccaatccattacagcttaaccaagattaaatgggatgatgttaatgaaagagcttcgccaattaagaagggccatgtaaatgtgggtaacctgattgttttgtcaaaaatgctaaagcggggtggggggtggcgcagtggcttatccctgtaatcccagcactttgggaggtcaagacgggtggatgacctgaggtcaggagtttgagaccagcctggtcaacatggtgaaaccccatctctactaaaaatacaaaaatttgccaggcatggtggcaggtggctgtaatcccagctactcaggaggctgaggcaagagaatcgctggagcctgggaggcggaggttgcagtgagcagaaatcttgccactgcacaccagcctaggcgacaagagcaaaactctgtcaaaagaaaagaaaagaaaatgctgaaggagttactcagggtcaagaaagttttcagaatgtccgtaagataacatcatcatgggacactacctgttgctgggtgctctgcggcttttacactgatgctgattgtgtgagatccagaaaaagaaaatggagttctacatgcccatctcacagcagggtcatcaaatcctgctagtgacacagaagctgacatccagctcccacccgccttcctcccaggttcggggagcaggtagagtgggagccattaggtgggctctgccagtgttgtcatagagtggcaagtcctccatgggatgggagtggcatgtgggagccttctgcatcatgcactatgaaaaaagaaaatttactatggggcaagtggttcatatagctatggggcaagtggttcatatagttaagttgattgtatatatatatatatatatatatgtattccagtgtagaaagtattggctgggtctgtaatcaagtattccacagaagtgccttcataggtgctgaaacaggattatgagagtgacagacacaggactgaagacagggagaaaatgtgcatggctgtgagaatatattgctttgattctttgacttctcatgatatatgaaaacaaataaagtgggggggggtgacttcaataatatcacgaacatatttaaaatgaaattctgagcatggagaaaaatttcaaattctggtataaacaaataatctaaaaatatagataaggaaaaaatgttttcatttttttggtcatattgatttgggtcatatatgattgaccaaaaaaaaagatatttctaaaatcctggtgctttttcatttaaaaatagacaaccaaagaggaaaatgaacaatgatggaaattcgtggaagaggaaactaaaatggcaaaatagcatattaaatggcactgagccttggtgtgatcaaaaaaaaaaaataaagcaaaatgagata

SEQ ID NO: 481671 - DNA, 740 bp, Homo sapiens
  misc_feature (344)..(344): n is a, c, g, or t
tttatgctgatcatatgcataacctataatctcacaattctacttctaatggtatacccaataggaataaatacctacctgtaccagaagacatggtcaaatatgctcataacagcattaactggacaggacaaaactgggggaaaagacataattggcccttaaaagtaaaatgcattaattaactggactatgctcactcaatggaatattctattaccattaaaaaggaagaaagtgctggtattcacactatcatgagttaatctcataaacatgtggttcaaaagtgtaacacaaatgtgaaggtatgccgaatgaggccactcttatatagagcacanatgtgcgcaacagagctatatagcgctggaattataggatttggtaccactctagagaggaatattccctgtgatagaggtatatgagggatgaggagtttattatgaacactactaatattataattgttgatcggggggaaaatcccattactgaaatttctatgccgcgtggtctaactttaggacgtctttttttagtgattgtcctcttaaataattttgttaaaaaatatatttgtggcgttatttgttcatgcatgcttctatttttatgatgattttttagaaggggaatactgtgagttgtgctaactctttttgtaataacctcctgcgattgtactttcatggagggttttgtctattggttatggcttttattccctctttgcg

SEQ ID NO: 481672 - DNA, 451 bp, Homo sapiens
tccataatgtgtgcccgttcccgtcgaccacccaagggctgaggaatgcgagcgcacggacaggactggcaggcagctccaactgtagccccggtgcgggatccactaggtgaagccagctgggctcctgagtctggtggggacgtggagagtctttatatctagctcagggattgtaaatacaccaatcagcactctgtgtttagctcaaggtttgtgagtgcaccaatcgacactctgtatctagctgctctggtgaggacgtggagaacctttaagtctagctcaaggtttgtaaatacaccaatcagcaccctgtgtttagctcaaggtttgtgagtgcaccaatcgacactctgtatctagctgctctcgtggggccttggagaacctgtgtgtcgaaactctgtatctaactaatctgatgggcacacattatggaggggtaccg

SEQ ID NO: 481673 - DNA, 128 bp, Homo sapiens
cagcggaactatcgcagattctcatataacacattccccgcatccccttcaaacacaatcccctctactaaaatcacagcctcgctgtcctttcctatgacttctaacaccctagacctcactaggta

SEQ ID NO: 481674 - DNA, 132 bp, Homo sapiens
cacgagggcgaggcagcgttggtctatgtctcttggttctgcggcacatgacggacaggacgcttcagcctctctcattactgcggcgcggggcaaggtgtgagggaggaaatgggcacaggcacccccgcg

SEQ ID NO: 481675 - DNA, 317 bp, Homo sapiens
aaagcttatagtggcctcctttggaggaatagaagtggtcttatcaaattgaactatattaaaaagcaccggcttaccatctttttcaaaataaagagaaggcagcagtacgaatctttcatcatattgtgacaaacaccccctgattaagaacatcagggacgcaatataagcgccgatcactagaaaaccaccaaaaacaagctttctcataaatagctttttgcgaaaattaggtacactccatctaatagaataagatagctagccaacggcaggaactaattattaatcggcctttttttacttgtataacg

SEQ ID NO: 481676 - DNA, 1308 bp, Homo sapiens
acgtggtgcggtcgtgctgcgttctgttgctggttttgtggggcgtttgggcggtcgcggtgtctgcgtgcgtgtggttttgtttttgggtgtgtcgcggtgtggtgtgggggtgtggggtccgtgggcggctgttgacttcggttggttttgggtggtgggggtggggtggaggtgggagggtgtcttgcttggggcccgtgtggctcgttaatcgcgtttggggctgtgctcgcgttcgctgtcgtcgtgttgcgcattgcggtgtcgcttcggtcgggtccgtgtttacggggcgtggggcgcggtttgtgcgttcggtgctggtggtcggtgtgggtcgctgctggggcttctcggtgtcgtggtggtgctagggggttgtggcgtggccggggggtgggaggtgccgtctcatcttccgggtcgttgtgtggcccgtcgttagtgggggggtgtgcggttgttcgcgccctgaactcgatcgtgtggcggcttagtgtcctgggaggacgggctggtgctggtgcggtaggtgtggatagggccccatgccgctgcagtgcgctctatgtttagcggtggttatagtctcgcagtggtggcgagggggactgcagtgtcaggtgcccgtgcccgctgcttatctcccgtgctggtggcggtctgttcgccgccccgtagcttgctggcgtgtcaggtgatgccttagtgggagttgccctctgtggtctcttgtgatgtcttgtcccgctgttagagcgagcctatgcagtttaactcaatcctaagggcctcctaaggccttggacaactgcatggtagctgcactctaggagaaggaggggatatccagatgtttagattcaggggtagggtagtacggagtgtccctccctgtctagtgcctagcccagcctgtgatggcagccttcttgtatgtgctctggcccacgcttctcgcctagttatccatggggtaggtctctgtaggcttcagttttactgctgctgcatataatgaatggcgggcctgcaatgccgactacacctacggagtgctgttgaggactaatttcattcctattaatattaaaataatactgatctggcttggcaggtcaggtgccatgtctgggaacagggacgggggagcttcacctgttttgtcttggctgttctttgggctgtgggtggggcatccattgccagggtcggggaggaaataccaaatgcattgttgttctgctcaaaccatctcactgtttctatgagagctcgggtgttgtgtgaggtggtctggtgggg

SEQ ID NO: 481677 - DNA, 315 bp, Homo sapiens
  misc_feature (73)..(73): n is a, c, g, or t
  misc_feature (137)..(137): n is a, c, g, or t
  misc_feature (162)..(162): n is a, c, g, or t
  misc_feature (296)..(296): n is a, c, g, or t
ggttattcctagggtaatacaactgctcttcaaagaaattgataaacagagtgcactttgaatttactctganagtgctcttacttagagatttacaatgaagaaattttggatcttctatgcccatctcgtgcganagctcaaataaatatacgcagcggntcctagggcggcataaagcttgtgcgcggctgcagctgcgcaggctgttttgcgcttgcgcttgcggtcactgtttgcctgtttgggcaccggggcaacaactgctgggcactgtgcggcctgccgacggcctnatgcaactgcgcccgtgcg

SEQ ID NO: 481678 - DNA, 171 bp, Homo sapiens
gcggcgtagaagcgattagcagcaaagctttgcgacaccctttacgaggcggttcgggaaggtcctcacgggaaccagcgcaagcccgcaagttcctgagacggttgagttcagatcagccttagaccattgatcccagaggacaaggccctttgtggcaccgtagcttag

SEQ ID NO: 481679 - DNA, 959 bp, Homo sapiens
gggagaccatgggcttccaggcttgcagggccaccccggccaccagggcatccccgggagatgttggcctccagggaccaaagggaatgagaggcctggagggaactgctggtcctgcctggtaccccctggcccctaggggtgttccatgggcatggcaggggcctaggggctactagtggagagcgaggaccgtccagggacctgtggtggcccaacaggactgccgagggcccagaaggggaacgacggagagacagggcgagccgcgatgtccctttgaccactcactcttacctagcgttgtgagccatggctcatgtgatgtcgtggcatttcagacgacgacgtgtcaaaacgttcagagtcctttccaccgagaacatcgaggccgccccatgcgccatcttgtgagccatgaatgcttgcgagcctggtgcgacgtgatgccccgtgagggtcccccttgggcacccagcaagtaatggtcctgtgttgcctggcagaatcgcgcgggcgttggtggcgcggcctacccttgtaggtgcggacggggagccctggagcttgtatggtcgatgatgggtcagcctgtggcgtgcagggggcgtatgcacccaggccgtctggagagtgacgaggacatttgttctgcactggcccgaggaacgctgagccttcctccctgggttagtctggacaccgtgaggcgacatatcctggagaagccagggatgaaaaaggtcggacgagcctgtgcttgttggcatggccacggaacctagggcctcgtgcaagggtcaacccgataatcttggagtctggcgcatttcccaagtttcgcgacattttaaccgcccttttgatttgggtcttttggcacccacaaggaatcgtgagcactagcgagcacatagatacgtacctgcgaaaagtaacacaaaccaaaaacaaagcgg

SEQ ID NO: 481680 - DNA, 142 bp, Homo sapiens
acagatagctgcctcagtgggtagcttgtcttttctctctcctcatgatgtccataattttaagaaggtctcctatttccagaacgccaatctgaatggccaacgcaaagcaaagcgagcttccccagtatggctcagcgct

SEQ ID NO: 481681 - DNA, 126 bp, Homo sapiens
tgtcaaatgaagcagcacagtgcaagaggaaggacaagatagaaagggtagcatactgattggaaagcattatgaaaatttagttgaaagtgcattgaaggaagagtaaacagagaagaaaaaggc

SEQ ID NO: 481682 - DNA, 293 bp, Homo sapiens
tagtggtaaaatatataattcaagagcacattcggcggacggacaagcaagtatacgagtagcccgctccagtccccggacttaagcaagcatcaagtgagggcggcaccggtccaggaaaagtagggaatgggggtgagagtgtggacaaggtctagggcttaatactaacgagacgccccttgtaatatacatctaatagcaaagaagacgcgggatgcaggctactgagagaaaacaatctacctaggtacctatcccctatcgcatataggcccccctctaagaacttc

SEQ ID NO: 481683 - DNA, 184 bp, Homo sapiens
gcatagacaatcttttgtgctttatcagattctcagtcaatcaatggtgtagctagaaccggggcggcgcgggcgcgtgtcgaagagagagtgcgcgcgccaaaaagagagagatccagagaacgggcatcgccagttgcccggggggccttcactttgcagtcatcatctgtacaaactcttc

SEQ ID NO: 481684 - DNA, 81 bp, Homo sapiens
gtatcccccagacagggcccaggaaagggctctctccgcccatagggggggcccaataaatgtttttggctggctgcccca

SEQ ID NO: 481685 - DNA, 323 bp, Homo sapiens
tactgacgcgctgatcataatccatgattgtggtcttcccagatgtaaattaatactccaactctgaccaatacatgggggcttgtgcctgtaatcccagccctttgacaggaggccaaagtggtgaggatcgcttgaggccaggagattgatactagcctgggcaatgtagtgagacccccatctctacaaaaaattagctggacatggtggcacgtgcctgtagtcctagctacttgggaggatgaggtgagagaatcacttgagccaaggagtttgaggctgcagtaagctatgactgtgctgctgcacttcaacctgga

SEQ ID NO: 481686 - DNA, 710 bp, Homo sapiens
ccttcccccaccctggcttgctcttggtcacagggcggttctgggcacttgaactcagggccgaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggacttggcttgtcctcacccagtcggaactccctaccactttcaggagagtggttttaggcccgtggggctgatctgttccaagcagtgtgagaacatggctggtagaggctctagctgtgtgcggggcctgaaggggagtgggttctcgcccaaagagcatctgcccattttccaccttcccttctcccaccagaagcttgcctgagcttgttggacaaaaatccaaaccccacttggctactcttgcccggctttaacttgaacccaatacctaggcttacaggccatcctgagccaggggcctatggaaaatctcttcctggaggggcttttaggttgggcactataatggcttttcccttttccattttttcttttggagcaatggcacaagccctggaacctggaaaggacctaaggctaaggccttatttcctttccctccttattcttaaccccattgggtccctttcccttttttttggaggtccaggg

SEQ ID NO: 481687 - DNA, 267 bp, Homo sapiens
gacagtggacacaagaaggacgttcgccctgagcacaggtgccaacggtgccaagactggcaggacgtgagggcttgattgtttcatttaggcagttgctgcaggtgtggtctcatggtgccatctgctgctcccttgaccacttttctatgtcctccttccaccccaagtcccggatcactggctgttctctggggagctcttggcatctgccatctgagcctaaagttgcccactggcgccaatagattctgtttgtcctgctga

SEQ ID NO: 481688 - DNA, 148 bp, Homo sapiens
aaaaaaataatatcagctcggtacctttatgtaatgaagcctccataacaacccaagaggcattgggtttggggagcttccagcatagctgaacacgtgaaggttcttggagggtggtgcatctacggaggacgcagtgacccactcg

SEQ ID NO: 481689 - DNA, 432 bp, Homo sapiens
ttcttgtctagcataaaagccctggctcttaaaggctggcaacctttaagatgcaaatgcaagagggtccacccaacatggcgattcccaccgttgtcctcttgcccttgctccatcaggtacctaacagcatggccgcccccacataaccccgtgtgtaaaatgtcatggcatcctgcatttgtgtattaaaggactggggtgggagggccagttttcttgagggctaaatgacatgcctggtcaaaccaatcctctgagccctatgcaaataagacaccaccccctccagccgtcacataaaactggctagtattgtcagaatgtaaggtctcctctttcagctttagagcccccctccctctgtctgtgtaagggggagcttcttccttctgccttctcccttcaagcctactaaacgctctgctcctt

SEQ ID NO: 481690 - DNA, 939 bp, Homo sapiens
ctcccccggggccctatgttcagcccttctccccggggtcttttaccctatgtgcccccgcggggcgcgagatatcactgttgggttccccccccgcgggacccaccctttttgtgccccctttgggccccctctcttttaggggggcacaccccgttttggaccccacattgttgtcgccccacaagactccgcgggtggtgtcccgcgttccgcggatatttctcccgcgggaatttgttctgtcaccccccgcgcggtttcggggtctcccaccgcgcgttcccccactcaggggccccgcgcttttgtcacccccacaaaccctcgtgagaaaaagggcgcgtcccgcggtgtatattatacattggaaaaagtgttttcaaaacgccgcccccggggggcaccgcacactcttcacacaccgcgagcaacagggcgcgtgtttgcgagggagagagatctcccccctatttctctcccccccaaagaggcgttccccccacacacacaagaataccgcgggtttatgttcccgccacatttgtgttatgaaggcgaaatttctcgaagagaggcgcccgcgaaagagagggaattctcccccacacagccccacagcgagagagagaggagagagagagagaaaagagagagagagaccacacaataaaggttcccgaggggttcacacccccggagacacacagagagagagatttttagaataagagttcctctgagcacctcaaaggaatattttaaaactttttgggacttttggcacactgtttgtgccacacacctcttctcggtgtccctcccccccacacacacttggggagtggatttgtccacaaacccctccgggggcccttttttatattttttttttgatgctgttttattttccaaaaaaattggggccaccacaccaca

SEQ ID NO: 481691 - DNA, 80 bp, Homo sapiens
  misc_feature (7)..(7): n is a, c, g, or t
ggaaccncaatggtttccatttaataatctcaaaaaggagaaaaaaaaaccttgtaaaaaaagcaaaatgccaaacttat

SEQ ID NO: 481692 - DNA, 387 bp, Homo sapiens
ctcgagtaatcttcgtgtatggcgccagttgcttattcatcatagcatgcataggcatttctagtgacatattcaggatctgttccatttaacttctcaccaaacatggtgagctacatggtgcaattgatggggcctgtatcctcattcatcatggcatctagatactcatcagttggattcttccccaatgaagctagcatatcatgcatgtcttccttgtcgatgacaccatatctgttatgatcactcatgttgaaggcctctttgaactcctatatctgtgactggtcatacatagcaaagctcgacatggtggtggttaagtcccggctcagctacgagtttccgagcacctctccgagcccctcgcttccgctatcacac

SEQ ID NO: 481693 - DNA, 1090 bp, Homo sapiens
  misc_feature (370)..(370): n is a, c, g, or t
gagatggtgctggacctcacctacagccccccggccgaggccttctcctgcctgcccccgtacttctctttccctggcgccgctgctccctggacgccggccccgtgcgtcagtgcctgctgtgtgcacccctcgacgtccgcaggccgacctctgcggcccttcgtcgcatccagtggctgcgcacatcaagcttcaagtgaggtgctggactgagcattgcttgcgtctctgcttgcatcgcgtgtggcctgcccttccgagtggtcgcgactgctgggacgggccgctgtgcgagcgtgggggcagctggctgggcggctgttcccgatgcgggctgatgcgtgatccactttcaggcccatccctntcgcccgtgcggcccaaggctccctcttctgaccatcggccctattagcgcgatacatcattgcccctcaatgacgcagagggcacctggttcttcctcctagtgagatgcaagcggagttgcgagtgagcaggcgtgccaaaggtcccgcgtgaaccactatgctcacaagggatgcgcctagggccccgtgtggctcggacgtttgcctttcatggcgcctcacgtatgccctggggcacgcccaaccgttgggtccagtcgccctgagccggggggccccaccttcagtggatcaagcttggggagtccctgtggggcagtttgccacgtggccccctcttcttgatcgcccctcttccgttccccataggttagggacatggggggctacccaggctctgtgcctagcttcttgtggacctttggggcgaaccccatcacagggggcctcaaagtgggcgacccagaaaccccctttgagcaattcccggctgaagaagccccggggttcggtcccccaaaggaaggctttaaggagaacgttccatgggaaaagaggccccaatggtttagcttcaacgcagggcacccccccggcaggttcttcacgtgcgtggaggcttccaccggtgggagcgcgccaaagcagcccccccgttagctttacgatcaactcaacttgccagacagctgtcttgcaccccattcgcaccaccc

SEQ ID NO: 481694 - DNA, 928 bp, Homo sapiens
  misc_feature (926)..(926): n is a, c, g, or t
taactctttcttgtgtttgtaagtagagaacagggtcccccagtgttgcccaggctggtctgcgaactcttggcatcaagcgatcctcctgccttagcctcccagagtacggggatacaggctctttcttttacaaacataaaggttttaaatgggttataactctgtactctggcccttagatggtttatagcttcggttctgtaatcatgagttgggtgggagatattctccatagatgatcttctactgaaatgcctaaagaagtcacaggcgggcttctggtttatcagggattttttttaaaaagtcaatcagaaaggggatactggagcttcttcatgtttgtaacagctatattaaaacgggagacagtgatgaatcagctacaagggtaatatggttttacacatcatgttaagatagcggctttatgtgtatttatatggcatgcttttgtaaaaaacatgctgggtgatgaaagattagtttagagagaaactgtcatctgtgcagaggatgcattttctcattaattctggaaaaaacggttcacgggttatatatactggtatttgcacaaggctattaattggaaccttgtgagaatgagttaatgtacggaaatatttttaaaataggcttaactgtcaattgcaacttttttttagcatacgggtggacaccgggcaagtagtggcccttcttacaaaatttttaggccctttttaaggtgctcatttctgactttggaaagtgtttaccataagggggtattagggtgaaagtgacggagtcgaaagggggagtgaatggtggtgtaagtacggcgtgggggagggtgggttagttagacattgtaaagtgtttgggaggtgtgaagtgctgctatctatatgtgttatgatgatatttattttattggntg

SEQ ID NO: 481695 - DNA, 414 bp, Homo sapiens
ggatgtccgatatgggagagtagaggaggtgagatgtgagatagaagaaatcgtgtaatgtacatgatctcaggtagaagcggatataaaggtagcagtggatgaatagaggggaaagttacctacggtcagaaaagtgctgctggtggtggaagctataaaggccatgtggatatttgggcacctacggttcaagagtgggccgccctttaaagggaggcgcagacatctggccggcatcgtggctaccttcctaaccagctgttcagaaccttctgatttttacatgtactgaataagatttgagtaatgaaagtctgtagtcttaaaactctaaaacagttgtactgcttccaagcagcagtatttatagtaacgtaagctattaatgctaactctcgcatgtcaagaaac

SEQ ID NO: 481696 - DNA, 873 bp, Homo sapiens
gagaaacctgcggaaaatggtagcgatggcgggctgggccgagtgggtgtcgtggttgccgggctgatttgggcgtacaggctagttatagttaggctgcacatgctgcctatcaagcagcgtgctcatgcgtattatggtgagtcaggaagttatgtcagatcgggaagcgcaatagacagtagaagattaaaggcttttatcgtgagtccaactctgctatggcagactactgggtgatcattctctggacgagtctcaaacccatgcgtatctagcataggaatcgcgtggattgcagaggcatgctagtcaggcagggagagctaccaatatggaaagccatataaagctagtatgcgaggtagctatctcttgcacagtttgctggatggaaagattgggcaaggttccctcgaagtcacagagctttcgctctaggagttgataaacaccaataactgtctcagaggactgcatagatcaagtatgtccgttggttcaggacccatgtattaaatgctttggggacgacaatgggatactattgctgatagaactgatgctattcgtcataatgtgaacgacatgacagtgtagtaagaattcctgagtgaagaagttggaatcgcattatataatcttggcttgatattgtggtccgtagtgcctgtgttgttacctgtattcaaatgataatattacagtcaccgtagaacaataatttagttatagctgtgctgccattgatcagtcttttacttgaggcagttaaatatcgtaattaagtcgtgacatggagtatagtccatgatatctaagggagttgggaagcttaaaagaaccattttttataaagtgttcatcctcctg

SEQ ID NO: 481697 - DNA, 870 bp, Homo sapiens
gaagctcagctgtagacgcctgcagtgtgactgtgaatagtaatggatcttccaatatgagtgcaatactaaatcgttgagagacgcctaagtctcagaatacacaattatgttggcactctcctagttagaaagtcatcagatgtaataccacggggacagttgtgaaaccggtgcatcggtagtagactctgccagtgttacagtcccgcgaaagtgcgcctcttgactcaagcaccttgatgacaatcaaaaacaggtttatctagtgtcaaaaccagttcttctcaaggtttactaagaaataagatctatcaagatccatagcatctgaagtggtagccaggcctgcttcattgtctacatgaactaacggctgttggaaacgtcagagcccgttgatcagcgaagaacatactgcacggaaaacgcaattggtgtgatagtagatcaggtcagtccaaagaaaccctcggaagagaagacaagctcgtctgagccgcagtggaaagctggcacagggaacgcagtgctaacacacggccccctaatacagtagttgactcagcatgcagcctgcagggatcgacacattgacaaaaaaccagtgtgatgtctttttgggggataccagtgggcagacaggaatgatgacccaagattattactggaaaaagtacacacatagattttctgaatgcctgacgtggattaatgaggggatgtccaaacagagatttactggtcacatgaatgacttgtttaaatatccaggaggcaagaagttggagctttgggactgtctggatttttggacaagcaagggtttgaaacttttgcgtcttgaaagaattggggggcaggtaaaca

SEQ ID NO: 481698 - DNA, 120 bp, Homo sapiens
tcagacgctgaactatgtggaatccagaactcagtgagtgcaaaccgcagtgacccagtcaccctggatgtcctctatgggccggacacccccatcatttccacatagttcagcgtctga

SEQ ID NO: 481699 - DNA, 503 bp, Homo sapiens
  misc_feature (8)..(8): n is a, c, g, or t
  misc_feature (102)..(102): n is a, c, g, or t
  misc_feature (104)..(104): n is a, c, g, or t
ctcttttnaatatcataatagtgtattgatgtaaaacacgaacagctgtctggcgtacgaacggtgtgagtgactctgcagagtcgccacagtcctcagtgnanctatcagtcagtgcctgtgtggggaacccggggactccgcccaggctccaggcccagtgtggctgacttcaagataaaggcagcggttccttccactcctcctgcttgcccttccagcagaggctctgggccacccaccagcagatgtgccccaggtcctgcaatggctaggaaccttgggagccatcttcctccctctggtcatcctcttccccagaccgtgcgctgcccctagatgaacttgaagcacttggtcttgtcatggggcaggcgtgtcttgaagagcacagaatccaccctgaactgcgtgtacaggaggggcatgtagccgtacaccttcacgaagaagttgatgcacttgtgccgctcgtggaagtgggagtcatcatgagacagggc

SEQ ID NO: 481700 - DNA, 484 bp, Homo sapiens
gatccagacttggtcgagcgccagtctggaactagagctccacacgtcaactctgggacgaccccctgtacatgtagtcgtctcaatagttactggggaatgttcgcagccttcacttccgccccggccccacattttccaaagtcatccatcaacccaggaaaataccaaatctaggtcttacaactagggaagggaaggcaagggactggacgggagagaagaaaggaacgatccgaaagcccaacctccttccagaatgtccatgagaatcttgagcacatatggtccttgcgatgaccacatgacctgccgagccccctttactatgaacctcatccttatattttccttagtatcacaattaatataatatgtcatttctgttaatagtgtcttcttgtcattttactttttaaaagatttcattgacatatacatacaggaaagtgcatctatcataagtgttccacttgatgaattc

SEQ ID NO: 481701 - DNA, 119 bp, Homo sapiens
  misc_feature (65)..(66): n is a, c, g, or t
cacttatccgcttactatctacagcttgagtgcagagatgaagagtcaaatctgaccaagatgtnngatgtggataagagaatctctgctccccacctctaagtggcccgccaatcgaa

SEQ ID NO: 481702 - DNA, 123 bp, Homo sapiens
gcttagggtggttactctgtgtggtactggatttgactggcggaggttcgggctcgcctggggatctcctcagcccatgtacccgccatgtccggagtcaatgtgcctctggcggaaggggga

SEQ ID NO: 481703 - DNA, 215 bp, Homo sapiens
gtccgacttacacctcatctgcgtctgagcttaatactgtgtaagtaacgtaattcgtaactctcatttgctgttagcacctacgcgcaaccagatcacgatagattattacttcttcaaatattaattcggtgagatatttcaaactaccattttggacgaaacggcacctcgagactgtcacgagtgactcttgctcctatgctccatttcag

SEQ ID NO: 481704 - DNA, 269 bp, Homo sapiens
ttttttttttggagataagatcttgcgctgtcctccaggctagaaggctagaggagtgcagtggcaaatcatggcccactgcaacccgaacctcccaggcccaagtgatcctcccaccccagcctccagagtggtccatcatgcctgactaatttttctatttctgtagagacaaggtctccccacattgcccaggctggtcttggacttctgagctcaagtgatccacccgcctcagcatcccaaagtgctgggattacaggtgtgag

SEQ ID NO: 481705 - DNA, 195 bp, Homo sapiens
ctatttttcaggaagatctcgctcccaatcattaacacaggtgagtctgtactgatcgagaggcgcagtgtttccagagggccgatggttgggtccacctctccctctgccactcccttgtagaaggagccgatctggaggtagccgtcggggctccgagggctaccggagcttggtggtgcggcccttccttgc

SEQ ID NO: 481706 - DNA, 119 bp, Homo sapiens
tctcgagcttccgtacatgcagcagacaggattccaggcaaccaggtgtttgatgaagctaggactgagcgagcaagcgatcaagccgcatttcgtggtgaaaattggataagagtcca

SEQ ID NO: 481707 - DNA, 649 bp, Homo sapiens
gaacagcctctggcatgtggaacgtggttggctcagggttgacagagaaaagacaaataaatactgtattaataaggaaaaaaaaaaaaaaaaaaaaaaaaaaaaatttttgggccccccggcgaaaaatttataaacccatttcggctgggcggcgcgcgggaccagagtgggttactgcgaaccggcggtccaagagcgttgctcccgaaggaaaaccgggggccatgcgccataggccggtgggttcctccccaaagataaaaaaaggccggcggcggaaaccggaacggtgttggtgacaaacccaggagtgggcgtccggaaagagccatacggggcttttcaccacagagggggcccaagggaacgcccaatataaaattacgcgcccccgggggggaacataaataaaataactacaaggaagaaaagaaaataaaaaggtaaaatataactgtacagaaaatgtaaaaagaaatagaatcaggaaacaaatcaggaagaaagatataagtaaaatataaataaaagtggaaagtgagaagggagagaaaaagaaagaaagatatataggaagtggaaaacaatagaacataaagaagaaagataggtaaatagaagatagatgaaaaaaagtgacagagaa

SEQ ID NO: 481708 - DNA, 464 bp, Homo sapiens
  misc_feature (72)..(75): n is a, c, g, or t
  misc_feature (217)..(217): n is a, c, g, or t
atacattttagataaatgagatcttgcagccttttacacacagtaggaattcaatatttttatgaggctaannnnaaatcacagaagagatggtttcagaggtagggaagatttaaacaaacatattccaaggaacttatctttgggaatgtctttgcttttccacaaagatattaagcttaaggaaaccttgccatttctgtgctttccgttaagntaattaactaagatgtttgattattatgcatattttgtgatattccaagatacattaacattttcaaagccaggcagtatgctaaggaatttctcaataagtgaacaaagtctaccctgaaatcattgatttcagtcatttagtcactgatccaacccatatactcttacggtttcaaagtcatatggtttaagagaattaaacaactgaaaagaatagtaaatatcacctattaaaattccctcat

SEQ ID NO: 481709 - DNA, 687 bp, Homo sapiens
gggggcattaagagtgttttgggtcatccaatacagatctagattctttaagggaatagagctggttgataaaaactgttgtactggcaaagcacgaagcttagatggacagtatgatgaccgttaaacctaccaatactcatgatcctaattctattaatgaacactttgtaaatgtcccgacaccttatgctgtatcgcctgagagaatgtcatttgatgcgatgactgttctatcaggcattgatgattctgaggaaaactttgaaaaagctaagggtgtccaaatcctagggcttccctgcatactagcccagttctgccactagtggtctgtcttgatggaacttggtacgacgctcttaattaggctatgcacctactatgttatctgatttgtacaatttgcaattcgcagtttacaatcatatttaaatctgcttgtaaacttacagattgaatgcctgagttgttcataaaatgcctaattatgagacatttattctaaaatgtaatcgaaaatccgcgttaggtggagaattcccaaaatcttatctgaaattctcttcttaggtacccttactggtatatgtcaataggccttctttggatgcggccttttcgagaacgactttttaaaccttctggtgactaggtacctgactttcattttttcgatggccccct

SEQ ID NO: 481710 - DNA, 834 bp, Homo sapiens
ccactgaacatctggtgtcgccatgggacgacgcccgcccgttgttaccggtatagtaagaacaatccgtacccaaagtctcgcttctgccgaggtgtcactgatgcctaaattcgcatatttgacctggggcgcaataaggcaaaagtggatgagttcccgctttgtggccacatggtggtcacatgaatatcatgcatctgtcctctgtagagccctgtaggctgcccgaatttgtgccacattcacgtcatggtacaaacatgttgtggacaaagagtggtcttccaatatccagtggctgtcggctccagccctcgttccacgtcatccgcatcatgcccagatgttgttctgtgctgctcgagcatgacgaggtgtacgcttggtctgggccttattcatagcgcacgtcggagtctctactagttagtcaggcttgcattgattcttgtcaggagcatagaggtggccccagtgactcagccactatggcttactataaacagccaggtctggcaagtgactttcagtggtcactcaggtaccccttcctgcgagatgcaatagcaaagcatgacgtaaggtcttagcaagctcttccccacaggttaggggaaatactggtgatgggcagtagctcttcttgctttagctgaatgacaaccatcttgccagcatggtaggctgaagcttggccagagtgagcccagtgtgcgccttttcagttggttcttgggatgctcctgcagccaattaatggccgactgagttcctttcctcctgggggcccattgtgcgatggctgcacgcaagtggcttcttggtatgtac

SEQ ID NO: 481711 - DNA, 308 bp, Homo sapiens
tagaggatccgccactgtagcattgctccaatctcggggggctgcacggcccattgtccctctaacagcaagttgggggcagccgcaccgctcgggggtcgctgtacctcagttcagccatgcccagcagtctcgtatcgttcatcggcacattaagccagcacgacaagtcgcgcccagccacactcaagcacacggcccatgccaccacccagcccacggcacatcgcagcacaagcagctcatccaatcttgtctaatccatgtcctgtgtaccgggccgggggtgcaggtaagagccggtagta

SEQ ID NO: 481712 - DNA, 139 bp, Homo sapiens
tatcatacatatccccaagtagttttagatcaaaaacatgaaatagatccacctgcttatatttaacgcatattaaaaaggaaactaattggaccatatttctatatatagtctattttatacaaaaaggctacacaat

SEQ ID NO: 481713 - DNA, 198 bp, Homo sapiens
aattcctgacgcaaacgtcgatgacctgaatctggctattgccaatgccgctcttttggatgcctctgcttcaagccgctcacactccagaaaaaactctttgtctctgttgtaagtgttgtacacgagaattagcacactattagcataaaagacacttggcatctttacttacttgggcaagtaagtcacgtactt

SEQ ID NO: 481714 - DNA, 227 bp, Homo sapiens
ccctggccaaaaaaaaaatttttaacttttccattccctttattcccttttttaattttaaaatctttagcttatttttgaatgttgggcccccgtaaacaacatttattgtcgctgggtaaacattgccccccgcaggtttagggggtaatgtcaaattattactttttttatagggccaatgccccaatcctaggcctaccccccccaggtttgttcttttttta

SEQ ID NO: 481715 - DNA, 144 bp, Homo sapiens
  misc_feature (82)..(82): n is a, c, g, or t
  misc_feature (107)..(107): n is a, c, g, or t
cggttcggaggccccgttcaccaccaggcgcagagattcaggttctcccccatgggcgtcgatcacatgagcgggctctctngcgtcaacgtgccaggaaacgcctncttcggctggtgcattttcatctacaacctggggcaa

SEQ ID NO: 481716 - DNA, 564 bp, Homo sapiens
  misc_feature (39)..(39): n is a, c, g, or t
  misc_feature (69)..(69): n is a, c, g, or t
  misc_feature (85)..(85): n is a, c, g, or t
  misc_feature (142)..(142): n is a, c, g, or t
  misc_feature (187)..(187): n is a, c, g, or t
  misc_feature (220)..(220): n is a, c, g, or t
  misc_feature (242)..(242): n is a, c, g, or t
  misc_feature (251)..(251): n is a, c, g, or t
  misc_feature (329)..(329): n is a, c, g, or t
  misc_feature (336)..(336): n is a, c, g, or t
  misc_feature (338)..(338): n is a, c, g, or t
  misc_feature (374)..(374): n is a, c, g, or t
  misc_feature (379)..(379): n is a, c, g, or t
  misc_feature (399)..(399): n is a, c, g, or t
  misc_feature (407)..(407): n is a, c, g, or t
  misc_feature (435)..(435): n is a, c, g, or t
  misc_feature (459)..(459): n is a, c, g, or t
  misc_feature (471)..(471): n is a, c, g, or t
  misc_feature (555)..(555): n is a, c, g, or t
gggaggggagtgggttaagcgcactgcagtgcgcggggngctacgttgctttcacacaaacctgcggcngtggcccacacctggnaggggcctttggtcataggacggcgtgggggagaatactgttttaagtttgggattngggtgggttttggtgttaaaggtgagggtgcgggttaagaaaggntggccccagctttgcaccatctaggctgaaggnctttggaccactcctaggagtnagggctggntccattagctcctggtactttggtctggcccactccctccttaaccaagcgggtccaaggtcaagaatggcacaagancagcccntntggggccttcccacctctacaacctagtcccctggncagcnacagtggcaaaaggcaactnggtaaatngcagctttctccagttttaagggcactngctctccaacacccctcccttgcntaggggcctctnccaaaaaaaaattttacctcctgtttcagaaaatctaaccagcaaccagcctgttgattccagggcagttagccagacgcaacnggagaaaga

SEQ ID NO: 481717 - DNA, 152 bp, Homo sapiens
aatctcaatgtatcctatcaccactgcccatctgatcatgggtgtagggccatccactggagcacagacacagatggcctaccacaacctcaggaaagaatgattttctgcctcctcgcagctgtccactgacaatagctcctcaacaagag

SEQ ID NO: 481718 - DNA, 89 bp, Homo sapiens
  misc_feature (29)..(29): n is a, c, g, or t
gaattcaaagcttctaaccgatgtacggnggacatgattatttttctaaagctggttgggttaataaacagtacctgctctcaaattga

SEQ ID NO: 481719 - DNA, 341 bp, Homo sapiens
cgtaagactaaagtctcatagtgggatcctggtgtagctttccttcgtcgctattcctaaaaagcaacaaaaaagttttttgtgaatgctgcaagattgttgcattgtgcatactgagataatctgaggcatggagagcagattcagggtgtgtgtgtgtgtgtgtgtgtgtgtatgtgtatgtgcgtgtgcgtgcacatgtgtgcctgcgtgtgggtataggactttaacgctccttggggcatagggaagtcacgaaggatcgcttgacatcaggagacttgcggggtataatagcagacgtctgagcttttccccacccagagaatagccccgttcga

SEQ ID NO: 481720 - DNA, 220 bp, Homo sapiens
ccccccccccccccccccggcacatttagtgggctgagcaagggcggggccatctccgggtttttcttttttggcggttttttcccggccttggttttttttctccccttttttgagaccccccttttgccccatttgggtttggcttttggggggtaattttgcggtacctggggtaatgaaaaaaaagagcaaggaacaaagtaaggaacaaaagaga

SEQ ID NO: 481721 - DNA, 1193 bp, Homo sapiens
atggaagatccgtcgggggctcgcgagccccgggcccggccgagagagcgggaccctgtggactggtgccccctacccatgacctaatggcctgctacccacgatctgacctgctgtgtgacctgaccctgtgtggacccgctgcaggaatgcgaagcagcgacgggaaccggcgaagggacggggaccgtggacccggagagagaccaggagagggacggggaacctgcgaccgtggaacctgggacctgggagagggagagagagagggcaaagagacccggacctgaggccccctgcctaggacacacacagggacgcgggccctcgcgcaggtgaacacggagttgggaaaaaccgtgccaaagccggacgcgggaccgggagccccggggaactgacctgggacgcaagcctgagccttcctgggcccgcgccctggagaagccccggagccgccgtagccgcagcaggacaggggagaaccccgggcgccgaagacccgaaagtgaaccccgcttcggagagatatctgcctcgaccccccaggcctggacgagaaggaggggtggaatattaccagtcagagggcggaaggactcgtgagaatgccaactatatgcaaatacttggtgccactggggagaagcctgttgcaaaatgctggaggttctctgaacttgctgatcttggctgtagacttctgatgtttacaggttccacagtgggggctacacaggtggtattaccagctttggggggcatttcctacttatcagtcgaagggggttacagtggttgatggtgcatgacgggagaaggccagcaatgggatttccagttttacaggttaaggtgccctggctactgtgtgcaatggccttatatggaggccataaaagcctttgtggcgcttggtcccaagaagtccgcggggacccgagggagtgtaccaagtgggtgtagaccaacggagttgagtacttcctacgggggagaacaccgcagatagtattatcagacacattgtgagagtcccgtttagtaaagaggaggtgcacaaagcgaagaggttgggtactaaaaataagatggtgcagtatgagtcggtgagcaagagtaaatctttttttttttttttcttcttttttttttttgtcttttcttttgctttctttgtttcagggtgtgga

SEQ ID NO: 481722 - DNA, 1263 bp, Homo sapiens
  misc_feature (256)..(256): n is a, c, g, or t
  misc_feature (264)..(264): n is a, c, g, or t
  misc_feature (302)..(302): n is a, c, g, or t
  misc_feature (308)..(308): n is a, c, g, or t
  misc_feature (310)..(310): n is a, c, g, or t
  misc_feature (341)..(342): n is a, c, g, or t
  misc_feature (389)..(389): n is a, c, g, or t
  misc_feature (413)..(413): n is a, c, g, or t
  misc_feature (427)..(427): n is a, c, g, or t
  misc_feature (621)..(621): n is a, c, g, or t
  misc_feature (635)..(635): n is a, c, g, or t
  misc_feature (658)..(658): n is a, c, g, or t
  misc_feature (678)..(678): n is a, c, g, or t
  misc_feature (695)..(696): n is a, c, g, or t
  misc_feature (723)..(724): n is a, c, g, or t
  misc_feature (905)..(905): n is a, c, g, or t
  misc_feature (965)..(965): n is a, c, g, or t
actcccaccacccactcccccccctcccccccacaccccccatccccccaccaccccccactccccccccccctccccacatccacccccactcctcctccctcccccccacccctccctcccccccccccccccacccccccccggccccccccctacccacccccccaccaccacccctccccacccaacccccccaccccccccccaccctcaaaacaactatcgggtctatgtgtattcgaggtcccgttgngttttaanttggtcacagggttactcagctgtaccttctagtccgncatggncngctctcacccgggacccccagttccagaacnntgcagcaatggtaccgcgagcaccgctccgagctgaacctgcgccgnctcttcgatgccaacaaggaccgnttcaaccacttcancttgaccctcaacaccaaccatgggcatatcctggtggattactccaagaacctggtgcacggacggacgtggatgcaggcatgctggtggagtacttgtgcctagatccagggcgtggaggccgcccggtaagcggatgttccatggtgagacgatcaactacaccgagggtcgcagcctgtgctgcacgtgngctctgcggaaccngtcaaacacacccatcctggtanacggcaaggatgtgatgccnagaggtcaacaaggttnntggacaagatgaagtctttctgccagnngtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaancctggccagctgaaccccgagtcctccctgttcatcattgcctccaagactttactaccnggagacactacgaatgcagagacggagaaggagtgggttcatccagcaggccacgaacttctgaagtggcaagactttgttgcctgttcctaaacacaaccaaggaagagtatggatgacctcaaaacatgtccatactgtgatgggacgagacacatccactggcgaaacaatctcatgctgtgttggttacaatccgtagttggacagatagcaatctcagactgataaaccacattgcaggatgatacactgggagaccagaaaagagcttgtatagaggtaacacgcccatcta

SEQ ID NO: 481723 - DNA, 138 bp, Homo sapiens
atctgagaatttagtaattacttggctttcttttcttaatatatatttaaaataattctataatatgatatggagacattctactgtcatattaaattcaccgctttaggaggtgtattatacataatcttagtcatc

SEQ ID NO: 481724 - DNA, 1297 bp, Homo sapiens
  misc_feature (256)..(256): n is a, c, g, or t
  misc_feature (264)..(264): n is a, c, g, or t
  misc_feature (302)..(302): n is a, c, g, or t
  misc_feature (308)..(308): n is a, c, g, or t
  misc_feature (310)..(310): n is a, c, g, or t
  misc_feature (341)..(342): n is a, c, g, or t
  misc_feature (389)..(389): n is a, c, g, or t
  misc_feature (413)..(413): n is a, c, g, or t
  misc_feature (427)..(427): n is a, c, g, or t
  misc_feature (536)..(537): n is a, c, g, or t
  misc_feature (592)..(592): n is a, c, g, or t
  misc_feature (655)..(655): n is a, c, g, or t
  misc_feature (669)..(669): n is a, c, g, or t
  misc_feature (692)..(692): n is a, c, g, or t
  misc_feature (712)..(712): n is a, c, g, or t
  misc_feature (729)..(730): n is a, c, g, or t
  misc_feature (757)..(758): n is a, c, g, or t
  misc_feature (939)..(939): n is a, c, g, or t
  misc_feature (999)..(999): n is a, c, g, or t
actcccaccacccactcccccccctcccccccacaccccccatccccccaccaccccccactccccccccccctccccacatccacccccactcctcctccctcccccccacccctccctcccccccccccccccacccccccccggccccccccctacccacccccccaccaccacccctccccacccaacccccccaccccccccccaccctcaaaacaactatcgggtctatgtgtattcgaggtcccgttgngttttaanttggtcacagggttactcagctgtaccttctagtccgncatggncngctctcacccgggacccccagttccagaacnntgcagcaatggtaccgcgagcaccgctccgagctgaacctgcgccgnctcttcgatgccaacaaggaccgnttcaaccacttcancttgaccctcaacaccaaccatgggcatatcctggtggattactccaagaacctgtgttgactgtgagtgactgttgacttgctgtgattgcttggttgtgacttgtgnnccaagtccagtggtgactgtagtgatgtgcctgccctgtggagcggattgttcanatgtgttgatgaaatgaaatcaacttacacccgatgtgtgtctgatgcctgtgctgcacgtgngctctgcggaaccngtcaaacacacccatcctggtanacggcaaggatgtgatgccnagaggtcaacaaggttnntggacaagatgaagtctttctgccagnngtgtccggagcggtgactggaaggggtacacaggcaagaccatcacggacgtcatcaacattggcattggcggctccgacctgggacccctcatggtgactgaagcccttaagccatactcttcaggaggtccccgcgtctggtatgtctccaacattgatggaactcacattgccaaaancctggccagctgaaccccgagtcctccctgttcatcattgcctccaagactttactaccnggagacactacgaatgcagagacggagaaggagtgggttcatccagcaggccacgaacttctgaagtggcaagactttgttgcctgttcctaaacacaaccaaggaagagtatggatgacctcaaaacatgtccatactgtgatgggacgagacacatccactggcgaaacaatctcatgctgtgttggttacaatccgtagttggacagatagcaatctcagactgataaaccacattgcaggatgatacactgggagaccagaaaagagcttgtatagaggtaacacgcccatcta

SEQ ID NO: 481725 - DNA, 349 bp, Homo sapiens
tgtcgctcacatctgacaggtgtattgacagtgtggatcgtcagtcgtggactagcgatcggtaatgggaaataccggtgggatgcagtggctcgccctgtaatcctaacactttaggggccaaggggggaggatcgcttgagtctaggagtttgagaccagtctggggaacatagcaagaccccattctacaaaagaattttaaaaattagttgggcatgatgacgcatccatagtcccaactacttggaaggctgaggctgaggattgcttgagtctgggaggtctaggctgcagtgatctatgattgtgccactgcacttcagcctggttgcaaagtacgactctc

SEQ ID NO: 481726 - DNA, 440 bp, Homo sapiens
  misc_feature (23)..(23): n is a, c, g, or t
  misc_feature (29)..(29): n is a, c, g, or t
  misc_feature (121)..(121): n is a, c, g, or t
  misc_feature (142)..(142): n is a, c, g, or t
  misc_feature (166)..(166): n is a, c, g, or t
  misc_feature (169)..(169): n is a, c, g, or t
  misc_feature (176)..(176): n is a, c, g, or t
  misc_feature (205)..(205): n is a, c, g, or t
gggacatattgttagctgccacntagcgntcattgtataggtaatgcctgcaccataattcctagtaatagccacgaccaattaacagtcgggctatccttgctgtagttctcgtcatggngccacaaatcactgtgtaacntggctcactggtgagcatagggtnganggtaaangtttaatccttgctagcttgtgagaagangagttgatgactgctccataccagtggctagatggagtattaaggtggagcagaaaagaagtgagaacatcttgattcccctttcacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttact

SEQ ID NO: 481727 - DNA, 869 bp, Homo sapiens
agagtcaacagcacacagagagatatggcggtagatacgtcgcgcaattatcgtgtggcggctcggagtcttggagcacccgcaccagggcacccaatgtttgtgacaccgcggtttgggcacaccgatagacccttccgaggccctatgttcgcccggagaaatccagttgccggggacaaaaacatacttgggcctgggatggcgcccacacacgcacgctttgtgctcgcgacaacgcgtcaacgttgtgggccccagcgttgtcacagacttaacccggggccgaccccgtcagcgtttgttccggccatactcagacatattagctgggggcaaccccttcatcaaagaaaacttgcggggccacccccaatagcgtggggagatcttcacccctggagtccccaacgctcagaaagacctccgtcaagtaccccagagtgttgtcatataatccccattactgcgcttacaaaaatagttggctgctaacagggcgcccctattgttaacccttgtgtatattatactcgcgagcccccgagaacacatggggtcataaaaagcctgatagcccgcgatgaggacgacccaaaaggtgttcccccccttgcttccccctccccagagggtcccaccccatagttacttcagattacaggacaaaattcattcccagccattatttacgtgggcacactaactcaagatgtgtccaaacagtcaaaagagtgtattttagtaataaaccaacagtgcgggtaaatacaagaaaaatataggaaatactcctcactgttattgtaggaagcgaatgagtctgaaggactcatgcaaaacagggaaaaaacccaccgcccacatgc

SEQ ID NO: 481728 - DNA, 317 bp, Homo sapiens
gaggccaggacttcgagagcagcctggccaacatgatgaaatgctgtctctactgaaaataacaaaaattagccgagcatggtgacaggtgcctgtagtccctgctactcagaaggctgaggcgggagaatcgcttgaacctaggaggaaaaggttgcagtcagctgagatcgcgccactgcactctagcctcggtgacagagtgagactccatctcaaaaaaattcggcacggggaaagcgagaaggaggctcctcccctcctaagctgagccaaagcgaggcttaaagccacgaggcagttttaaggttcccaag

SEQ ID NO: 481729 - DNA, 453 bp, Homo sapiens
  misc_feature (57)..(57): n is a, c, g, or t
  misc_feature (93)..(93): n is a, c, g, or t
ttcagtatgtgtctctaaagttaatgatattatctcatccaaaaaagtgacttattnaatatcatcacatattcaggtagcattcaccatttnactccactgtctcaagtgttttttggctttgttttgttgtatttgtttttcagtatgttcactagactcaggctcttaagtttcttaagtctcttttaatcaataagtttcttctccatctctgttttttttttctcttttcctcttacaaattgaagaaaccaggatttttgaactatagtttcccacattttggatcttagtgattgcatcactggtgttttgaagacattttcctttctgctatatttttcttttttttttattattatacttttttttttttttttatggaggttgcaatgagccattgcattccagcctggatgacaagagtgaaattccatctcaaaaaaagcg

SEQ ID NO: 481730 - DNA, 353 bp, Homo sapiens
cacgaggagcattgcaagagcgtttggtggccctctgagtcatctcttctcctcacgggacatcccagcatcttcatggatcctcagaggcacggggggccaccctgaccaccctcctcagagtgaacctctgtctatgtgtccttcttcatatgtggtggccagaaaccagatcatgtgcacagaacagacaggctctggaagagtgattgcaaagtggggacctggaggcagccagcggggagtcctgagaagtacaagacccagaggtctattcagagagaaaccaaacagtccagagacgtggtggccacattcccctcagcactgtgagaaacaactctgttttacag

SEQ ID NO: 481731 - DNA, 779 bp, Homo sapiens
  misc_feature (681)..(681): n is a, c, g, or t
  misc_feature (743)..(743): n is a, c, g, or t
  misc_feature (757)..(757): n is a, c, g, or t
tctggtcaaccatcaaaagtgccttcccaagtctcacctgtttttcacctcttctaggacctttgacaactgtcttgttacaaatgtttggtccttgcttctttaacctcttagtaaagtttgtgtattctagattaccacagttccagagacaatgctggcacaaggcttccagcccatcctgtccactgacacggagaatgaaatcgtcctgcctctgggctccttagatcaggtatccagagatttttactcctccagtgccaggcagggcctacgtccataaactcagcaggaagtagttacggaaaacagatctccgcccttctgcagcccccttaagattaaggaggagtatctaatctctgaagggggaatgaggtaggaggtgggactcaactctggaagtggggctcaggcactcagaccaaactgagcactagctaaaataggtccagggcagatgctagtttccataggacacaccgacctgtgtcaagtcagttcaccatggctctggcagcacccagaagttaccaccctcaccctggaaatgtctgcataaactgccccttcatttgcatataattaaaagtggatacaaataccactgcagaactgcctctgagctgctactgtgggcgcacagcctgtagggcagccctgctttgcaaggagcancgcctctgctgctgctgtgcacagcggccgcttcaataaaagttgctacaccactggcttgnccttgagttccttnctgggcaaagctaagaccctcc

SEQ ID NO: 481732 - DNA, 233 bp, Homo sapiens
attttagggggtattttggggttccctattcctggatggcccccaaggggaattgccattttttttggttttttcggttaattctatttttttgggggtaaaatcctttcaaagaagggaaatttttttttttttttttttatttaaaaattgggggattttgggttttttcccccctttattgtcaagggttttttttaagccttgtttttaaaaaaagattttttccccta

SEQ ID NO: 481733 - DNA, 259 bp, Homo sapiens
gctatactggcagtgttttacactctggaaactagtctataatggccggtcgtttattgcactcggaatgcttcaatcccagagcttcgttatcagcctaggcaacataccaagactcgatctctatcaatttttggggaaaattgaccaggcgtggtggcattaaccctgtggtcccaggtacttgggaagttgaggtgggatgactgcttgagcctggaaggattggggctgcagtgagccgtgatcacgtcactgc

SEQ ID NO: 481734 - DNA, 816 bp, Homo sapiens
agcggacgggtgcccggcgaggctccccaattgacgtggtgtgcttcaggacgtgcggctccaacggtgggctcttcgaccatggtaagcgtgtaggactcccgggccacaacggtgctccttgctcgcggttcctcgtggtggtccctctctccggcgcggtcctgtggggaggggcccaattcggtgccgtgcctgagcctagcggtgagagcggatgacctcgaaggggtctggaaccgtgtggcctgtcgcggtgtccagtggtgaccagcgctggggctctctgacggtgtggtgccggccgatcggtgcttgcgtgtcccatcgtgacggcacgtgttgccttacgccacgtggcgactcggtcgtgtaccgtgacgtgcttcagaatcgattccggccatgtacgcgagccgaacttgcgagacgaagctgttcctgcgaagccagtcctcgcgacagctggtggtgtggcactgatccattggggcttttgcagcgattgcctgggcctttcctgtgcgcgtcggatgagggcccgtccttgaatatggcttggacttagatacaagctggccttgcagcccgcgggcgctccgggcacacgcgtgctggtgaatgactacggccgggggggaacggcggagccgctcgagcccggggacccagaccttcctttcctggatagggtacgctgtgcacgttgaggcctggcgtgggaccggccatccatgcggtcgaaggagaaccgcgtgcaaaactcgtatacaggcaggggccgagccgaacaaatgttcactcctaatcgtccaa

SEQ ID NO: 481735 - DNA, 135 bp, Homo sapiens
tcagattgacacgtcgaatgtgcccccgtcccaggtcaaatgattagcacgttgctgctcccccttgcccgtatctgtcgcaggccgtaagctatggcggcggccagtgggctcgcttgatgatcctgcagcacg

SEQ ID NO: 481736 - DNA, 341 bp, Homo sapiens
ctaagatattccgagggaagggcaccaggccacctcccttccgcaggtctgtcagattaagggtcttccgaatgaaatgccactgtgcattttcagacaaaaaaatctctgataaacagactatgaatggatgttcgttcctcccgattcctcttttctcttcgtggcgacttagagattggcggatattcggaattgtgaatgtacattgcgtcgagttaaaccccttgtgtgtgagacaggacgcatcgggcccctggtggcctgggggccagacccgtgggcaggtggggcatgggccctggcctgcggggacctgctggggtaagagggctaggaag

SEQ ID NO: 481737 - DNA, 877 bp, Homo sapiens
  misc_feature (29)..(29): n is a, c, g, or t
  misc_feature (62)..(62): n is a, c, g, or t
  misc_feature (66)..(66): n is a, c, g, or t
  misc_feature (77)..(77): n is a, c, g, or t
  misc_feature (82)..(82): n is a, c, g, or t
  misc_feature (88)..(88): n is a, c, g, or t
  misc_feature (105)..(105): n is a, c, g, or t
  misc_feature (114)..(114): n is a, c, g, or t
  misc_feature (135)..(135): n is a, c, g, or t
  misc_feature (148)..(148): n is a, c, g, or t
  misc_feature (168)..(168): n is a, c, g, or t
  misc_feature (173)..(173): n is a, c, g, or t
  misc_feature (175)..(175): n is a, c, g, or t
  misc_feature (179)..(179): n is a, c, g, or t
  misc_feature (185)..(186): n is a, c, g, or t
  misc_feature (209)..(209): n is a, c, g, or t
  misc_feature (211)..(211): n is a, c, g, or t
  misc_feature (216)..(216): n is a, c, g, or t
  misc_feature (226)..(226): n is a, c, g, or t
  misc_feature (316)..(316): n is a, c, g, or t
  misc_feature (414)..(414): n is a, c, g, or t
  misc_feature (513)..(513): n is a, c, g, or t
  misc_feature (521)..(521): n is a, c, g, or t
  misc_feature (554)..(554): n is a, c, g, or t
  misc_feature (571)..(571): n is a, c, g, or t
  misc_feature (584)..(584): n is a, c, g, or t
  misc_feature (674)..(674): n is a, c, g, or t
  misc_feature (684)..(684): n is a, c, g, or t
  misc_feature (689)..(689): n is a, c, g, or t
  misc_feature (755)..(755): n is a, c, g, or t
  misc_feature (859)..(859): n is a, c, g, or t
ataaagcaatatatgtatatatatttttncagaaaaacaccagaggtgaatttctacaaaancgcntgcctccccancagancatgtntgcctgattatcaaganttctttttngtaacattaactctctaaagncaatcgagggggncgggggcatcactgctacancccangncgcnaactgnncctctggtcttcagccacatctngnttttnctaataatgngtaaatactgcctgggtaaaatgctgcaaagtcttgatgagagaaagcatcaacagatcaagcaaagccatgaaaattatgaagcaagcnagagctgattattagaattagtaaaaatgattaagagaggatgacacaaccatacgggatttgtatattctgattgacactcttttggcagcgaattnggtcagcacctcgggcagggaaccaaaactgagtgaaaactgctctttttcctcctagctcaggccaccaacgtcacagccgggactgagagaactgcngcatctgnggaaacttctattctcggggggcagagattgcnctgtgaaaccctaccgncactaccccgganggccctggcctccgaggtgtctgcagcgtgctgccttcgccggggcttttcagaatgggccggggcctcgggggtcttcatccccaaggnagcctcttgnttttnggcgccgcctttgtttttgggccggacgccgttttgcggctgtcttctgtgttcgtggcggctgtngccctttcccagtggctcggcttcattcccactgccctgcgacttggcaggcccatttagcctgttgttatgatactgtggattaaatctccgtctttggttanaagatccattctgcttgt

SEQ ID NO: 481738 - DNA, 282 bp, Homo sapiens
aacgatggtcctcagcttgggcaagagcgagactccgtctcaaaaaaaaaaaaagacccgtctctctacaaaaaatgaaaaaactagcagggcatagtggtacaaccggtagtctcaactactggggaggctgaggcaagaggattacgggctgcagtgagctgtgatcatgcccgcctcagcctcccacagtgctgggattacaggtatgagccaccacgccgggcccattttttttttttttttgggacaattttttttttttgggaaagggggtcgtgt

SEQ ID NO: 481739 - DNA, 514 bp, Homo sapiens
ctccggaaatcatgagactgacagaacagatcttgtggcaataagaccccaaataatcaacaggacctagggctcatgccaggcaagggtaagtctatgtcaccctactcttaaagaataaactagattctaactaccacatagtattcatttttctctagcagccaagcaagcactggctatgagagaagcaagattaaaacaattacaacacacccagctcacagacactgagtaactgatctcctgccccaccgaccttaacgacagctttcactggacaagggactgatttcagtaactttctcctgataagagacgatcctccatggactggttctgcccagttttagaggctgtgcctttacagaggctgagtaccttcattccctgcttcactttttgatgtgtagagcctaattataacacatttaaatgtcaagtctccaccccagaatgaacatgcatgtttattcaatatgcatgtgtaaggacctcttttatgagtatactc

SEQ ID NO: 481740 - DNA, 194 bp, Homo sapiens
  misc_feature (7)..(7): n is a, c, g, or t
  misc_feature (165)..(165): n is a, c, g, or t
cagcctncttagcccctcagccctcagccgtcagccccctcaacccctcaactccctcagcccctcagccctcagcctcctcaatccctcagcccctcagtgctcagccccctcaaaccctcagcccctcagtcctcagtcccctcaacccctcatcccctcagncccctcagctccctcagccctcagccctt

SEQ ID NO: 481741 - DNA, 204 bp, Homo sapiens
gtgacccagaagttataatccacttcataagggctcactttcatgatctcatcattttaattatccatatctcaaagagctcacctcctaatactctcactcgggacctaggacttccaaaactagaaagtttcggcggcgatacaacacacctcacttccactaacttgctacttcttctcctgctgctacggataaccacca

SEQ ID NO: 481742 - DNA, 817 bp, Homo sapiens
aggctgggtttgatcggccgaggctgagcctgggctggtgcgcgccgcttcctgtcgccaccctctctggacatgcccagtgcctgcatggctcatgccctctccgcgtccatgtgctgcttagatgtgtgctctgctgcctgctctgctgctgctgctgcctgccccgtgctcttagcccgaccctcgctcctgctcctgccgtgtccctcatgctgctggcctcctgcccccctgatctccttgccctgcctgcctgcctccctggagcagcatgtgactgtgctgctggtggtgctgatgtgatggtgcttggcacctctgatgtgctagcatgtgctgccatgcagtggagatcttgtgctgaaaactcaaatgaagataaatgcaccccaagtagactgtagacaaatgcatgtggctgagctcaaagcccgcaatgagtggttcttgtgaatgcaaatgtgagctgtgcgttacatgcccaaagatgatatttgtaggacctgagcaacaaactggacagataccctgaagaggaggtttttctatgatcaagcttttgctatttatggagtgtgtaagtggtctgtatgactttgggccagttggcttgtgcttttgaagaacaatattattcagacctgtgaggcagcactttatccaagaggaacagatcctggagatctgatttgcaccatgctcaccccctgagccagttttaaagacctctggccatgtagacacatttgctgacttcatgctgcaacgacggtcaaaatggccatgtttcgtgctgacatctataaaaggtcaa

SEQ ID NO: 481743 - DNA, 125 bp, Homo sapiens
cttgcgaatcacataatggcataccagatacagggagacacaaacatgctctgtgtaaatagaactacaaccagttgttgactttatgtttcacagtggctcccctatccccatgtgctgtgtag

SEQ ID NO: 481744 - DNA, 219 bp, Homo sapiens
acgatatttccaaggttattggttatcttccagggtttttatagtttaaagttttacatttaagtctttcatctatcttaagtttgttttctatatgggataaagaaggggctcaatatcaatcttctgcatatggctagccagttatccatcaacatttattgaatggggaatctctccccgttgcttgtttgtcttgactttgttgagatcaaatgg

SEQ ID NO: 481745 - DNA, 187 bp, Homo sapiens
aaaagtcctttttctcagatattgctgaagtattcaggggcgacgtgacgtgtgtagatatataacatataaacaaatgtgacaaactattaattgctttgaaatttattttcttttttttttttttttttatattatttttttattatttttttttttttttttattattatttttttttattttt

SEQ ID NO: 481746 - DNA, 192 bp, Homo sapiens
acccagaacagatcagccgaatcaaccctggtgatcaatggggtgacagatgtcgcagctagatcgtcctcacatccaaaatcatgtatgaattccatgaacgccacagcagaagctataaaaaatctcattaggagcagaaagcacaatgcccaaaaggcaaaaatgagaagaacttcaagagggggatcc

SEQ ID NO: 481747 - DNA, 1018 bp, Homo sapiens
tatgggcgtcgtgtgcagcaccgtgtggctcctgggcttgctccccgtcgtccggttggtgctttcgctctctccctggcttgttggttggtcgctcactcttggtcgtccccgcacgcgtgccagcatgcgctttgaatactgggtccccgcgcctgcgccttcttccggtcgccgtccggggtttctcctctcggggggcaagaccatgcacagtgtggcgctatcggcgcgcgacacagagatccgtcaggcactctgctacttactggatgctgtttcagttgattcgcgcaggcaggttagcttgcatagactggcgctgctcactcacgtgtcacgtgggtcgtaccactcgcgtgttgcagcaacagcacgcacccggtctcggggggttgggagttagatcactcatactctctcacccctcgacgacgttgtccgttcgaaatgcgagctgcacccagcagtagcttctggcgcgccaggactactctagtttcactcttgttgtccgttgttttcggcagctcagacgatcgagcgactggggtgttaggggggtgtgatattatatctgctcctgtcgtcgtattcctcctgcttggacacacaagctgctagtcgtgatttcattgatcctccccctggtcgccgattattgtctttgttcttaggagaccgatgagaagcacgagagaggacacgatccccactacgaatcttagcagtgtttcgctccgacgagaagaacacatcctacttgccctcctcgtcggtgctgctgtcgttttactctcacccccgcttatgacatcctctctgtagagaggtgtctgtgggctctagctgggactacctttcttataaccaagggggaggcacacacacacacacacacacacacacacacacacacacacacacacacactcttgatccctgcttccctcccccaagtgccgttctgtgatcgccagttcaaagttacgcacaggacactcaatttcttgccccc

SEQ ID NO: 481748 - DNA, 1035 bp, Homo sapiens
ggctgtacggcccggagattttgggagtccggaactggtgtcgtgtggtcgcatcgtgattgtgtccgcccggtcagccggttcggccttacggattatcgaggatgcagtgacctaggctttccagcgtgattgccagaactcgacgatcacatacagcatggatccccaaaatcaacatggcaggtggcagttcgttagtggtgatccagcagcctatctattggatagccgtcagagcattagactatgagagagagattcagcctactgctatctggtccttagaccagagtcaaggccataagaggcagcaatgaatacacagaagggccttcggtggtgaaaagacctgctcctcggacagcaccaagacaagaacagcctgaccggactcatgaacatcataccaattactgtgaataataactacgagcacaagacacacaagccacctgggacatgcagtactcccaagtaatgccaggggccccatccgagcagatcaaccagcacggggcaagtgccagccagctctgggagcaacagcagtgcctctcctgcaacagggactggcccgcacgggccacccaccaaccacgacccacgccccgggatcccatcacgccctgacacagggccaccacacgcaacccaagcaccacacaccacactggactgctcccatcccctcgcacagcggccaccccagacaccgccgcgcaccctgcaccaccccccccaaggtcaccactccggccaaccccgacctccgagaaacgccgcacacaccgacggccaccaactagccactacgccaccaagtgaacccctaccccaccccgtgctagggccccagggtacacccgtcgcccccacgcccccaccggcaccccgcccgacacaccccatcgcgcaacacccccatccacacaccctgcaaacaccaccaacacccccacgggccgaccacacccaaaagcacctgcgacaccaacaccaccaaccacacagccggaagtccccgaactcccc

SEQ ID NO: 481749 - DNA, 1413 bp, Homo sapiens
  misc_feature (565)..(565): n is a, c, g, or t
ctgaaaacaagttcataagatgagaaaaatctacgagacttcttgatttacaacactgctagccccctttcctcccagactctgacatggatgttccagtgcgagacttaagtgtgttggtccctgaagctttgctgtgaatggttgtcagttctgtgtgtgaaactctgacaaactgaagaaaggtttcaatcgttctctactgaaagagattcgtcatgcaaccaccgatagatcatggtgagatctccatgcgagacaagcgtgtcgctgttacacttctttacttgtgatgtgtatgtggaggttgtagcatacgggtcgagtgggcgtgacaacttggtgtaacctatccgttctcaattgtatccatggtgaaggtccaacgtgttacagtctctgcagtagggttggtgttgtgagaatgaaacagggcccattcgtgaggttaaggatgccatagattactatcgaagtagatcaagaagtaataaataaacaaaataaggaggaaagcgggtaaggagattatagtatccccagaatcatatttaacacaacaacnctgacattactcgaaagcgctgcgaaaatcttgggctttgtcacgagacatggcgttgctctctacagttcgccatagatagtgtgccttgtattctcctagacatcgtcgcatttggcgcacagcagaaaaatttacttacgcctataatctcatttagagccacgatcttggcctatcggtccgatcgctttgtccctcatatagggttggcgctagaatggtggcgtggcgaccacactcgcggaaaaccttctgcagcataacgtggattccggtaaaggcctcccaagggcgtggcgcatttcggcctggcccccgtataggggccgaagtggtcacagggttgtggccctgtttattgccgcgcaggcagcgctggcgccccattggtggcctgtggccattctggggcccccggcgtgctcagagacgagcgacgggggtaatgggcttcaagaaactttggtggctttgtatcccacggggacaaagacaagcgacccacggcgggaggacttaaaagtggataacagccaggtacatggcgcacgagacaaggacaccctgtaggggggcgcccctggtcgacctatggctggcctcccgcctccttttaagcagacggggacacgacgaccgacggagaactcctcggccacacggcgggaacacaacaacagcgtgcgcgacacgaggcgaagccccgcccaaacgaaggagacgagcaacacaatgtgcgaccagcgcccactatcatcgccgaacaacgagagagacgccaaacgaatgggtcaccccccaaacaatgtgtcggagctgacacaaacaagcaggccccgaattaa

SEQ ID NO: 481750 - DNA, 284 bp, Homo sapiens
gctgacaaatcataaaaagacaaagaatagccgggagtggcggctcaagcctgtgatcccagtactttttgagaggtggagacaggaggatcacatgagcccaacagttggagaacaacctgggcaacacagcgagaccctgtttctacgaagatttcaaaaattcgttgagcatggtggcatgtgcctagtcccagctcctcaggaggctaaggaaagaggattgcttgagcccaggaattagagtgagctatgatcatgccactgtactccattctggggga

SEQ ID NO: 481751 - DNA, 231 bp, Homo sapiens
  misc_feature (49)..(49): n is a, c, g, or t
  misc_feature (126)..(126): n is a, c, g, or t
  misc_feature (128)..(128): n is a, c, g, or t
  misc_feature (138)..(138): n is a, c, g, or t
  misc_feature (181)..(181): n is a, c, g, or t
  misc_feature (186)..(186): n is a, c, g, or t
  misc_feature (189)..(189): n is a, c, g, or t
  misc_feature (214)..(214): n is a, c, g, or t
tgagagaccgtgttgcaatgagtgagtaaccttcagtgaagcatgagtnaaacccagagtaaggtgtgagtacatctcaaatagagtgtgactacaaccagcgcaattgtgcgtaaaacccacagnantgtcaaagtnaaacaggcgtaaagtgtgagtaaacccagagtaaatgtgagtnaaacntgnaagaagttgtgagtacacctggcantgcaacacggtctctca

SEQ ID NO: 481752 - DNA, 373 bp, Homo sapiens
gtgatagctgactctatgaggatcaacgagggcctgcgaaccattcatgattaagtttgctgtatcttgatgataaaaactgaatggggccggccgcagcgtctcacgcctgtaatcccagcactttgggaggccgaggtgggtggatcacaaggtcaggagatcgagaccatcctggctaacacggtgaaaccctgtctctactaaaaatacaaaaaattagccgggcgtggtggcgggcgcccgtaatcccagctactcgggaggctgaggcaggagaatggcgtgaacccgggaggtggaggttgcagtgagccgagattgcgccactgcactccagcctgggcgacagagcgagactgtctcaaaaaaa

SEQ ID NO: 481753 - DNA, 2138 bp, Homo sapiens
ggttgttaccgaggttttcaaacagtgaagcatcgaaatgagaacacatgccctctcccacaagaaatgaaagctctgtttaagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaagggtgaaatagtggtgaaaaataacccaaatgaatctgtaactgctaatgccgctaccaattctccttcatgtacaagagagttatcttggacaccaatgggttatgttgttcgacagacattatctacagaactgtcagcagcccctaaaaatgttacttctatgataaacttaaagaccattgcttcatcagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcagggg

SEQ ID NO: 481754 - DNA, 1368 bp, Homo sapiens
ggttgttaccgaggttttcaaacagtgaagcatcgaaatgagaacacatgccctctcccacaagaaatgaaagctctgtttaagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaagggtgaaatagtggtgaaaaataacccaaatgaatctgtaactgctaatgccgctaccaattctccttcatgtacaagagagttatcttggacaccaatgggttatgttgttcgacagacattatctacagaactgtcagcagcccctaaaaatgttacttctatgataaacttaaagaccattgcttcatcagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcagggg

SEQ ID NO: 481755 - DNA, 960 bp, Homo sapiens
ttagagtggtactttcagctgtgacttactacagtgaaaaggcacaaagcaaaattagcaaagcgaagaggcacatggggttaaatgtgggggaaaccaggctccagcttccaaaagtcacttttagtgacatcacataggagactcttaatatcccagagacaagttaagagcccgtgggaagtgttgtctaccaggggtgctcattagagactcagcgcctagggttctgttggggggccggtcacacaggctccctctctcatgctgctggttttcttacaggagttttcctacttgttgatgcctattcctcactcgtgctgttttctcattttagttgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcagggg

SEQ ID NO: 481756 - DNA, 94 bp, Homo sapiens
attctagttatcttaattgaatttgaaaactttttcaaatgcattaagataactagaatggattatggtgtaaaaataaaaaaaaaatttattc

SEQ ID NO: 481757 - DNA, 360 bp, Homo sapiens
  misc_feature (339)..(339): n is a, c, g, or t
tttttttgaggcagagtcttgctctgttgcccaggctggagagcagtggtgagatcacagctcaccacagccctgaaatccagaggtcaagtgaatctcccatctcagcctctcaagtagctgggaccacaggcacatggcaccacactcagctaatttttaaattttttgtagagacaggggtctccctgtgttgcccaggctggtctcgaactcctggctcaagcaactctctcgcctcagcctcccaaagtgctgggattacaggcgtgggcccatccagtaactcatttttaatggaacacctttaaaaaaattacatcttcactcctcatacanttgtttgcattcatcagaatt

SEQ ID NO: 481758 - DNA, 212 bp, Homo sapiens
gctcccagagtgtaggatacaggcatgagcaccatgcccggcaggaacttgtatctggcaaggaaacatttcaatattggtatggaaaaaaaaaaggtgtttagttgaacttttatttctcttaaagtcctactcatgggttcattcctgcacttaaaagaaatacaaacggagtcttctctctcctcaaaatatggaaaccaagggggagg

SEQ ID NO: 481759 - DNA, 401 bp, Homo sapiens
ctccacagcaccggcttatcaaaaactccgtggcccctctgtgagcccatatttcttggaagccacatggtatcgcgccatgcagaccatgttacgcgtcatacacaaagctttgcttccaaagtcacataacctggttagtttccagcattggcctttatccatctcaagttagaacgcgttattcaactcaatcaagtctggacctaggggatatttggacgctggccataccggtcgcggttctctcggacacttaggcgctctcatgataggacccggcaccacatatcacacttttgtcaggcacagccagacacagccgcaggccggcgcacaacagcgtagccaacgaggcatgactctttaagagcgtgcacagtttagccgagagcacagtg

SEQ ID NO: 481760 - DNA, 120 bp, Homo sapiens
cattcaggtttctatttttatttttattcaacacaagcaaacagcacaattaagcaacattcagcaactccagaccagcttttcttaccccccagaagaacgaacaatttaaaaacaaga

SEQ ID NO: 481761 - DNA, 690 bp, Homo sapiens
ataaaacaatttaatgatggcttccttgatttacacacaactctaagacaatgatgtgacaaaattattctctccatgcactggtacaactgaagttcatggaacaagagtgcaacccaagtacatgtgggctgtgtgtgttcagatccactgctcagcctcgagtctcatgttccaacctgaccgtctggctcagtgacttgtgtgacactggtggagaggagtggactgcccagacccctcaagtgcagtgtgatggtggacctggcatgcagatgtatgcatgggcactccatgccccatgttgcgagaatgtgcacaggggagacatgcagaaacaccatgcttccaggtgcaccctgaaagacccatgttggtgtctcatgggggtgcccatgctctcccatcatgatgcttgtcctcaggggctggagctggttgctgggtgcatgaggcagctagggtgcgtggagatgtggagtgtggtgataaagaaccacatgcagaatagtgacccacatgctgaattgctaggtgccattgctattcctcccagacactgagttcctgaagacccagctttatcttccaaggtgtatcaacattcccaagatctcaaagctggaaggcggcaagatgtggagcctgtgagagacagatcgaatccagtcctgaggccgcctcaatgtc

SEQ ID NO: 481762 - DNA, 517 bp, Homo sapiens
tactgccgggcctctactgagggagaggggccatgctggggcagacctggcatctttagaggtgtgcccctggccaggcatttccccctgtggccattcatttgctcacatcatcacctgtttacctgttcagcccttccttcactcgccaggtcactggcctgttcactcttccatttcctagtcctctgtccgttctttgtgctactagtgcttcctgaggcccactcagtgtccagccctgtgccaggcttggggacacagagtcaaacctgtgaggaccccactctgtaaactgtagccatcctgccaggtgcttcctagtgatggagactggtgctgtccaaccactggaagtgcttcataaaggacatgcgctgagcagggttttggaggatttggggatttgggtagatcgagaatagtggggaaggacactgctggctgcaagaactgcatggacaagcacagtggcccatgcttgtaatcccagcactttgggaggccaaggtgggag

SEQ ID NO: 481763 - DNA, 125 bp, Homo sapiens
cggatccccttacaccccacgactcccggggttggtggttgtggtaaacctttacattacgttgtacggacagctgacctcactttctgacacggcgacggggctcggggttgacttcgggagga

SEQ ID NO: 481764 - DNA, 509 bp, Homo sapiens
gtttaattcttaagtattttactcttttaggtactactgtaagtagatctttctcagtttccttttcggatcgttcaatgttggcatataaaagtgtaagtgccaggcacagtgtcacatgcctatagttccagctactcaggaggctgagacaggaggatagcttgggcccaggagtttgagatttcagcatgctatgattgctcctgtgaatagccactgcactccagcctgggcaacataacaagacctcatttcgtaccaaaacacataatactgattaccgtgcatcggttttgtatcctttgctgaacttgtttattctaacagtcttactgcgggggtgtgctgggatctaggatatgctagatacaatcatgtcataatgctaacagattttacttcttccaaatctggatgtcttttatcacttgttcttgcctaatcgctgtacctagaacttcaaatactgtgtgaaggacgcgaggcaaaacacaaacaagcaacca

SEQ ID NO: 481765 - DNA, 1071 bp, Homo sapiens
  misc_feature (438)..(438): n is a, c, g, or t
gggagggactacggctaggtagctgaggccctcgtgtttaatcacttaaacctgggagtgcggaaggttgtggtgagcagagatcacgccattgcactccagcctgggcaacaatgagcaaaactctgtctcaaaaaaaaaaaaaaaaaacgggtaaccagttgcttggaaaaaggaagctggataaaagaggggagggcttgtgtaaaaactctttcttgccttatgaaggccacacattcatctcatagaagactcccttgatcttcatatgctacctaagagggggacgacacaaccccttatttgttgtaatatctcccataagcaatgtgatctcataaggcaaggcaagggggtacattaggaaagtttgggacacatgtgaggggctatataggtacaacgtgatattaatgtggagatatagccgaagtnataaaagtggttgggaaaagtctgaggcgagggaggcatgtgtgtcattaaaatattaaagtgactttttactataatcattccggggaagtgaaaaaaggccaattataagaaaaattttagaggtgttaaacaagatatttaaaagggaactcaatgtgtatagaaatagatagatagtgattaggtagtaaaaaggcgaagggaagtataatacaattattgggtgtggatttgtgagctgacagttatataagattataacaatacaaaatatatgggaacttatgagaaaaagacaaggagcaaatttttaacaaatattataagaggaagaggtaaatacgttgaaaatgatatttgggtggggattataaatccagggaaagggatattatatcaaaattaataatattaatatataatatagaagaaaaaaaggacgattgtgagaaaaatcataattgtgacgacaaaaaaaagaagaaatgtgaataggaggaagattatatgaacaaagaggataatataaatgacaaacagctagtatatatgtacaagacatgtatgtatgagaatggtatgcgacacaggagataagaagtaataaaaagagagatgagataatatata

SEQ ID NO: 481766 - DNA, 133 bp, Homo sapiens
taaaaatggtgtgggggggtgtgcggggggagagagaggagagagagacttttttttgtgtgtgggtgaaaaagagagggggggaagaagaacaaaacagagagagaggagccgcggcggcgcgtggtgtgtg

SEQ ID NO: 481767 - DNA, 111 bp, Homo sapiens
tcgagctggtaccgcatctgtacttcgggggcttctctcttgttataaaacttttaccaagtgaaacatcgataccaccttgtttccattctcactggtgtaaatactgag

SEQ ID NO: 481768 - DNA, 199 bp, Homo sapiens
cgtgcttatttatacgagcgggggacgttcttacactatcaagccagggcactttctccggaccccttccctaggggactccaggatggagaccttctcccatcgcgcctttttacaatggtcggactggtcccggtgggcttcagtgatgggatagtacacttcactcagaggcattggcatctttaaataatttctt

SEQ ID NO: 481769 - DNA, 100 bp, Homo sapiens
tcccctaagctatgggactgggatcacacggcatgcatcatgccacatacatgggtatttgctggaggggagatggagactctctgtcctggatgtgaga

SEQ ID NO: 481770 - DNA, 179 bp, Homo sapiens
cgtatcaggcactgaggattgaggtggcaaatctggacggggcccaccggaaggtgttgctgtggcagaaccttggagaagccccgggccattgccttgcatcccatggagggtaccatttactggacagactggggcaacaccccccgtatggaggcctccagcatggatggctctgg

SEQ ID NO: 481771 - DNA, 127 bp, Homo sapiens
ctttgtagacgtacgtggtgttacgggctagagattgggggaaatgggaaatggggagtgactgctaatgggtatagggcttcttttgggatgatgaaaatgtcctgaagttgactgcagtgatggc

SEQ ID NO: 481772 - DNA, 763 bp, Homo sapiens
ccttcagcagcacattgatggtgcaccacattctgctgtccaatgctcctgtatgctacaagaagtctgtaacctccccagccctgtctgcttttttgcttctcttttttctgttctcgtccgggatcccgagactgtcccgcagctgtaccctgaggactcagaccttggactgatcaccaccccggcccccaaggccggcttttcccgtggcctggtggtagactaccctaccgtgcccaagccaagaaattctacctctgcttgttttctgggccttcgacccttatacccgaggggctgagtgaaaatccggatgaagttgaaccccggtagtctgtgttcacccatgagaggttccccttaaggatgtcgaggcgcgggaatggtgaggaagaatcgggcctgggtgctggagagagaaggagcggcaccggcgcccgggcacgggaaagtcagacctgacaccccgtacaccggccgcagcgccagccccgcttctaagtcaccaccgccggttctggaaaggcaccttgcctctgcaccttttctatattgttcagctgaccaagtagtattttagaaaagtttctaaagttataaaaatgttttctgccgtaaaaaaaaagttctttgggcccggcgctggtggctcacacctgtaatccccgccccttgggaggctgaggtgggaggatcatttgaggcccggagtttgagacctgcctgggccacataatgaaacttcctttcccgggagaga

SEQ ID NO: 481773 - DNA, 426 bp, Homo sapiens
acattccaataggaagtgcaaactagttcgacagtcacacttcagcaggagagagagatggtcttgggcgaaggcactttagtcagtgagctagacccagtgccggagttggtcttctcgtgactctgataaatctagacaccactctgttggagaaccagcactgccggcagctggggttagtgcactgactgagcgaggcatgaggcctgctcactggtagaacttcttgttagggctgttagcatggtcagctagcagctggcatggggtgaactgttttccataggcagcttcatatttcttgagccggtccactatcttctgggcgccatacagatccacaaagcggaaaggccctcccagacaaggcgggaagccaagcccaaagacggctccgatgtctccctcttgtagggaaggcca

SEQ ID NO: 481774 - DNA, 105 bp, Homo sapiens
tggatcccgtgtgtgttcttgggtcggtgtgggtctatactaagttgagatgatatcgttacgggggaaggcgcttcggtgggtcgttctctcggcgccccctct

SEQ ID NO: 481775 - DNA, 857 bp, Homo sapiens
gactggctatttattataaagtactgaagtcacatagccacctataaaacagcatagcaacatgtctgcctgtttcacaaacagtcatttctaaaggtcagagtgtccacatcaggcaccatttgtgatatgactccgagtggcatcatatttccattttttcaatgacaagacactccgaaaccgtttcagataaccaaactcatcattgccagaccgttcaccgttgtggaatgcaatcgttgtatatctttctgtgccatcacaacaacaatgccgttttctgccacgctggttgccattagtccatcttcctcacagcaccatctagaacaatcgaaacaattggtcgctcatcatatcaatctggtcaacaggcaacattctgcaagagaatgaacagtggcctaacaaagtcacacgatcttcacaattccatatcatgggacacagttacttggtggtacaagatgacaatggtacagaacaagttggcaacccctttcctatcctactcagacaacatataataagagaaccaaacataatcttctaagtcgtacacaacttctcaaacgcagaaacctatggggcgcttatcccagtggtacacccgtgtccagtcccttacaccggtatttcctctggacacccaacagatcaaactcggacaggcccatgatattcactataccccattaacgaccaccaaagccccacccattttccagcggacaaacactgtccattcacatagcgcgacagggagaacataattcctatttccttcggacattctccagatacagggtatacaccacacatcctatcaaccagctacactcaagcccacggtt

SEQ ID NO: 481776 - DNA, 375 bp, Homo sapiens
cctaaactcaacttcttgaaagaaaaggaaaggaacttatcatcctggcaatgtgagaatgcaaaccgtttttgcttcttgactggctacgcagactcccaaacatcccacctccactgccagcacagtggcccacacttgcatcaaagtcctggttgcaagcaagtacatggatattcccaaaccattccattagaaaaccgtcctccctgcacacagaacaaaaacagcgctatttcctacacctatgggacggaaagtgcttggacaatggaatgggcaacgaatatgacgaagaacacaaaccaagtagctgtggatcaacttggagggggaccctgaattcaattccattgccattgcgccagcggggag

SEQ ID NO: 481777 - DNA, 152 bp, Homo sapiens
tctagaggatcccggagtgcgatgtgtgagggatgataaattctatacagagaaggggagtaatcatcactggtagaaaacttgggttttattttttccaggtctgagcaattagggtgtataaaaaatggaatcggtctggcgaggacatc

SEQ ID NO: 481778 - DNA, 849 bp, Homo sapiens
  misc_feature (17)..(17): n is a, c, g, or t
  misc_feature (62)..(62): n is a, c, g, or t
  misc_feature (64)..(64): n is a, c, g, or t
  misc_feature (66)..(66): n is a, c, g, or t
  misc_feature (77)..(77): n is a, c, g, or t
  misc_feature (101)..(101): n is a, c, g, or t
  misc_feature (117)..(117): n is a, c, g, or t
  misc_feature (119)..(119): n is a, c, g, or t
  misc_feature (124)..(127): n is a, c, g, or t
  misc_feature (138)..(139): n is a, c, g, or t
  misc_feature (164)..(164): n is a, c, g, or t
  misc_feature (186)..(187): n is a, c, g, or t
  misc_feature (203)..(203): n is a, c, g, or t
  misc_feature (215)..(215): n is a, c, g, or t
  misc_feature (217)..(218): n is a, c, g, or t
  misc_feature (225)..(225): n is a, c, g, or t
  misc_feature (238)..(238): n is a, c, g, or t
  misc_feature (240)..(240): n is a, c, g, or t
  misc_feature (243)..(243): n is a, c, g, or t
  misc_feature (246)..(246): n is a, c, g, or t
  misc_feature (251)..(252): n is a, c, g, or t
  misc_feature (264)..(265): n is a, c, g, or t
  misc_feature (270)..(270): n is a, c, g, or t
  misc_feature (276)..(276): n is a, c, g, or t
  misc_feature (284)..(284): n is a, c, g, or t
  misc_feature (286)..(286): n is a, c, g, or t
  misc_feature (289)..(291): n is a, c, g, or t
  misc_feature (293)..(294): n is a, c, g, or t
  misc_feature (298)..(302): n is a, c, g, or t
  misc_feature (304)..(305): n is a, c, g, or t
  misc_feature (315)..(315): n is a, c, g, or t
  misc_feature (321)..(321): n is a, c, g, or t
  misc_feature (331)..(331): n is a, c, g, or t
  misc_feature (338)..(338): n is a, c, g, or t
  misc_feature (340)..(340): n is a, c, g, or t
  misc_feature (349)..(349): n is a, c, g, or t
  misc_feature (471)..(471): n is a, c, g, or t
  misc_feature (551)..(551): n is a, c, g, or t
  misc_feature (650)..(650): n is a, c, g, or t
  misc_feature (687)..(689): n is a, c, g, or t
  misc_feature (828)..(828): n is a, c, g, or t
ttctagacccccccagnaagaaaaaacaaaaaacaagatagaggcagcaaacacaaattctnangnagaggaaaggngcagttgagtaagacggctaaggnaactgagaagcctgangngatgnnnnctcccccttanncctcctcttccgcctcctcaccganatcctcctcctcttctgccgtnncatcctggtactgctnatactcagagangnngtcgttnatgttgctctctncntcngtnatctnnatcttgtttatnntctcntttgtnttccagtngnggnnngnntttnnnnngnntatgggagtnaactgntccgggatgngcttgangngctcctggntggctgtgctattgccaatgaaggtgactgccatcttgaggccacgaggtgggatgtcacagacggctgtcttgacattgttggggatccattccacaaagtagctgctgttcttgttctgnacgttaagcatctgctcatcgacctccttcatggacatccgaccacggaagacagcagccacggtgaggtatcggccgtngcgggggtcacaggcagccatcatgttcttggcatcgaagacctgctgggtgagttccggcactgtgagagctcgatactgctggcttccacggctggngagaggggcaaagccaggcataaagaaatggagacgnnngaaggggaccatgttgactgccaacttgcggaggtcagcattgagctggccagggaaacggaggcaggtggtgacacactcatggtggctgagacaaggtggttcagatccccgtagtttggtgtggtcagcttcagantgcggaagcagatatcataga

SEQ ID NO: 481779 - DNA, 524 bp, Homo sapiens
gtgacctagaggatcccggttgggggtagggttatttttggtttcaatcatttcactgctgattatataacaaaagctcatagtataatataaccccaccatatggctggaatttgattccagttggtcaaggctttcaatttcctgggaggaccaaaagtaacagaactagacacttaggccatattgcaaagaatattttctttcaattacataatgaatctctcagtttgagaaaataaggaaggatgtccgtgttctactgagatcactcacatctggtcgggtgcggtggctcatgcctgtaatcccagcactttgggaggccaaggtgggtggatcacctgaggtcaggagttcaagaccagcctggccaacatggcgaaaccccgtctctactaaaaatacaaaaaattagctgggcgtggtggcgggcgcctgtaatcccagctactcgggagcctgaggcaggaaaatctcctgaacccgggaggcagaggtccggcgagcaagaacatgccact

SEQ ID NO: 481780 - DNA, 220 bp, Homo sapiens
  misc_feature (201)..(201): n is a, c, g, or t
  misc_feature (207)..(207): n is a, c, g, or t
gagacatcaagtagcgtggagaccactgagacccagccactggagaccattagcctagggaggtcattggtgtccttgccaagccctgttttgattctgggtccaggagacagagtgtagtcagaggagaggaatcacagacagcccagtgcagacaacaggcaactctttcaaggagtcatcttataaagactgaagctnagaggntttttttcccagt

SEQ ID NO: 481781 - DNA, 862 bp, Homo sapiens
tcaattctgaccgtaatcgccgtgcaacctcgacctagggtggcccctcgcttgttccgtgtgctatcaaggccatttttggcccttctaccaaggtattggtttcttgagaggcaaaacttacgttcattcctgcaagaatggtgaaaaatgaatataacgcgaattgcgatagcgttggcccgcaacttgggaaataaatgggggaaaaaaatggcgttttccaaacaagtgaagtttaatctgccaatgtacgttattaatggaccaagacttcaggggaactagggaacagtccactggaaactggtgcggccccaaggacagttgagcttcttggttgaagtgaatttaacgcaatttggactgaagactcttgaagctatgttcggttaaacacctcatcagtctgccagcatgaataaaaggagaaatgcctgcctacatgtccttgaagacactccctatttgtaacgaactgtctgtagagtttgggacaatgctagttcttcctcgaagttccttccacatggactagcttcagtgaatgtttctcatgtaaaatagactgcttcttatgttgtcagccatcgaggaattttactcacaaggacttactagcgcccatatgttgcagaagcaaccatagacagtaattaaatagatgccaatcgagaagcacatgtcaggtcccaggtgacaacacttacttctagcagagcatccagcgtgtatagtgtgacacgaggtgaagaaggctgggctgggccagaacctgggaagcaaatcctatgacttctcctctatgtgaattaatggcacagccttttatagtctgaccaaatatcttaaagattatacc

SEQ ID NO: 481782 - DNA, 257 bp, Homo sapiens
atgatatttttttcaattgagtttttatgatataattttttaatgttatttttaaatgaaataattttttaatgttatttttaaatgaaataattttttaatgatgaaacttgttcaatgaaattatcaattgaacaatttttcaatgaacttggtcaatgatatttttcaatttataacttgttcaatgaaattttcaattgaacaatttttcaatgaacttggtcaatgatatttttcaatttataacttgttca

SEQ ID NO: 481783 - DNA, 519 bp, Homo sapiens
  misc_feature (33)..(33): n is a, c, g, or t
  misc_feature (43)..(43): n is a, c, g, or t
gttccacccacacacccacttttgaaaccattngaagggccgntggacttcgtgtggacacccgcggacgcggccaatatggccgcgggcagacactgaacctcttttgccccggatccagcgccatggtgccctccaggaagttcttcgttgcgggaaactcgaagatgaacggtcggaagcagagcctgggggagcccatcggcactctgaacgcgcccaaggtgcacgagcgacaccgaggcggctagggctccccctactgcctatatcgacttagcccggcagaagctagatccaaagaccgctggggctgcgcagaactgctacaaagtgactaatggggccctctactggcgagacaagccctggcaggatcaaagaccgcggtgccacgagcgcgaaccccgcgcactcagagagaaccgccgtgcttcgcgcagacacgagagcctgactgcgccaccgcggcccccgctttgggcacgactactcggcgtttcacccgcttggggggcg

SEQ ID NO: 481784 - DNA, 490 bp, Homo sapiens
  misc_feature (75)..(75): n is a, c, g, or t
gagtactctagaggatctggatgaggacgtcactgcacagtatgccacaatgtgagatgatctgaatgatacacnaaaaggcctgtctcttctgcatgtggacaaaagtggtagctgaactgaactaatattaggcatgtcagcaatacaattcaggtgacgtctgcaaataactccatgtactcttcacaatggatcgacctagctactcaggaggctgaggtggaataaattgttgaggccaggagtaccagatcagcctgggcaacatcatgcgaccccatctctaaaaacatctttttaaaaatgagccaggtgtggtagcatgcacccgtagtctcagctactcaggagcctgaggcaggaggatggtttcaacataaggagatcgaggctgctgtgagctatgatcgtgctactgccctccagcctgggggacacagcaagttcctgtttccaaacaacaacaagaaaacaaaacaaaacaaaa

SEQ ID NO: 481785 - DNA, 401 bp, Homo sapiens
agataatgtattacattatcagcttaacgctttcaaacactacgggaggcattatatctgtacacatagacttaagtcaacacatatactaagctgtaactagtctgccttccattagtttggtctctcagcactataaaatgtcgacttcatatcagtctatgcagcaccagtgacccccttttcagcaggcatcggtaatcacattaggcaaatgtcttgcacacatgcattgtaaattaacataggtagaaccttgataatcaagcagtcccaaatatgtcttataacacaatgttaacattaggcaacacaatattataatcatcagatctatttcctgaaaaagttcagttgaggtaaatccgttgaggggcaaaaattcaagccgggtacagagc

SEQ ID NO: 481786 - DNA, 1566 bp, Homo sapiens
  misc_feature (35)..(35): n is a, c, g, or t
tcgtatcgttatcgatgtatttagtgtcagcaggncagtgctcatcgatatataattcatctcatgcgtcgtgtgctcgtagtgtggtatacagtcatcatttgttggtggtgtccaacattaaaatgttcgtgtggttgtataacctcgctgtgactcgttagtgcctcttttaggatactttgtataaattttcttgtggtggctgctcccctactctcttgttttgcttaataaaacgccccctagtttctccctaggagctttctcacgtggattattggaaaagtcctcctggctgttttgccaaccccttttgatggttccttcccgggttatactccccctaggtttgtttctcacatggcgaaagaatattgtgcctccccaagagggggaacgttttctttcccttgagaggccaagtggtgcgctccccgtaggtagcgtggctgaccccctctgatgtgccagcaagttttgtggctaccactcttctggcccgggggagttcacaacgtttgtcccacaaggggggctttctgcaaaggaaattgtcccacaaaaggggtgcttccgacgcaccgtgtctttaagatgatggtataacccccccccctcccccggttgagggaattgccccccgtcgagtaacacccgtttcccgttacattttcgtggatgaaaaaaacaagttgggcctatttttccccccccaatatacacggggaattttctcctatttcccccctatggggaaatcttctctctccccgagtgctcgtaaaaagtcgctctttcaaaacgtatgaacccccgacgggggaaagtctggctgtaccccctgtcgcggccccccctttttctcgtgttggcctgtttcacgccctctctttgtggggtttatcgaagctttcactgtgtactccgcgtgttgagcgccgcgcgaacacacaccccttttgtcccacactcgtgtccgcgcagggctccacgttggcccacgggtgccctttgaccccctcttagtgggagaatagcttcaccacaggtgcacacacacgaagtggggaccccgctggtacactcgcctgtgttctcgagaccccccattcgtctcgtttctcggtgtgccgcccacttgttttggtagctattataagtctctaaatcttttaatgaagggccacacgggtcctagttgttcgaactcgaagccctcacgggatcgatctcttgaccttattgcgcccaccacgatggaactcaccttgcccacacgatccgatgcggcgatcccccctacaacaagcctcaagtcacacttccaagccccctaccttgttctgtgcaattccgcgagggcaagcttctggaagcggggtctttctcggggaatctggcgccactccgccgggagatccacgagaccgccagaagcctcccccagctcatcccctggaaggacggaccggctttttatagcacacagggcttaacgatgggaacccccctcccacccacccgccaccattaagaatttgcaccacacctccaccccttcca

SEQ ID NO: 481787 - DNA, 119 bp, Homo sapiens
aggcgcccattcgatcttagcctgcgatggcccttccaccgagaagcccatcgtgcccacgtcgtccccgatagcctccgccacaaagtctgctgacttgccaacgacgacgacgacga

SEQ ID NO: 481788 - DNA, 137 bp, Homo sapiens
aatgtggcattgtgcccatttcgggtggagcctgagatctccctgatggggaccagtgacttgaatgcgctgccaggtttaaaacattgtgaccgagaaggtgctggctgctgtctacaaggtctgagtgactacaa

SEQ ID NO: 481789 - DNA, 325 bp, Homo sapiens
ccctattgttcatatggactctataaatacgattgcgctgttatcccttagcggatagacttgcttcctgtctcgcgtcaagattattaggcagtcaatctctattctagtagtctcctcttcagactggtgatttcttagcatgttctgctctcaggttgtgttctgctccaacgtcgtcccgaccgcgatttcgtatgcatgttcgttactttaggacctgtgtgattgttttctcctagaaggcttaataaattaaagctccatagggtcttctcgtcttgctgtgtcatgcccgcctcttcacgggcaggtcaatttcact

SEQ ID NO: 481790 - DNA, 206 bp, Homo sapiens
tggccatggaatatgacctcgatagtactaggcctcactttgctagaacttgggtatactgccatgctccagacactcctgcagctccagcttatcattaacagttggataccaactggcctgtacataccagggaaggttaacccacagaagtagcagggcccttagtgtgcaagatagacactatctcttggcatacaatcata

SEQ ID NO: 481791 - DNA, 836 bp, Homo sapiens
acagtaccagaacttcctcagtattcaagtaagatggaatctgttctggcaggtgtatgcatcgtgctgtacgctgtttgtgcctggatgctgtatcatagctagtgaagatgctgttaagtaacatgacttcacaaccactggtccagcaattgtgggtctacttcgtatctggatctcgatccctctatcatgggatattggtcctgtccctgctatacagttggcgcactgaacggaaagcaggactgagtcatgtaaggacatggatttggtagaggatcgaatgaatgctttttgctccccagtacttggctcttcgagacgatgtttggtatcttgacataagtataataccaatgtgaatgcgaggagccattcgctatctgggtcatcccaactagggaaggatctggatcaagaattactgcacacctggttcacgaattaaggcgtcgagtgtggaaaatatgccgttggatcagcttgcattggaggtggccaaggtattgctgtcatcattcagagcacagcctgaagagaccagtgagctcactgtgacccatccttactcataattggccaggccaccagtaaaacaagtgaccttcagagcagctgccacaactggccatgccctgccattgaaacagtgattaagtttgaactcaacgccatggtgacatcaaaaatgcattgatcatgaataggagcccatgctagaagtacattctctcagatttgaaccagtgtaatatgatgtatttctgagcgtgaactcaactatagaagacattaaaagaaatcgtattcttgcaacgtaaccaccacttctg

SEQ ID NO: 481792 - DNA, 225 bp, Homo sapiens
  misc_feature (66)..(66): n is a, c, g, or t
  misc_feature (88)..(88): n is a, c, g, or t
ccccttttttttttttcccccccggggggggaaaggaaaaaaggggcccccccccccccccttccnaggggggttttttgcgcccttnaagggttttgttttttttcccccggcccccccccccgggggtttttttaaaaattttgggggggggttttgggggttttttttttggccccccgggttttttttttttttggggatttaccccccctttttttttta

SEQ ID NO: 481793 - DNA, 282 bp, Homo sapiens
  misc_feature (274)..(274): n is a, c, g, or t
ccacacaacactgtctttctcaccacccgccaagcaaccagggcacagggctggttgctcacagattgagcgaggcagcacctccaaccagcactcaagttcaacagggccgcgttctaaacattcaactgaagttggctaagaaaccattaggtgaggctgggcacagtggctcacgcctgctatcccagcactttgggaggccgaggcaggtgggtcacttgaggtccggagttcgagaccagcttggccaacacggtgaaaccccatctcnacaaaaaa

SEQ ID NO: 481794 - DNA, 751 bp, Homo sapiens
gctgcgacgtgactggtagctgcgtgggtactggacccaagcaacgaggcagcgagcgaaggacgggagccggtaccctgggccccgttggaactccagccgtgtgcgatcgagtgacgcatacgctcgtgcgctgtgatcagtgcatataaggatatttggatttgacctgcattaatgaatcgggcatctgcatggtctcaagggatcgtgtgtctgacagtgcgtcttgcccgattcgagaactgaatgaagattgcaactttcagaagaagttccaacgcctgatatcactgacgcatgcttcacagggtaaacaacatgacctggacctaaacattccgatgcgataatcctgcaagggtcccaatcttagtcacacaagccttgcaaaagcaccggtccacacgtatccatgggtagccgacagagccactaatccttcccgtattgtcataggaatcaatcacaaagttaaaacaggggagtggtgcccagcgttaccatggctggaactaagaattttgtccgaggatccgaataaatagtacccttggcgaggcacaaccaaggtgtttacgagagaaacgactaactggcccgctcaggacgcgagaacttacgaacacacacagtgggaccggtcacaccgcgaacaggacgaacacggcttccgtcgataaaggaaaaggatggcggatgttggaaggaggatgatgcctggatacttagtggatgatggcactagcgt

SEQ ID NO: 481795 - DNA, 405 bp, Homo sapiens
cgtcgacacgacttttcccttacattttcaccagtacttaatcttggctttatttcatatattctagatgttcatcgtctgtctgcgcacagttaacaactgtgtttaccattctatcggctctctcttccggtgatattttcctttgttgtgtaggtttttaatgtcatgcaatatgtcacttcttgggatcattgcctgtgctagtgacatcttattcaaaatgtccttgactctattctttcttcaagtatgttaaattctcttttccttgaggtagttcaaattttggggggtcttttattctagttgttaaaattaatttaatgagagatgaaagacataggcctacattcattctcctacagcttgaagcactcttttccttgtatcgcttgtcgacgc

SEQ ID NO: 481796 - DNA, 326 bp, Homo sapiens
  misc_feature (43)..(43): n is a, c, g, or t
gtatctgttttatttgactgcagtctccttggtgcaaaaacanaatgggaaaaataaggataactcagaatttcaaaaggaaatcacaaattcagctagtaatagcattttcagtacttttcgtaaactaagtaaatacacaaaatgttgatttttctgaccataagacatattttatgtccttttgccgaggtggatgtgttagtctcaggccctcctggccacattgcccaagtcacacaggcttctgtattatgtatttagataaaatgtgtgaaaatatatttgaaaaaaagttcataaatatgcattgatttttgtacaaa

SEQ ID NO: 481797 - DNA, 1910 bp, Homo sapiens
atggccgccgacgtcttcatgtgctccccgcgccggcctcgcagccggggccgccaggtgctgctcaagccccaggtgtccgaggacgacgacgactcggacacggatgagccgtccccgccgcccgcctccggcgcggccaccccggcccgggcccacgcgagcgccgcgccaccgccgcctcgggccgggccgggccgcgaggaacctccgtggcctccagcagatcatccacagcggccacttcatggtgtcgtcgccgcaccgagagcacccgcccaagaagggctacgatttcgacacggtcaacaaacagacgtgccagacctacagcttcggcaagactagctcctgccacctgtccatcgacgcctcgctcaccaagctcttcgagtgcatgactttggcctacagtgggaagttggtgtctccaaagtggaagaatttcaagggcctgaagctacagtggagagacaagatccggctcaataatgccatctggcgggcctggtacatgcagtatctggagaagcgcaagaatcctgtgtgccactttgtgacacccctggacggctctgtggacgtagacgagcaccgccggccggaggccatcaccacggaagggaagtactggaagagccgcatcgagattgtgatccgggagtatcacaagtggagaacctacttcaagaaaaggctacagcagcacaaggatgaggacctctccagcctggtccaggacgatgacatgctgtattggcacaagcacggggatggatggaagacccccgtccccatggaggaggatcccctgctggacacagacatgctcatgtcggaattcagcgacaccctcttctccacactttcttcacaccagccggtggcctggcccaatccccgggaaatagcacatctgggaaatgcagacatgatccagccgggactgattcctttgcagcctaacctggacttcatggacacctttgagcctttccaggacctcttctcttctagccgctccatttttggctccatgctacctgcatctgcctcagcacctgtaccagatcccaacaacccacctgcacaggagagcatcctgccgaccacagccctccccactgtgagccttcctgacagcctcatcgcgccccctaccgccccatccctggctcacatggatgggcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccaggtgagccaggcggggagactcagtgcggggctccccccgacccagagggatgttttcccatcccaaaggctttcaaacttgtgaccaccaccaccaccctggtgtgcacgtgcatgcgcacacacatacacttaaatgaaacaaaagtgtcatgaaataatacatggccatgatcta

SEQ ID NO: 481798 - DNA, 435 bp, Homo sapiens
  misc_feature (132)..(132): n is a, c, g, or t
  misc_feature (278)..(278): n is a, c, g, or t
  misc_feature (282)..(282): n is a, c, g, or t
  misc_feature (298)..(298): n is a, c, g, or t
  misc_feature (316)..(316): n is a, c, g, or t
ggcaccccccaacagtgccagaaaaatatctctttagaagatagatcctcagtctgtttctttatgcacacgatccatttccacagtggatgttgtggttggctgcatgaacactccgtgacagtccacctntcactcagttgtaacagatgacttttctaaactttctcctcagattcctttttttgaagatatgtgtaaaggcattaaagctggtgacacctgtgagaagctggtgggatattctgccgtgtatagagtctgttttggaatggctngttncttctttatcttctgnctactgaccttgaaaatnaacaacagcaaaagttgtagagctcatattcacaatgggtaagtattttagtcttcttggggatggctttctcctttcttatgttcaggacagtagtccaggatcccatctgcccacca

SEQ ID NO: 481799 - DNA, 139 bp, Homo sapiens
cacatagctgctacccagaggggcggggttgacctagggtgaatatccaccgttttgtttttgatggatggctcccttcccccattcgccttcccagaatatcctgtcaagttccacttcccagggagctctgggggag

SEQ ID NO: 481800 - DNA, 236 bp, Homo sapiens
ccggccctctcttatgtgtgccagatggggctgtcctctgatttatttgcgtcatgcaggcagatgagattatgaacaggtggtccagaatccttggttggtggagagagcaggctgctgctgcagattcagtgtctgggaataggaatatgtcaggagacttgtagacactttggtgggtttttggcaaaaaacactagaataaaaaaatgctgtagtgggcacacattatggag

SEQ ID NO: 481801 - DNA, 440 bp, Homo sapiens
  misc_feature (335)..(335): n is a, c, g, or t
tactgatccatggcctgttaggaactgggccacacagcaggaggtgagcagtgggcaagcgagcattaccacctgagcttcgcctcctgtcagatcagcagtggcattagattcttacagaagtatgaagcctattgtgagttgcacatatgagggatctaggttccatgcttcttatgagaatctaatgcctgatgatctgaggtggaacagtttcatcctgaaaccatccccccatcacccttccccatccgtggaaaaattgccttccacaaaaccagtccctggtgccaaaaaaggctggggaccaccgtcttagaagggccctaggcttnggacctcttggatgttctttgggctcccatgcaagtaggagtttgggctaagacagaattgtaaggcagccttagctaattggaatgattacgcagcttcagagt

SEQ ID NO: 481802 - DNA, 426 bp, Homo sapiens
ataacaagaaaacctgtcagactgatagcacttcatttactgacgctccggctatactccaggaaacaacacatcactgagtacacgtcttaatatcaagagcacgcttgactacagtacctgatttaaaaatagaagacatccccagtcctcatgacataccgcaaatatctgtggggtcctgttgaaaagaacaaaataaaggagcccaaggggtcattctgtctcagcaccatccagccgtggcacttctcttcccatatatccattggattttttgttttttccctaaccaaagttttaacactagagcagattcctctgtcatgatggcggttgtgcacctctggtatcctctaatttggtaagcattcataaaacaggaaaaagtaaactatcatccggatgcacaaccccggaagggat

SEQ ID NO: 481803 - DNA, 286 bp, Homo sapiens
tttctatagcgacaatcagagacaaaaatagcttacattgggtcagatttgtctctagttaaaaaaaaaaaaagttcttaacccttattgtggtcccgacatagttagggaagccagaggggggataccgatccatttattaacttacctcagaagtaacaggtccacggggctatgaacaaagaactagaggaaacttgtgccaaaacaagtcgatatctagataagacctccccaggaaacaaaggggactcctgtcccctgccactcacgctaatatgacgtt

SEQ ID NO: 481804 - DNA, 980 bp, Homo sapiens
  misc_feature (868)..(868): n is a, c, g, or t
  misc_feature (872)..(872): n is a, c, g, or t
  misc_feature (889)..(889): n is a, c, g, or t
  misc_feature (895)..(895): n is a, c, g, or t
  misc_feature (916)..(916): n is a, c, g, or t
  misc_feature (970)..(970): n is a, c, g, or t
gagcacggcgcttttttctgaggtgtcagaaaccagctgaagtgcagaggccatccctgtgagtgaagggccattgagggtatgtgagctcaacagactgtacaaggaagctctacatgactgggaccacagactgtacaaggaagctctacatgactgggaccacagactgccctcccctctctctgcccacccaatgtcatccactcaggaacactgctgaccatctgcagagtctcaggaagtgatgggaaaagggcgggggagataagcaggcaaccctgtgattgcaccgtgagggcggaaaccccaccagctccccagtggcagggctccttctagacccaccagggcatcctcctgcgggtccaggacctcctttatcctcagggtaaagtctgaacttccccgcaaggctcaaagacccttctgggtgggcacctgctgcccgacggtggcaccctcactctgcccctcctatctgaagactttactgtgcgccactccgggctgtctcctccagggcctctgctcttgacgttcctgctgctggggcatgcgccctgccagagccccttccccacccccaatacagagatgagggcctgtctgcctgcgggccggcctgtctcacctgaccctgagcgccgtagagcagaaccagctgactttgctgtcctgtcacaagatggagcaacccacccattcatttgttcatgcactcattccacatagctggggcaaagcagatcctgatgtggatgggagacgggggcagctggacaggacgcagtgagctgaactccaatgtggcagggacaacactttggacacagggaaatctgcctcttatggaggacgtctgtcngggnaggggagggcagggagnagttcncgacctgagtgtgagcggcgntcgcagtcactggctctgcatgggaagctctgtgagggcagtgggggcgctacntcgtgtgcgc

SEQ ID NO: 481805 - DNA, 299 bp, Homo sapiens
cttcaaaagaagagaattggccaaggatgcacctataatcccagcactttgggatgcctgaagcaggtggattgcttgagcctgggaatttaagaccagccttggaacatggtgaaacctcatctctaccccaaaaaacacacaaaaaatttggcttggcatggtggcgcacgactatagtcccagctgctcggaaggctaatgtgggagcatcacttgagcccaggaggttgcagtgagctgagatcgtagcactgcggctccagcctcgggcgagcggagtgtggactctctctcca

SEQ ID NO: 481806 - DNA, 100 bp, Homo sapiens
atagtgtcggtgatgatcactttatactgttgtctggctcgatgatcactatatagtgcttgtctggctggatgatccactttagactgttgtctggctg

SEQ ID NO: 481807 - DNA, 113 bp, Homo sapiens
ttccaaatgttttatataaggcaagacctttttcggcccgttttaactaacaaggactaaggaagggtttttaataaacctattatgataataaatttgtccctatttcccta

SEQ ID NO: 481808 - DNA, 105 bp, Homo sapiens
cgggtctcttccggacctcagtggatcaccggcctcggcctcccaaagtgctgagattaaaggcgtgagccaccgcaccgggcctaatactggtattttggagta

SEQ ID NO: 481809 - DNA, 318 bp, Homo sapiens
tggaatcaacctgtgtctatcagcaaatgaacagataaaatgtggtatatatacgccgtggaatactatttggccattaaaaaaacaaaattctgttattctcagcaacatgtatgatcttagaagacattatgttaagtaagccaggcacagaaagataaatactccatgtactgtacttatgtggaaggtaaaaaagatctcatagaagtagagagtggctcatgcctctaatctcggtgctttaggagtctgaggtgggaggatcacttgaggcctggagtttgagaccagcctgagcaacatctctcaaagtta

SEQ ID NO: 481810 - DNA, 919 bp, Homo sapiens
aacggtggaacctctggtgcttattacaggaaatgtcggagagagagctggcgaccggatggaatagaacttggtgaatccagtatatggcagcaaactgttcatatcatttcggtgtgcaagattgggtaccacgtgatgacttgggttcatgacgtatgtacctgaacgtgtgtgtgtgaacatatatctaccacggtaactctgggcgtacgtttagatgtcagagggtgtggatgccaactcactcaaagacgcatttgcccactgtgtaagagagtactatcgtggtttcgctatgagtgcgtactcttatgggacctgccttctgcttcctcgatgattttgccgtgctcctgggaacacgtcgcttggcacgtagaagtaggggccctaatggtggacctcccgtccagggtatccatcgacggatctggacggttgccaagactttccaccttgaagtaaactatcacgagatagagagatcgtaatgcattaatctgggcgagcgtgacatgcttcgctcatggagcttcctcactgcgtgcgatatctcactttgcctcgaattgtacgtagtgggaacaccatttaggcactgctcgatgcggaacatttggcgtctggcgatgtgggcccttattacttgcttgatggtgccacgtttctgacccgtgataaggtggtaactgtcctccctgtgtctcgcgacccacgagcgttttagccgagtgatagcctcttaaactttctctaaccgtgatctggaacacaaggggtgttccctcgtaggatactcaactgttgggtagccccattctattccgaaggatttgccaccacgtcacccctttgccgtgctcggacgggtcacggaccttgcacgcaacccttccccggcctggtccctcacgcg

SEQ ID NO: 481811 - DNA, 162 bp, Homo sapiens
accctggcgaccttggggggtcgtgactggaaaagccttggtggacagtgcacgagatggactcttcttagagcctaggagaaactactgtggcagagccacttcagcaggagaccagatcaattacccaatgtgtcaaattcttctctcagtttgaatgca

SEQ ID NO: 481812 - DNA, 324 bp, Homo sapiens
  misc_feature (129)..(129): n is a, c, g, or t
  misc_feature (165)..(166): n is a, c, g, or t
  misc_feature (175)..(175): n is a, c, g, or t
  misc_feature (177)..(177): n is a, c, g, or t
cagtccccagagcttgggggccccgaaacgggaagaacaaactggggcacggtggcccccgtgagcaaatggtctctggggcaatcagaggccaggacagacgccgccccacccactggaaatggggcngagggagggggggggggccttcggggaaggggaggnnagaggggcncntgccccccgccctccccatcccctactcccactgctcagcgcgggccattgcaagggtgccacacaatgtcttgtccaccctgggacacttctgagtataaaacggaatacaataaaaaacaacatggggaaacaggtgcaaaaaaa

SEQ ID NO: 481813 - DNA, 185 bp, Homo sapiens
agaatttgagactagcctgggcaacatagggagaccctgtctctacaaaatgaaacaataaaataaaaaaaaaataaattttcttatgctaatacaggttgagcattcttaatacggtaatctgaaatccaaaatgcttcaaaatcttaagcttttcaagaggcatcgataaacaccgggtaccg

SEQ ID NO: 481814 - DNA, 301 bp, Homo sapiens
  misc_feature (78)..(78): n is a, c, g, or t
  misc_feature (232)..(233): n is a, c, g, or t
gtgttagcatgaagtatcgtccatgcctattctgaatgtattgctagttcctctagggtttatggtttaggtcttacnacttaagtctttaatccatcttgagttaatttttgtataaggtgtaaggaagggatccagtttcagttttctgcatatggctagccagttttcccaacaccatttattaaatagggaatcctttccccatttcttgtttttctcaaggtattgnntcaaacagcagatggttgtagatgtgtggagttatttctgaggcctctgttctgttccattggtctat

SEQ ID NO: 481815 - DNA, 890 bp, Homo sapiens
gaactcttcattgtctcgtgacttaagtactccctcatgtgagagtgcagccataatagcatccggttagaatagacacgagtatctgtaatctttggcatatagcattccacacatttctctaaatgtacctttcagtagcccagaaagaagttaaaattctgggtcaaaggataaattgaatatgtcattctgatggttattaccaaatactctttctgagacaagagtcttactctgtcacccaggctggagtgcagtggcacaatctcagctcacgtgcgagctctgcgctcccggtttccaagtgatactcgtcccgtcggcttcccaggttcaagtgattcttgtccttcagatcgtcccgagtagctggagttacaaggcgatctgccaaccatgcccagctagctctttgccaattgtcagctagagacagggttacacctatgtaggccagcatggtcttgaactcctgacctcgaagtgatccggccaccgttgggcatcccaaggtgtggggattacaggtgtgagcgactgagctggccaaatattcttgtgaaccaaagtttaagttttgcattgccattcccatatatgtgtcctgtatttgctccacaggctccaatcagatacagtggtgtttatacttcgttttgcaagtgacaaggtagaagcactggttcatgctctgtcgtgaacaaggtgagcatctttacatgttacaggtcatttacatttcttggtgtatgaagtattcttaatattgggaatcctgtcaatacctggtttgctggggttatggtggggtcaatcctagctcctattaacattttactgtaggttccaatggtaaaccacacaaaagtacaacccacacaggcaaa

SEQ ID NO: 481816 - DNA, 1401 bp, Homo sapiens
  misc_feature (256)..(256): n is a, c, g, or t
cgcaaaattagccacccataataaaattaattaaccactcattgcatcgacctccccaccccatccaacatctccgcgaatgtatgaaacttcgtgctcacgtccattggcgcctgcgctgatccttccaaatcacgcgactaggactgatataccatagaccatgacacgtgactcaccgagtagcggactctcgaacgcgaccgttgtatcatcatatcgtcccagcatacactacgacagacgttaaaattantgagacgtagaaatcactcgcggcataccgcttacactgccaagtaggtcgtcacgtcgagataatctcgtctatagtcgtgtccgttctatccatagcaacagtcgaggacgacgggccctcatatttagcggggactcaatgtatacattcgtacatcaggacataccatgataacattcaggcacttatcacttccctgacttgcaagctcactagagcaagcaagccctatcattagggcgtatagctccatccacagtgaaggcctaaaattattgatattcgtgaagggggccaaccacgttaacttgagcatatacctttagatactccccgaccgattgcaccagtaacagtttgggggacctaggatccttgaggtttccaagtcgaaagtcttgacggatggcttacatcgaggtaagaaacaagatcccgagccgcttcgactacgcaatgtcatgtcaacgccttatgcacattgtgcaattcctttagcgcgcgtttcactatggttgacaagccaccttagaggaaggctggattcctagaccgtcacatagtaccaaagacgctcggaaaacggggaattcaaaaaaaaaacgcaccatagaggaaatcgaacctaccgcagtgtccccagggaattaaacaggtcaacccaatttcccacacccagtgtaactatacaacaaggctccaaaagggatagcgccggtccgaggcttaaactatactcctttccctttccgtctcccgtatagaatgaacgagttaaacacacaataatactcaagccaaggaacctccgatagggcgaacccaaggacaaataagtacgccgaggcaaaaccacattgaaaacaacacaacaccaaacgtaaagaccgaaaagaatacccagaaaaagagcaaaagaaagaagacagaaacggaccacaaaagaaaagaagggaaactgccaccgaaaaacgcacacgacaccagaaaaaaaccgcaaaaacaaagacagaagcaagagagataaggcacgaaagaacccaagaaacaccaaggaaacgcacagaaaggaagaagagaaccgacgaagccgaagaaagaaaaagaacaaataaaaacaaaaaacgaacccgaaaacaagc

SEQ ID NO: 481817 - DNA, 197 bp, Homo sapiens
attgcaggccaagcttgctgatcgagtgggacagatcataaaacatagtccagatagactcatactagggatcccaggtacgaatgctgactttggcattatctacgtaacccctatttattgtcataggtgactctcataatacacctattgttgcaaaaccagtcaaaatcctaccatattaaaaagaagtccct

SEQ ID NO: 481818 - DNA, 1074 bp, Homo sapiens
  misc_feature (705)..(705): n is a, c, g, or t
  misc_feature (881)..(881): n is a, c, g, or t
  misc_feature (915)..(915): n is a, c, g, or t
  misc_feature (920)..(920): n is a, c, g, or t
acgcgtggggcagcatagccacagccctctttatatgctaagaactattctagaattggagacttacaaatcttaccttggtaactgggactcagtctgtgaaactcctgtacatccctccacagagcaatgaccctgacctccaggatttttgtctcagctgtagtattctgaggtttagagtggcctttacttaaaaacagcaacagttgttttttttttaagttaacacataatctttagtaaaatttgtcgaaaaatactaactttgattgtgtttggtcatttatcatgagtttagaaaatgtaaagttgtaattctctgtattcatatgaccaaaaggacttcttggcaaaatctttccacactaagttctcacaaataactgagtaaatagcaatcacagtgtcaatataataaccttcctactatgaatacaaattatattttcttaacattacctatttataattataactgatgcttttaggcaagtatgaataagacaatgtcaaggaagtgaaatataaatgagtcaaatgtggcaaagaaaagggataatcagaatgagaagctgagttgtgttctgctttaaaactgaaccttggctcttcaaagtaaccctcaagcctttatccaaaatatatcaggtaggggtcattaggaaacctaatagcatcttgtaagcactaataaaggttacngttctaaaagtcattttaaaacaaccataagctggcaagactgacagaatgaactttttcagaactctggaatctaattgaaaacttacaacagcaaccaagagactgcttaatgaagaaaagggcagctgatttttggcatttaaggaaatctctgttaggtaactggctgaccngtgagatagtggaacagagacttcagtgaccaanccaanaaggaatactgcctttgcaaaacagtttggaaaagtcactaaacaaatggatgactggagcccttaggaattaacaacaggcaaacctgaggcagggcagagacatctgattacccagtggtcatggttccgatggccagttttcacacagaag

SEQ ID NO: 481819 - DNA, 1037 bp, Homo sapiens
ggcaccttctctcgcggccgggggaccgcagcgcggggctagcccggagacccggccaccgtgcctggtggctgccttcactgcctgttctctgtgatgctgtgataaattgctgtgtgatgcatggcaccacgcctgtgcagactctggctggatcttgcgcacatgcggcagtggatttgctgtgctgccctgcgggagtgccctggggcagctggctgggatcctcagcggcggccggtttgtcctggttgtggtcaagactggatgatgtaacttggctctctaggaagcctcacttggcctgtaacctcaggaaggttctctttgaccccatctcatttcgaagccacttctgaagccacttgagaaaaatgatgtgacagttcctatcaaaaaggattcagaaacatataccatctgtgaagaaagtggccctttctcccgcttgcaaaatagacattctcaaattccaaaatgccagccaagagcccaatttacctgaaagcagccaataacaagaaacggccagacatttaaactgagggacattctgtctcctgatatgatcagtcccccgcttggagcactttcggcaaaacattcacattggcaagagggccagacgaggcttcggggatatatcctatctatccacgggagcctagagcttttacctgggaaacagcggaaagggagacctgggggcaggtccctggggctaaaagggtctctccggtgccacagcgcaccgcgcgcctgggtcacagagaagcacacccgcgggggggcacaacaagagagactgcccacccgcaggccatggtgggggagacacacgagaacgagggggcgcgccagggtgacacacgggacgaaaaacgagccgacgagagacgacgacgggcggacacacggctgacgcgccgagcatgaagccgaccggacggagaaggcaagagagagaaaaccgtcgtcagttgagatattgaccgatcgaacacgacacgggaagacacgagacggcagaagagaca

SEQ ID NO: 481820 - DNA, 384 bp, Homo sapiens
  misc_feature (13)..(13): n is a, c, g, or t
cccaccctgcccncggccctccccaaagtgcctgggattaccaggcatggaacaccgcactcagccattcaaactcttttttaaggaattttagtggactgtaaaagacagttttggaattgctacctgagtaatcttcttgcatgttttgcttgataacagatattttacaattctttattatttgtcacaaggacatagaagggtttctactggaggaaaaatttttgtcaggaggatttctggtattccatagaggcaccttagtgtcttcctagggaaaaccagcggagggtgcctgaatcccaccagtgtagcaactagcactgtggtttgcgttttatctgttctatatattggaattgtgcataagactttacttgt

SEQ ID NO: 481821 - DNA, 113 bp, Homo sapiens
aagatcacgccattgcactccagcctgggtcacaagagcagaactgtctcaaaagaaaaaaataaaaagaaagaaatagaatttaaggccaggcacggtgcatgctcatcacg

SEQ ID NO: 481822 - DNA, 1041 bp, Homo sapiens
gaaggagagggcatcctctgtccttatcttggccccttgtgtctgtctcacacacatctgctcctcagcacgtcagtgtggggaggggatgctccttaaaaccccaggtggctgactcctccccacccagtccaggacattttaggaaaaaaaaaaacaaaatacaaaagcccaagtattgtattttttcttggtatagtagaggtggaaaggagtcaaatccacccactagttaggccctaacttcgtcagaacaaactgttttatagtatcacgccgttctatgcgtcaaaaaccacctaccgtaagtatatagtgggcacccagtggttggtctgaacatacgtcacaagccggagtggaaccacactatatcgagcccctggggaggcaactaatgctatctcatgtggctaagcatgacaagacattcctacacagtcccgcggagtcaaagtccattgcagatacaaagcaagacaaacacaacatagaaacctcgagctcacaacaacaaggacacaaattaataaacaaatgaaaggcgacccacgacaaatattctatcccctcactggatgaagacccaaaccacgagggcatgcacactacagggaccggggggagacgaacacctgcaaaaaggtagccccggtaaaacccgagcccgagcagattctcgggggaggagccagcaggctgcggaggcccgccaccaagaatccacgacggcacccgagtgggccaacgccgatcacgtggtacaagaggagccgcggctaccacataagcgttgcgacaaggcacgcacacaaccacttgttgcaagagggtcccgcgctccgtcgcgcctgtatctatgagccgcccgggggggctcacaaccacagtcggcccgccgacgttggccggtccagagaacaccgcggcgtggggcaccaaacacaatagtgcgcaggccgggtgtgtcaaaaccgccaccggggggggcgcaagaagggctcattgcgcgcgggaacaaacacggtggtccgttagagc

SEQ ID NO: 481823 - DNA, 129 bp, Homo sapiens
atacaagatcatccgtataacaatagtggagacaaattgataaataacaggtaaaagaaagatattctaggcaattactaggatcatattggaaaaagtgagtacagtaggatatttataactatcaca

SEQ ID NO: 481824 - DNA, 234 bp, Homo sapiens
tctctgttgtatttttatataattagttatgttgcaaaaagtcaccgtgaaactggattagcaaacactgaaccactgctctactatggtgttagattcctgaaagctgctgttcacaacatttttgtcaactgatcaagatacaaccttgttttatgtctgttgcagtttaaatacaccttatttaatatatttggttgatttattaacattgaaatcatggcctgtcgacgc

SEQ ID NO: 481825 - DNA, 413 bp, Homo sapiens
gcagagtagcatccaagatggagttgctttaacctcaataggccctttatagaagaattttcctaggctgggcgcggtggctcacgcctgtaatcccaagcacgttgggaggctgaggcgggtggatcacgaggtcaggagattgagaccatcctggctaacatggtgaaaccttgtctctactaaaaaaatacaaaaaaattagccagggatggtggtgggcgcctgtagtcccagctacttgggaggctgaggcaggagaatggcatgaacccgggaggcgtagcttgcagtgagctccaccactgcattccattcactgtgccattccattcactgagccattgcagtgagatcgcgccactgcattccagcccgggtgacagagcgagattctgtctcaaaaaaaaaaa

SEQ ID NO: 481826 - DNA, 372 bp, Homo sapiens
catttattcttaagcatgttttaagccttcatttagttcatactgaagaatataataagctttcaagtagctcatataatacttcgggagattaggctgtcaacaacttgtttaactgttaagagaacattgcagtaatgtacctctgttagtgagcaccttctcttctgtgcttatctcttcaagataaatacatggaaggatgtgaaaatcggaacaccaactatgtgtctcactgcatctaagtgaagcagccacagctgtgagagttttcaaagcagaaagatgctgatgtgacctctggaattcagacatactgagctatgggtcagaagtgttttacttaaaaagcaaacaatccccaggaaatac

SEQ ID NO: 481827 - DNA, 117 bp, Homo sapiens
cggagctgcagatttgatggcctactgtgaagcacgtgccaaggtgagacccctcctggcccctgttcggcttcagaaaacccgtttagggagaagaagtttttctgtgccatcctt

SEQ ID NO: 481828 - DNA, 255 bp, Homo sapiens
ctctactgctccagaagctaaaaagccaaaataaaggtggtgaatgttgagctgctattgaagccacttggtctggcagttagggaaagaccttcttatacatgtatatatggggccggaaggttagatgattattgccagataaattcggaaaaccgaaaggaatgattgctataaaatgcagttgcaggaatattgtgttattaagttccagaggacacagctgtgttggacccattatgaaaacatttttat

SEQ ID NO: 481829 - DNA, 549 bp, Homo sapiens
actctatcctcatgacttttattatttatgaatagcactcaaacaattatttacttcctatttttctataaattaattgattttgaaaactagaacatgtttattttaaaaggaaacacagtagccctaaggtaaatggtagactgctatcccttgccatacatttaaggtaatcctaaagataattatcacaaagagagagcaatattgtcaaattttatttagacaatattataacatttaactagacactatatctaactaaagactaattccaaggtctgcactcactttggttttgttatgtataaagggagagaagtagatgttaggtgttaaagatagcttcaaacgaagactttttcttgacaaaaccagaaagattgaaaacatttgaaaagggactaactttctcagtgtgtgactcaatgctcttgatcctttgtatccctaaaatcctcttgtcggggtacaatttgggaactaacgactgatatgaatatggagaatgctcatttgaataaggaaaaattgtatagaattgtccca

SEQ ID NO: 481830 - DNA, 284 bp, Homo sapiens
cacattatgcagtgtaggaagactgaaagtgtctatctatacatccgtgccccttgactagtcttagatactagattcactatttacacctaagatcgtgtgacctatcaatgctatgctctacaccacttcacaaagtatgttgttgcagcacctgtggtcctaggaaaagaatgtagacgacgggagtctaaagagcatgggtttgagtcatagctctttcctgatctagccatgtgactattaacaagttactccttcttctgttgtctcagagttttcat

SEQ ID NO: 481831 - DNA, 546 bp, Homo sapiens
tctggatgcgaagtgttctatacacgtagttgtaaaagaataatttcctgtagagaaacctaatctaatagagacctactcataattgggcgaaatcatactcataattccatgctactgaactgggggtgtaatacagacacacatcattcgtctattcatttaaccagcggctttattaagccaccaactatactgcccagcaacttcgcagcgcactggcaatttcacgcagataagaaaaccacagctttctgcccctcaaaactgctaggaactctacagcgctctcacacatcaccagcgtccccttcaaacccactgctcctaccagcgaacactaaaactaccctgcactcctcactcccctgcaaaccaacctctactacagtacagaacctgcttccctagccttggaaactatacacaattgaacatgaacatgacagccaaagacttctacactcaaaacggcaatgatccaatcagcccagtcaaggctgagtgggtcgaatgggcgactccacctcgcgctcaacgccttga

SEQ ID NO: 481832 - DNA, 408 bp, Homo sapiens
ctccccaaccccccttttccctagttattaagacagcgaaaagggagaaagcaaaaagctggaaaaaacagaagtaaattaaatacctagacgactttggcgccaccacctggccctggtggttaaagtaacaataatattaacccctgaccaaaactaatgttgttatcggtaaatcccagacattgtatgagaaagcactgtaaaaactttttgttctgttagctgatgtattgaccccccagtcacgtccctcaagcttccttgatctattatgactttttcacgtagaacccttagagttgtccacccttaaaagggctaggaatttctttttcagggagctcggctcttaagacacgagtctgccgacgctcctggccaaataaaaaaacttctttcttcttt

SEQ ID NO: 481833 - DNA, 277 bp, Homo sapiens
tttattggttggtcagggagaatgagccgggggtaagggtccctttccttcccatctcgtctacccagaagacaccctccaaatggactggagaagtcccagagcctgctggctcagaggaccttgtgaggcagacaaattgttgtagtgatcttccgtgtccctcgagcaggctgcggtaggtgtcaatctcctggtccaggtcgcgacttgatgtccatgagccgctgatactccttgatactgccggtcattatcaggtcgtgcatcgcccagt

SEQ ID NO: 481834 - DNA, 242 bp, Homo sapiens
ccacactctaaccgcttgtgctatctatagatcacagacaatggtatggagtaacacttgccttgctcatctcccctacctagccatgtaccccatgcttgttcaatctatcacgtccctttcatgtgtaccctttagagcttttaacgctttaaaggtccatgaactctttctctgtgacttagttcttgtgatccaagcctgccgttgctcctgtgccgaataaagcctcttcctttttt

SEQ ID NO: 481835 - DNA, 347 bp, Homo sapiens
  misc_feature (145)..(145): n is a, c, g, or t
  misc_feature (178)..(178): n is a, c, g, or t
  misc_feature (297)..(297): n is a, c, g, or t
  misc_feature (316)..(316): n is a, c, g, or t
gcctgtaatcccagcactttgggaggctgagctggatcacttgagttcaggagttggagaccaggcctgagcaacaaagcgagatcccatctctacaaaaaccaaaaagttaaaaatcagctgggtatggtggcacgtgcctgtnatcccagctacttgggaggctgaggcaggaggntcgcctgagcccaggaggtggaggttgcagtgagccatgatcgagccactgcactccagcctgggcaacagatgaagaccctatttcagaaatacaactataaaaaaaataaataaatnctccagtctggttcgtttnacgggactttcaggttcttttctggaaatcg

SEQ ID NO: 481836 - DNA, 1010 bp, Homo sapiens
cggacgcgtgggtcgaatttttttaaagtatattccattattttggcatttttgatgtgtcaaaactttgacagcttttatgtagaataaaaaaatttttaaatttgtgtattgttacatatgtttgcatcaagctagcagccaagaggttaattgtgcaactataaaaaaaaaaaaaaaaaaagaaagttggtctaaatgtttttaaagaaaaaaaattgtaggtacgcttttactttttttcaatatttttaccccttgctgggtttctgtcccagaaatggcccgttgatgtccacatgttttgttcattttggcttaaatcctttacacattttttttcaaccatacaggggcagcatcttctaaataagtttatcagctttttttttttttttgggcggcccgatgctgcttcctaacactttctttgttttcaccctcttgtttgcttcggtttgctggtaatcctcctttcccccatggggatacgatgtttaagaggcatcccttggcggggcctttttttcggtttcccccctggttctgttggtcaatgtcttaacaaacaaccggttgggcctaccttggtttttctttgtgcgcagacgctcaccttttccagggcttgtcttacggggtcaattggaagcctcggtggttctcttgtttgaaaccaatttcccggacctgcaaaaatttcggatctgcggggggcttaacaaacctgtatcacctatttaacacggcgttcattttgaaaatctgtcccacatcctgttacacttttaaccggttccatcttccagggtaaaaatggcggtaggtgaggtttccccagaagtgggccctttgtgtacaaaacggcattcggaccacatggcgctgtgtgggacacgtgaatattttgtcaaacaggggcaaatctgcgatacacttaatctaggattaagcgacagaagttgagtgttgtccacagcttatatcatatgattgttcacatcactagt

SEQ ID NO: 481837 - DNA, 283 bp, Homo sapiens
tgctctagaggatcttattggtgcggtgggtcatgcctgtaatcgtttctttgggaggcaaggcgggcagataacctgaggtcaggagtccaagacagcctggcaacatagtgaaacccgtctgtactaaaaatacaaaaaaaaaaaaaaaaaatttagccaggcttggtggcaggcgctttgtagtcccagctcactcaggaggctgaggcaggagaatcattttaccctgcgaggcaaagtttcgcagtgagccgagatagagccattgcactcgggccgg

SEQ ID NO: 481838 - DNA, 145 bp, Homo sapiens
gaaaactcgtgggctcaagccgttctccagtctcggtctcccgagtagctgggactacaggcgccccaccgtatgcttttgtaaacaaagttttattggaacatagctcatttgtttacatattgtctacagctgctatcctctt

SEQ ID NO: 481839 - DNA, 757 bp, Homo sapiens
taaggcccctttgatttttggtttccacattagggaaaaattggtattaagattaggattgtggggaataaatccggatgctacttgtccacatgatggtaaaagggtagcttacgggttgtcctccgcattcaggttaaaatgaggaggtctgcggctagagagtcaacaaagctgatatgtgcttatggggcgaaatattatagcttgttgtgttgggatatatgtcgaggatggggatatattgctaggatgaggatggataagtaatagggcaaggcacgcctcctagtttgtgtagggacggatcggaaaatttgttggttggcgaataggaaatatacatctacgggcttagatgtaggggaggggttggttacaaggggtgtgggcgggggtaaaacatcggtgctggggtcgcctaagaggtctcggtgaaacataagttgttgaagtgtcctcaaggaagaagaatgaacgaaaattatgccgagggggttctttgaattgttgtaacaggggtgggaagggtagatccttatcgcaagtgggagggtgaattcccaaagggggggttgttttgactcccctctttgtgccaacaataagaggtgggcgtgctgataagggctgcaccaatgagggggggcaataaattgttaggtgtaaaacacttgtgagggctgtgacatgttactgaaataagtcctcgaattcttgaaacatgttttcccatgtttggttcgggaaaacattg

SEQ ID NO: 481840 - DNA, 794 bp, Homo sapiens
ggtcctgcctggtgtgccatgctgctgctggtgcattgtgcatgtgtggcctgtgctgtgtgtgctgcatgatgctgtgatgcctgcctcgtgagcctgatgcctgccctgtgcccatgtgctccccctgtgccctgtgtgccctgccgcctttgtgcttgctgcctgctgctttctgcaactggtgtcctgtgctgctgcatgtacatttgtgtgctcaatgtggctacaccaatgtgcctgttgtaccctgtgtgtcctgcccttgcccctgtgctgtgttgcctgctgtgttgtgctgctcaagtgtccgtgttgtgacctttaggcttgtgcacagcggagttcttgtgtgcaatgctttgctgttgctgctgatggtttctgggggtgtagccgtgatggtgtgtgcttttgctgttccgtgtgccttgtgcctgtgcgcacaacaattgctttgcctttacgatcgtggatggacgtgtgtggtttgcgttagcatatgtgagtgcctggtgctttgctagtgcaaacccaccaaaaagtctgtttagacattagccagtggcttcattagttgtgacctagactttggcattaagcaccaattgtggagcagtggcctgagtggggtatccaagttcaaaccaagtggagcaaacccacgttgaaaacacgagcacagtacaagcatgtggatgtctttggggtgactgcccgccccctttggttagggagaaaatttggaattcccgaggtcgtttggcctttggcaaaaagcttttccctttggg

SEQ ID NO: 481841 - DNA, 114 bp, Homo sapiens
tgcctatccaagaaacgattgaagcaggagaagcaggcaggcagaatcgtaatgaggcgtgcgccgccgatatgacaccgtacattccgcaagacattgccttcttattattac

SEQ ID NO: 481842 - DNA, 315 bp, Homo sapiens
  misc_feature (124)..(124): n is a, c, g, or t
acagatcctggattaaaaattttgaatatggcttcttgtggccctgacaaaaactcgctctgtaaaaaaaaggaggatacaagatcagcttctcccccgatagaggcccaaggtaaaatgttgncaggtgtaagcatgattttaattttaaaacccgaagcaagtctataagctagtgaagtaactatcccccctagcccaaaaatgttatttaattttttttggaaaaaaattcttataaaacaattttgaaaaaaaagtttgcaaaaaaaaaatccaagtggtaactaaccatggcccccatggctttttcca

SEQ ID NO: 481843 - DNA, 245 bp, Homo sapiens
  misc_feature (149)..(150): n is a, c, g, or t
atctagagatcctaagatcctacagataagctgccgcagtacacagcagcagcggctggaaacatatgggaaaggagctgtgtcccgggagctgcagatgctgttggtgaaagagggtgtgcagaatgctaagaccgatgttgttgtcnnactccgttccttggatctcgtgcttagtagagggcctctttctaagtccctcttggaaaaagctggaccagagctccaggaggaattggacacag

SEQ ID NO: 481844 - DNA, 178 bp, Homo sapiens
tcgaacattcccaacagccactgctataggttaggtgtcacatggggaataggtccaggcctctatggctctcgcaggagtcacgtggcggcagatcagataacatatcacagaagaccagaatataagaacctgcctgggaggacggcatacatgactgcgtggcacagtacctcac

SEQ ID NO: 481845 - DNA, 209 bp, Homo sapiens
  misc_feature (6)..(6): n is a, c, g, or t
  misc_feature (26)..(26): n is a, c, g, or t
  misc_feature (63)..(64): n is a, c, g, or t
  misc_feature (84)..(84): n is a, c, g, or t
agcgancggcgctcagtggagttccngccattaagcgggttgacaacgccatcgaactggtcnncgaagacggtaaaaagggtnagttccctggtggccaaactgtaacgtatggcttgaagcaaaagggtgttgatattgcccgtgattcaatgccagaaaatgcttgggccgcaacacaagcagctaaacaagagattttagatggt

SEQ ID NO: 481846 - DNA, 243 bp, Homo sapiens
ttctccatcactatagttttgccttttccagaatgctgtaagtggagtcatacaatatttagcctttcagtctggcttctttctcttagcagaatgcatatgagatctctgttgggtttaccagcgcgctgctcatccctttttattgctgagaagtattccatcatgtggatgtactactgtttgtttatccattttccagtggggttgtttctgattatgaataaaggtgctataaacatt

SEQ ID NO: 481847 - DNA, 325 bp, Homo sapiens
  misc_feature (58)..(58): n is a, c, g, or t
  misc_feature (80)..(80): n is a, c, g, or t
tcaaatctgcaatcgcaagctgtccgagacccatgctggttgcatagttttcaagatnacttcttgttattcccaatacnctagcagttaatgctgcccaggactccacagatatggttgcaaaattaagagcttttcatcctgaggcccaggttaacccagaacgtataaatctcaactggattggtcttgattttatcaatggtacacctcgagacaacaaacaagccggggtgtttgaaccaaccatagtttaagttaagcgtttgccctttgcaaccgaagctgccatcaccattcttcgacttgatgatcatgtagcgta

SEQ ID NO: 481848 - DNA, 175 bp, Homo sapiens
  misc_feature (154)..(154): n is a, c, g, or t
  misc_feature (160)..(160): n is a, c, g, or t
cccgagagcatgccctatctggcttacacactgggatgtgaaacaacctaattgtcggtggttaacaaaattggattccactgagcacctacagccacgaagtagactatgacggacaacttggttacacggacagctcaggcgacgttaccantttaangcaacacacttgggc

SEQ ID NO: 481849 - DNA, 213 bp, Homo sapiens
  misc_feature (69)..(69): n is a, c, g, or t
  misc_feature (72)..(72): n is a, c, g, or t
atacacctatgaagattataagaacactgcggaatggcttctgtggcacaggggggcgccgacctcaanttncaataatctgtgggtctggattaggaggggtgactgataaattaactcaggcgcagatctttgactacggtgaaatccccaactttccccgaagtacagtgccaggtcatgctggccgactggtgtttgggggggggagtg

SEQ ID NO: 481850 - DNA, 269 bp, Homo sapiens
aagaccagcctggccaacatggtgaaacccatatctactaaaaatacaaagattagccaggtgtggtggcgcacgctgtaatcccagctactcgagaggctgaggcaggagaatcgcttgaacctgggagacagaggttgaagtgggccaaactcacatcactgcattccagccagggcgtcagagtaagactctgttctaaaaaaacaaacaaacacaagggtactatgagaaagcatccagcattgggtaatgtcacatccttgctt

SEQ ID NO: 481851 - DNA, 359 bp, Homo sapiens
  misc_feature (9)..(9): n is a, c, g, or t
  misc_feature (53)..(53): n is a, c, g, or t
aatcacccncccatggatccgccaagcctctgctggtttcctccagcacccgncgtactagcaatgccccttcctaccaccgacgggtgctctcttgagaaaatgcacgttcacgttagcctacccacaaaccaaacgaaccaaaattaaaactccagggggggaaaacaagacattatacaacctcgaggcaaacaacttctggcttagcccttgcttgagttatcagtacaaaggcgccgttctgttagatgggtggaacctgagagctgcccgcagtttggggttgaactggagacagagaacctctgctgggctcacaccagggccaccgggcttggtaacttactggtcagtgc

SEQ ID NO: 481852 - DNA, 551 bp, Homo sapiens
cgcgtggctcacgcctgtaatcccagctctcagggaggctaagaggcgggaggatagcttgagcccaggagttcgagacctgcctgggcaatatagcgagaccccgttctccacaaaaaaaaaaaaaaaaaaaaaaaaaaaaaatttttgggcggcttgggccttgagaaaaggtttttaaaacctttcggttgggggcgggggccccagtagtttaaggtgtcaacccttgtgggccataaaggcgtgggtcccctaaaggagaaagactccgtggcgccaatttagccaaagggggctgggggagttttcttcaccaatttaaaaaaagcgcgcccggggggaaaaccccggagcggtgtttcgttggaccaatacttttcccaaagagtgggggaggttgtctgagagcggccacaatacagggggggagcctctatatctacacaccagagggagatgtcaccagaggggaagacgctccgagattttcaaatatttaacgcccccggtcgtgtggtggggatacgagtcacgaagtcacgataaag

SEQ ID NO: 481853 - DNA, 962 bp, Homo sapiens
  misc_feature (369)..(369): n is a, c, g, or t
tgtcgataaggtccgccgcgtccgcgtttgtagacgacgtggtttccgaaagaagttaacaaaactgggggcggtatataatgaccccacgccgtctgtgagaaagcgggtgcttgtcaggccagagtggtgtgtccacaaacaaagccggcccattggggttgtaggttgggaatccccccatctggtgacattcttgtggaagagaaacaaatccgttcgtcagaggtggtcgtggagaaaaacacttttgctggggcggtctcaccaaaattgacaagcccgtgcttaagtttagtggggagcacagacaaattctctcgacaggagttagaagagaggcatcacccaataattaaggatgctttncaagagaagccggtgtttccgagtgcgctccctctagagggacagctctttgtggtacaattggccaagtactgcgccccatgagcaccgctcccttcactcctttcaagcccctctgttagtgttgatgcgcgcacgcccgctctacattgtatgaataaatttacgaccagccccacttctgttgaaaggcagcaacaatgtcagccacgcgaggttattattataaaagaggggaatgttattataaaagggctagaacactgtcgagctttacaagaaaacattagacagactcatttggtggcactcccccacagggtagtcgccaccagtaggtggaattctgttgcctgataaggacccctctgccccagacgagattgtttcttaagagacgcgcaatcctcaccagcgcatcagtcagggccctcgtgtaagatatgaagaagagggaggcaataaatatgttcggagagaagttgggggggcgtgcacttgattgaacaatgtaagaaagatctctgaaataaaaatcaagaataataccatgttcaaaaacaaaaagcagaccttctgtcccacaaaaacga

SEQ ID NO: 481854 - DNA, 282 bp, Homo sapiens
  misc_feature (176)..(176): n is a, c, g, or t
agcagtagtgtgtcttcaagcctttaccaaaaattatccctacttggagagaaaacttgggaaatgtaatcaatgtggcacaaaatttcaaccagttttttaaacagactacacatcttgaaatcataggagggaaacctaaatttctttcccaaagaggggcgtgtaatattatnacagaataactaccagacaacatttgttaaaactcaggacagtatgtattttaaaggagcaagtgcatgtgtgaaaatggctcattcagtttataaaatattacat

SEQ ID NO: 481855 - DNA, 82 bp, Homo sapiens
  misc_feature (5)..(5): n is a, c, g, or t
agccnattattgtcggctatgtgctgaagtatattttcagcgtggatgattgccagcctgacattattgatggtcgttattt

SEQ ID NO: 481856 - DNA, 974 bp, Homo sapiens
tccatcgcggctcaggctcccgaagtgctggggattactccgccatgatgaataggcctgagccacctagcgccagtctactatagaatgatgctatccatagatgcattgtgtgagctctgattatgtcagatggatataatagatcggatctcagaaatatcagcccttggatgcataaggcgtggtcgtgaatatgttttgtattaaagcagtgaactacgggtccgaatatgcaatagatcgatagagagtgggagagagaaatggggtggaaacgcaggaattgtggaaatattgggatctttaggggccatatagttgcattctaattgtaaaaattatggtgccgcaagtaaggaaatgtgatgttattgctaaaatgtaccaatcattgtttaaggaatgtggaaacatcttaaatacagggtgtacctggaaagatgtggtcattattttggttgaactaggaaattggtaccaggcctgaggtgcttgtgtcgggagcagggcgtgaatgatcatggttgtgcacgctcgatgcagtgatatagtgccttggaaaggtccttgtctatcaggaggaattgagatagtgaaggaggagggggagtcccataggtcgggactaaagattttactgtgtcatcattcccaattctcgtgtgggttttcgggccttgaggtgcaaggtaagtcttaggttggacccaggtcaatttcggtggaataatgtgaaaatgagccgctatcgcctttggtgggcaataagatggacgggtccatggggggggcattactggaccattggggttgccgggaatcgattggcgtaactgggagaggaaatcgggttaaaggggggtggaaaaaggggaaggggtttgagaacaaaaaaatagaaggaggaagagaagggccatttggagcataacagggagagaagagcatgcagaaaaaaaattggcagggat

SEQ ID NO: 481857 - DNA, 891 bp, Homo sapiens
ggaggtggtgtgtggggtaagatggtgaaggcggtgtggtagcaggtgaggaacgggtgaagtcgggatgtggcgggcgcgttgccaagtggggcggtggcgcggaggtcggtggctaggcctgtgcacgtgagtgacgcgctgggtgccggcacatcaggaggaagttgccggtggtcatgaactatgaccgtgggtgaggatcggcggagtgcctcgagcagcacggccgctgtcagccagggtgtcagcggtcgtacacggtgtggcagggtccatgtgatagggtactcgcccgttcccgcttcagcgcggtaatagccggggtattgcccacatcgcgcgcaggccggttgagtaacgggtagtcctgaccatctgtgggaaagccggtaaaggccagatagggtctaacaacgccacgatccgtcgacccacggagcccgctcgtcaacatgagcacccgcgccgggtactattgtgagtcgccaacgctgtggccccattactcatcgtggccatggatggtgttggcaaaacggtcaacgttgcaccaccccatcaacataggcaccgttctgatgctcccaaccggcataagcccccagggtatagctatcgatatgtacctttgccccgcgatcgaaaccgatatcagaatgagagtaaccaagatcaagccgcgaattgtactgctttcttcacgggagaaacggctatcgaataccgagcgtcaggcccgtcaatgtttgctcaaaccagctcccgcatcagtgtcacgttgttgcgggtgttaattgccgaactccacatcgccgtatcgtaactaacgccttttacgctaccaagacgctcacgcacgggtgtccagttctgcatcaaataccagcg

SEQ ID NO: 481858 - DNA, 225 bp, Homo sapiens
ttgatcgccggagggcgctgtacctgcgcgccacgtacgtgaaacaccggtgtttgaacgcgaactgcaacaaaaccgtcagcggatgctggacaacacgcctgctacaccagataaccgcagctatctgcaacgcactaaagccttctggatcatgctgggcctgcgtattggcgagaacggcccatcctatctgtgccagggctttatcgtgggttacgttgc

SEQ ID NO: 481859 - DNA, 936 bp, Homo sapiens
  misc_feature (9)..(9): n is a, c, g, or t
  misc_feature (32)..(32): n is a, c, g, or t
  misc_feature (86)..(86): n is a, c, g, or t
  misc_feature (124)..(124): n is a, c, g, or t
  misc_feature (167)..(167): n is a, c, g, or t
  misc_feature (184)..(184): n is a, c, g, or t
  misc_feature (237)..(237): n is a, c, g, or t
  misc_feature (252)..(252): n is a, c, g, or t
  misc_feature (357)..(357): n is a, c, g, or t
  misc_feature (522)..(522): n is a, c, g, or t
  misc_feature (525)..(525): n is a, c, g, or t
  misc_feature (528)..(528): n is a, c, g, or t
  misc_feature (542)..(542): n is a, c, g, or t
  misc_feature (628)..(628): n is a, c, g, or t
  misc_feature (770)..(770): n is a, c, g, or t
  misc_feature (801)..(801): n is a, c, g, or t
  misc_feature (921)..(921): n is a, c, g, or t
cagcacgcnccacacgcacccgcagccaagcncaccaccaacgagcgggagtacgaagagtaggaaacacagcgtcgcaggcagcngcagtacaaggaaaaacgaaaagagtaccaagacaaancacaaagagaggccaagtatccagaaaacagaaaacgaaacanaaacagagaagaaagcncaaaagaacacagtagtgtaaaacagcaaaaagcagagaaagaaaaaataaangccagtaaagtaganaaagaagaggcacaaaggagtaacaacaaaacacagggaccacaaccaaacacaagcagccaatacaggctaaaggtttggcagcagaagaccaaagcagtagtnaagcagaaccgcattgtggagaaagaaacggaaaaaagtgcacagaacaggccaacagaagaccaagagaagcagtataaagaaacaggattaagtgtgaagcacaagtcagaagaagtaaagacgaaaaaaacagaacaacaacaacaataagaaaaaatcaanagnggngaaaccagaacaanatctcactttcattatactacctggccagattttggagtccctgaatcaccagcttcatttctcaatttcttgtttaaagtgaganaatctggctccttgaaccctgaccatgggcctgcggtgatccactgtagtgcaggcattgggcgctctggcaccttctctctggtagacacttgtcttgttttgatggaaaaaggagatgatattaacataaaacaagtgtnactgaacatgagaaaataccgaatgggtctnattcagaccccagatcaactgagattctcatacatggctataatagaaggagcaaaatgtataaagggagattctagtatacagaaacgatggaaagaactttctaaggaagacttatcncctgcctttgatcat

SEQ ID NO: 481860 - DNA, 129 bp, Homo sapiens
agggccgcctgccccggccagaacgggcagggctgccactgacctgaagactccggactgggaccccactccgagggcagcgtaccgcttgccggcccaataaaggacttcagaagtgttccctgaaaa

SEQ ID NO: 481861 - DNA, 257 bp, Homo sapiens
  misc_feature (16)..(16): n is a, c, g, or t
  misc_feature (46)..(46): n is a, c, g, or t
  misc_feature (140)..(140): n is a, c, g, or t
  misc_feature (156)..(156): n is a, c, g, or t
  misc_feature (171)..(171): n is a, c, g, or t
  misc_feature (200)..(200): n is a, c, g, or t
tccaaagaaaggctgnggtggtggagtcagcgcccccattagaagntcgcgcctagagcggtctgaggtgggtgtgctgaagattcggtggcgtggagggcggctcgcgactctcttggtatccatctctgatgtggcangagcaggatgagcgcntcaaccgagatttcnctcgcggggcgatatcttatctcatggtntggtgcagccgtgatctctttctgatgcgtcaggatcccaggtaatctggtgcccca

SEQ ID NO: 481862 - DNA, 363 bp, Homo sapiens
  misc_feature (143)..(143): n is a, c, g, or t
  misc_feature (154)..(154): n is a, c, g, or t
  misc_feature (158)..(158): n is a, c, g, or t
  misc_feature (160)..(160): n is a, c, g, or t
  misc_feature (167)..(168): n is a, c, g, or t
  misc_feature (197)..(197): n is a, c, g, or t
cgctttacttgagaaccttatacgttgtgctgggaacaactgagggtgtttaacaaagaaacaccgattaacttttatgggggaaaaacttggtggcttcttctggatgatctccagtgatgctcccccatgctgaccacagnttccctgcagntgcncncagcatnnggataggctctatcatagaatttctcgantcatgtgccatagtacttacattagatccttgagggtgggcactgtggcttatctgacccctgtattccctgtagttcgggcagtgatttgcagaaataggcatttaataaacacttgccacaaaaaaacaacccagcataaaattttaaacgcaaacaaaaggtt

SEQ ID NO: 481863 - DNA, 120 bp, Homo sapiens
gttgactttcggccaccggtgccgccgatgtcgttgccggatactgaacggccactggtcgggtacctcctacctgcgtgacacggccgcgcggtgcgttgcttactcactcggggactc

SEQ ID NO: 481864 - DNA, 302 bp, Homo sapiens
  misc_feature (296)..(296): n is a, c, g, or t
aatgagccggaccagcaggctgggcccagattaagatgtcaccgaatcggagctgtagctgccggtctacgccacagccacagcaactagagatctgagccacatctgagacctacaccatggctcacagcaatgccggatccttaaccctctgagtgaggccatggatcgaacctgcaacctcatggttcctagtcggattcattaaccactgagccatgatgcaaactctggttattaattctctattgcagctatatattacgaagttttttgtcaatgtcacatttttttantccagc

SEQ ID NO: 481865 - DNA, 115 bp, Homo sapiens
gcattcgaccgacttcaaggggaaccttgcactgatgctcacgcacctgaagctggagaacttcaagatctggcgcagcaccggtcccacgcccctggcgcccatcacgctgatc

SEQ ID NO: 481866 - DNA, 280 bp, Homo sapiens
gccaaaaaacttaacagcctttgcataggccaatgggcaagttttgttaagcttttaaaatattaaaaagcagctcccaagcaaacgggtatactcccttccaaagtcctagggaggccggaggccaaagtccaagctggaaactttggaatggagggtttgcttttctctccccattatgtcaaaattcaggttttcctaactgcatggaccccttttaccttttgggatgtccccccctcctcaggaccttcagcctccccctgcccggcaacccata

SEQ ID NO: 481867 - DNA, 587 bp, Homo sapiens
cgaccaggtaccaggacccttgctagcccgcagagatagttgaatgccatgaaggaaggaaccggacttagccacttgtatggaactccgttattctaaggagaggagtctagtaggctaggcacaagaaggatggtccagcatgccttaaggcacccggatggctggcagaagcaagcaattgtgcccaaccatgtgcatgtccactgacacgcgccactgcagtgctctcaaggtcccgacgagctagcgctgaaggacacagctattgcctggagacatttctactggtaccttaccaatgagggtatccagtatctgccgtgattaccgttcgatcttgcccacgcggagattgtgcctgccacccgtacgccgtagccgtccagagacttggcgaggccatcggcctagaaggtctggagggtgagcgacctgcgagactcacaagaggggaagctgacagagatacctacagacggagtgctgtgccacctggcgccgacaagaaagccgaggctggggctgggtcagcaaccgattccagttagaggcgattggtggaaagccgtcagccacctcagtga

SEQ ID NO: 481868 - DNA, 163 bp, Homo sapiens
aagggaccccgagacgcgggacgtatgagtggggcgtgcgctccacgcggaagtcggagcctcctccccatggatagggtgtacagagatccctggactggagcccatcacctttgcggggaagatgcactacgtgacctggagttcgcgaccgatctttccg

SEQ ID NO: 481869 - DNA, 392 bp, Homo sapiens
accaaccattgcagatctcatagagcacgaaaccgaggatccaggccagttacacagacccagcaagagccaccagggagctcaccagcatcagcacagaggcccagtgtgtccgcaggcaccctaccaatatctgtagtgtgtagaagatgcacccgaatacgctgttggattgattgagaattctgtcctgtcccagcacatgctccaccagcccgaaacccctgccccactgtgaaggagaagacgcgcgaacacctgatgccggtgcccatgtcgcagagcgcgcggtaatcgcggtcccgggcgcgcgccgccttcacgtacagcgcgtagagcgagagcactaagcccgtcacgcagagagcgagccgcacacagacaggtctccc

SEQ ID NO: 481870 - DNA, 450 bp, Homo sapiens
ctcgttctgtcacccaggctggagtgcagtggcatgatctcagctcactgcaacctctgcctcccgggctcaagcaatcctcccaccttagcttcctgagtagctgggaccacacgtgcacaccaccatgcccagcctgggcgacagagcaagaccctgtccctttaaaaagaaaaaggagagagatgtgcttatatgaagagaaaggtcatctcccacaagagtacacagagcaaagagaaaagctgaagatggaaatgaccggcacattttaggactctcctaaacttcgtcagtgaagaaactgctatactatttcgaatggaacacctggagaaagatcaccagctgcttccccaccaccagctcctcaggactccaggagacagaaacctaatagcaagagatcaagtaataaacattggtgcaattaaaatattttctttcaaa

SEQ ID NO: 481871 - DNA, 191 bp, Homo sapiens
tgctgggattacaggcattgagcctaacggtccataactattcctttcaaactgatagtttcccaacttgcataccacagtttatgagattgtgttagatgtctttaaaacgattgaatctgtgtaaaacctgagtggcatacttctattatttcattctttctatctaccttccaccctactggggtctt

SEQ ID NO: 481872 - DNA, 648 bp, Homo sapiens
catggtgtcttttcaaagatataatatttgaagacatgttttctagcgatttgtgtggatgatgaggtgagctggactgaggcaaatcggaatcaagctggggggtggtgtgtaagaagacacgtggagtcgcacaataggcaactcctatatgtctagctatacgtggctgtacatttgctgcagcctcatgcttctgaggttgaaggggtgatcttcatattagacacatcgtgtgcttcagtcatagatgttaatagatggaagcgagttttacctgactgcaggattccgtgaataggagttgctgaaagagtctacttctgtgactacaggggaagtattgactgccagatctgtgtataaaggctgatggctatggggatgggacctgatcagctatgttagataggctacctgacagttagtactcccatgatggcttccagtgacacatgtgtctgagtagtaattctaaacactgtggaattgtcccctgtctggggacttctatggtcgtggactgtactgggtaacctgatggcagatgcttttgggcggtgatgagaagtatagtcgttgctggatggaggaagactgtgaggcaccagatcctgtgcttctgagggccattttcttgaagaccat

SEQ ID NO: 481873 - DNA, 451 bp, Homo sapiens
ttgagcatacacaaaaggagaggctggacacagcggctcacgcctataatcccggcactttgggaggctgaggcaggtggatgcccgagcccaggagttagaggctgctgtgatcatgccactgcattctatctagcctgggcgacagagcaagaccctgtccctttaaaaagaaaaaggagagagatgtgcttatatgaagagaaaggtcatctcccacaagagtacacagagcaaagagaaaagctgaagatggaaatgaccggcacattttaggactctcctaaacttcgtcagtgaagaaactgctatactatttcgaatggaacacctggagaaagatcaccagctgcttccccaccaccagctcctcaggactccaggagacagaaacctaatagcaagagatcaagtaataaacattggtgcaattaaaatattttctttcaaa

SEQ ID NO: 481874 - DNA, 162 bp, Homo sapiens
cccccccccccccaaaagggggggggtttttttaaaaaaaactggcctttttaaattttttgtttttaaaattaataattttcccgtttttgttctttttcccccctttttttcccccaatccctttttttttttttgtttttaaaggggccccccccccca

SEQ ID NO: 481875 - DNA, 163 bp, Homo sapiens
cagctctcaggttatctgatatttaactttgctttctctgcttgtcatatgagagttagatcttatttttacatttgctaagtgtcctgatctgctcatgaaatccttctatggcgtcaagctgtggatgcagattcctataagcgaccctttggtgacaact

SEQ ID NO: 481876 - DNA, 102 bp, Homo sapiens
atcaatcaattcgagtttaagggtctgcttaaggatttctctcccttttgccttttcttgtcttttcttttcaacatatggggtctcatgtattacccacgc

SEQ ID NO: 481877 - DNA, 434 bp, Homo sapiens
  misc_feature (27)..(28): n is a, c, g, or t
  misc_feature (52)..(52): n is a, c, g, or t
  misc_feature (159)..(159): n is a, c, g, or t
  misc_feature (164)..(164): n is a, c, g, or t
  misc_feature (174)..(174): n is a, c, g, or t
  misc_feature (310)..(310): n is a, c, g, or t
  misc_feature (325)..(325): n is a, c, g, or t
  misc_feature (329)..(329): n is a, c, g, or t
ctgcaaacagtttgatgactacgaggnnttcgatcagatcgaagcgaaacanaaagatgctcgggctatcatgaaaaggccgtatctggtgaaagcgaagacccgctcggcatgctgaaagccgggcttgatgaaatgaaaaatcaatcagtgtaaatngcatngacaatcatngatggctgagtacaatagaccacaagaaagatcgcttttcagctcggcatggatgaatagatgaaaatcaaaagcccgaaggcaaaagcaacagtccgctacaaaagttcacgatgaacaaactgcttgaagtatngatcagcaacgcgtngctngcctggggcgaaatccatcagctcttttggatggctggctaggtgtgcatcaccatcggttacgcagtagttcaactgcctgccgtagccggtaatcacccgctg

SEQ ID NO: 481878 - DNA, 113 bp, Homo sapiens
tcatgccacttccaacatctcatggccaaggtcatgatggcaggagtaatcagaggtgttcttgtgttgtgataagggatgagatgttggaaggtggcatgagatgttggaag

SEQ ID NO: 481879 - DNA, 1186 bp, Homo sapiens
gcacacacagcaggagtacagtggggatgagaaacccgtggatgtggtggctccaaccttccggacttcgtgtgactatagtaagacgattgcgagtggctacttgaaagatcgcggagtgctgacctcccatctaatcagtgtcattgatcggctggccttggcgtgagctcgtatctagaaaagcgagccctagttactcctcctacatagtcattgtatcgctgacgcctagatagagaacgggattgtccttgttccttttctaatgaactgcatccacgtatgagcctcattcattgcgctggtcctcctcatacgttcgggagagttggcacgtttcattctagtcaccacgggcagcactaagctcgacctagctcagcacgtaacggcacgttactgcgtccctaaccgtaccagagtaaccgtgcgacagtacctttaaaaggcgcaacgtagagcacggtctccgacgcagccctcaaaggtggcactattgcaaacatacgtattgtgcgcaaagcgtggctcacttgaaaaagtaactcattacctgccaacggtgcaccctctggccttttcgaggcccccacctgtgattgcgcagcacaataccgtaggaaagactccgtaccaggaacggatagtcgaagagggtgttgtcgacacacaggggaatcccccaagtccaaaaggtagcgtccgtcaagtttagcgccaccggcaaggggccccattgcgtactagaacttgctccttcggctaaggagcctggaggtaagcccaggatagcaccggacgacagggaagtaacccaaatcgttccaagggtaccctggaactgggttgcctagcggaacggcacgagaaccgggggggaaaccccccatgggatgggaaaccgctttccccctagccgggggccacgccccaaaagccaagggccctgaccccgggcgggactaacacggccgtgggtaattagcttggtggcgcgaaccgaccaaaaaaccccaaaaattggcccgttgggttggaacgccctaggaagaaacctgggccaagtttcgggacaccgaactggcgggggcaaacggcccaaagcttgaacccgttaagttcctcccattcaggaaccattggacgcgggacactggggcgtggggttttcccgagaacgacc

SEQ ID NO: 481880 - DNA, 683 bp, Homo sapiens
aacctcctaatctaagaggatccagcctacctggaaagccaatcagtcctcataatggacaagatccaccagactcctcctgtggactaacttatgtgatatgggaagtgagaaatagttaacaggctgtgcacgatcaaacgaacgaagatgaccagagtactcttaaccccagttagaactgtttttccttttgtatctgcagagtatgggatggtagttgttttcatgagcttctagtaaatttcactgtgcaagttgattttcgggttcctgtgttactgccattcctatttacagtactattggagtgaatgattatattgttaacaaaagtgacatggggctatggggtggtcctaaacttgacaaacgattccactcattgctgtttgtaactgtgattataattttgtgataatttctggcctgattgaaggaagattgagaggtctgcagttgatagtattttaaatagatttgataggtgttccaaatggcgttgtttcagtaaggtatttgtaacagttattggggttgtctgggattgtgtgaagaaaattagaaccacgctgtattacatttacctgggagttatttgtggatggcagttctgtagttaggggacggggtagtctggattgttggaactaagtgagactggtcaggataaatggaagtgg

SEQ ID NO: 481881 - DNA, 147 bp, Homo sapiens
tcgctctaaggatcccgaacggggtgatgcgtggtggtgagagcttgtactggtgggctattctgtcacgaaccctggcgcccctgcatcagctggctacgactccaccttctccctggaccagcccggtggcaccctgtgatctga

SEQ ID NO: 481882 - DNA, 144 bp, Homo sapiens
aatcttatatgtaaccatcatgctgtaagtaattaaaattgctacaactattaaaagtcaaatagtacagctcagaaaaataattcatgtactctaatattgtataagtagagatggggtatcaccatgtaggtcagcgctggt

SEQ ID NO: 481883 - DNA, 124 bp, Homo sapiens
cacgagggctgccggcactcaggcatataggaccacatgagggaacattttcagtctatcttctgaattgccttgtcaggagagcctgtcagatggccatgcgtaatggaccgaattcacatcc

SEQ ID NO: 481884 - DNA, 100 bp, Homo sapiens
actgagccgtatgatttgtagtatttgggggatcattgtctgatagctgaaacttcccattaattgtccaagaatactctgccggtgggttatatgtccg

SEQ ID NO: 481885 - DNA, 574 bp, Homo sapiens
acctgtcttcaagaaagtatggtaaagagctattaaaaaagggtcatagacagttcaaaagcaactggtctgttttcccagcccccgctaattcatctgtcctgtgatttattatttttcctgttttaaatattgtccccttttcaaatccaagccagtatttctcttcatcaatgaagaattccttgacaaccctacctcaactcttcttctccatgtggatccacttgatgtctgcccatcaatgacctttatcacacgctatcttgcactaatagttatatttgaattccaggttttcccaaatgtgcttggagacatttaaggcaagtgctttcagtaaagtttataagacctttaggtagttaccatggagcaggcattgggctgaatgtattctgttgcacttgtactggctactatcctgtgagattaataccattattatctacagtttgtagaggaagaatcttgaggctcagaaacattattccagttcacctagcataatgcctattttagatataatccttctattggcatacagaagtgcttgagcgtggtttggagaaca

SEQ ID NO: 481886 - DNA, 173 bp, Homo sapiens
agtgttatcgttaaagaaagcgtctacaggttgagcatccctgatctgaaaatctgacaattttgcatgctccaaaatcgaaaactttctcagtgccgacatgatgcctcaatgaccaattccacatacagcagttcacacaaactgtttcatgcacgatatgatcaaaatcg

SEQ ID NO: 481887 - DNA, 183 bp, Homo sapiens
tcgtagggtaaatgtttaagaaaaaaaagtgtaattggctaaagaataattcatgatctgtttatgcgataactccttttggttacaatttttttaaaaaaagctattttggttaatgtaaagtaaatatttcagagcaatttttttaaacttatgcgcactaaatacaggctctgtcacaac

SEQ ID NO: 481888 - DNA, 359 bp, Homo sapiens
cagcggtcctggagctgtgaggagattcgagccgtcacgctgcctcccctgcgttccgccatcagccgcttctgtcctctgacccattccaacactctcgtcatggtggattactatgacgctctaggcgtgcagagacatgcctaacccgaggatattagaaaggcctatactaaactggcactgaagtggcatccagatagtcctgagaatcaagactaagcacagagggacatttatgaccaatatggccatgaatgattcaatggtggaggagcatgctgaagtcattctgacagatcatttgaatagggctgcacattccgtgaccaacatgatgtcttcgggttgtctggtgg

SEQ ID NO: 481889 - DNA, 156 bp, Homo sapiens
agtggcttcactctcaacttcactcctataattctagtcccggctttgagtggtattcaacctttccaaggttctcaacccttttcacacgagtacggttacggatttgggaggatctagcccttaagactcctatggacctactagagcttgact

SEQ ID NO: 481890 - DNA, 200 bp, Homo sapiens
tgatcgcggatagcgatgtggagcctgaagtttcccgcaaactataatgattgtcccaggtcagcaaatgcctgagacctttattaaaaaaaagtttagggagtttccagcgtggctcagtggaaacgaatctgactagcatccatgaggacacaggttccgtccctgacctcagtcagtgggttgaggatctggtgttg

SEQ ID NO: 481891 - DNA, 184 bp, Homo sapiens
gaggatcccccggagagtacaagagacagctgtaaatacatagaagctatcatggtgtgtctcaggttattaaggataaacgtttaatcaattaacatctcttaacagctctgagaagtctttactgaaacgtatgagaaaaatattcaagtaaccacgtttaaaaccagttaccccaaaatct

SEQ ID NO: 481892 - DNA, 956 bp, Homo sapiens
attctagaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggagggcggagggttgcaggtgagccaggatgtgtgcgactgcacctccagccctggggtgacaggggttgaaacgccattctcaaaaaactaaaaaaatttacaaacaatcaatacacaaaacaaccacacacacatcaaacacaacaaacaaccacacacaaaacacaacaaataaaatatataaacacacaatcattctgtgtggggcgcaatccactccccctagagaaagaagtgttctaaacacaaacccgcattggacgtgcagcggcgcccaaacattggtcatcacgacgcaacgtcgcgacacatacctagtctaaccagacagaggtaaacctctggccccaactcatgatcgggttatgggttcctccgccacagataaaaaccgaccgtcggaacacaaccagctgctgtttgcaaaacaacacaggtgagcgatacgcggagcgcgcacaacagaggcggcaccacaaacaagcgggagctcacccatgcagagcacgaaacaaaaataaacgcccgccgggggggagccacaaaacgagcaaaacaaagtgaaaacagaaagcaagaagacaagaacgagaggaacgcgatccagacaacatacagacgacagcgacagcgaagaaggagatatcacaacacgacgagcgaccgaacaaacaggcaagacaaaacacggagactgaaaaacaagaagacaagacaaaaagaaaagcatacatacatctaaacaaatcagcaacatacacaaataacgacaacgaaacca

SEQ ID NO: 481893 - DNA, 113 bp, Homo sapiens
attaataagaccggatgattccaaatgcgaggagtcctcagagcggtgctgtggacgtgtttatccgggagtcctgtatgtctgcatctggcgccttgagaccttatggaggt

SEQ ID NO: 481894 - DNA, 273 bp, Homo sapiens
ccctagcatcttcctgtactttaattcatctctggattattataatacctaatacaatgcaaatgctatgtaaatagtttttatactatattcttcagggaaaaatgacaaaaaaagtctgtacatgtttactccaattgcagtttttttttttttctgaatattttcgattctgggttggttgaatccacagatgtggaacccagtgaatatggagggctgactgtattaccaatccaggcatttctagagaggtcaggattctggtatgta

SEQ ID NO: 481895 - DNA, 365 bp, Homo sapiens
cggcgctatactactaattgcggcgtcgacagcatgcagaatcaaggaagacgttcgcatagcattgttttaaaagataaaaataaggataagtgtggtggctcacacctctaatcccagcattttgggaggctggagcaggcagatcacaaggtcaaaagatcaggaccatcatggccaatggtgaaacccatctctactaaaaacacgaaaattagcagggcatgatggtgcatgcctgtaatcccagcttctccggagactgagacaggagaatcgcttgaaccagggagtgtcagaggttgcagtgagctgagattgcgccactgcacttccagcctggtgacagagcaagaccctggctc

SEQ ID NO: 481896 - DNA, 379 bp, Homo sapiens
ccaatatattatccaataatatagagaagtgaatggactcattattatcacgtagtttccaacgattgagttcgtcattgttatatagagccagaagcctgaaaacctaagatactatttcagactatactactatattgtggcatagttcttagtgggaattattttactttgcctctctgtgcttttcctttctaagaaattgagtaataatacttaactagtaaatgtttaatattatggtaaaataatagttgtcaagtactttgaagacttaaatgatatgtatattaacttttttactctcattcattttgaaaagtatcagagcctcagattaagagtgattggatagttttcactttgttgcattttctgt

SEQ ID NO: 481897 - DNA, 650 bp, Homo sapiens
tttttttttttgaatttaaatttaaatttattttcattatgttggagaggtttttcggtttggtttggttgtgtagtgtagtggttttggagacagtctgtgctctgtcacccaggctgggacgtgcaggggcatgatctctgcaacctctacctcccaggttcaagcaattctggtgcctcagcctcccaagtaactgggactacaggtgcacgctaccacaccgtggctgatttttttggttttagtagagacagggtttcaaccatgttgcccaggtgggtctcaaactcctgagctcaggcaatccacccgcctgtggctcccaaagtgctaggattacaggtgtgagccaccacacccagctattttttactttgcgtttttataattttaaagttggggggggtctcaattggttacccgtggctggtctcgaactcccggacttaagcgatcctctggctccaagcccagtaccagtctcaggtttctttactaaaaggatcactaccgtttttttctcctaatctggcgtgcgcatgttgacgcatgtgtgcgcttgtcaagcctttccgggccatgtgagtgtgtggcaggcgcttgcccaggcccagcgttagaacgtgtgaacgtccagataaaccttc

SEQ ID NO: 481898 - DNA, 251 bp, Homo sapiens
accacacacactcatacacagacatacagacacacacactgatatatgcagcacgtacacacgatacactcagacacactgacagacaatctactcacacacatactcctaggagagcgatcctgacattcaccatagggaagtcacggggctacagtgcctatgaataagcatgctaaacaaatttccagctgtgaggtaacaaaaccatgggtcctgggtctcccatccttttaaatcctcagtatgct

SEQ ID NO: 481899 - DNA, 159 bp, Homo sapiens
gagttgctacgatggaagttaaagggaaaagcaattcacaggaaagggtacaagacagcacacgacaagacagtttctaaattagtgttctggttcttcatgctttcaccaggcagttgctatagaggtggcctcagtcacatctaggactctgagaag

SEQ ID NO: 481900 - DNA, 587 bp, Homo sapiens
cattggatgataaagcattgttaatggtgaaaagttcacagatcactaatgttctagaggttaacttcaagtgggcaagctggggtttaaggtagtcagcggcctagttcctaaagccacagtataggatctgttaaactgaatgtctgtggaaagttggttttagctgcttggaggcttccttttaagacaaagtgtatgtgatcaagtggttttgagggaactgaagaacctgatgtagcccctggccagataattgcctgatttctcagatattatttctctgggaaacattctacatagcacaggagcttaagcagtggcattatcttctcgcctaatttccagagattatttctggtactgagaatcctgggaactactattgctaggaacatttaaagctgcatggtctgtctgtgtgtccatttaacttatttgtgaataccttagaatcttcatgggtcctggatttctcctgtgcttaagtccagtctcttatctctaattgcccctttatttgatccaccatgtacctaagggaagctctgattagcaagttcagactcttaaatcctttggaggca

SEQ ID NO: 481901 - DNA, 267 bp, Homo sapiens
cccttctgtcgagacacggcattttagtagagacgagattcgctgtgttgcctgagctaggagtcgagaccagcctggacaacatgaagaaaccccgtctttattaaaatacaaaaaattagctgaatgtggtggtgcgtgcctataatcatagctacttggaaggctgaggcaggagaatcgcttgaatcccagaggcggaggttgcagtgagccaagatcgtgccactgtactccagcctgggcgacagagtgagacactgtctc

SEQ ID NO: 481902 - DNA, 116 bp, Homo sapiens
gccggtagccatttaattgattcttttgtggcaccaccagcccattgtatttcacagaagattggccacaggcaaaataaaataacccaccacaaatccccttctgtcgtcttctc

SEQ ID NO: 481903 - DNA, 1576 bp, Homo sapiens
gacagagtgaggctctgtctccaaaaaaaaaaaaaaaaaaaaaagattgtccaccccagttgcccccatccaaagggcctgctgcgtgttgaccccccatgcccttggttaacccactctcctgctcaggggccccagaaggaaatcgcgtctcttcttcttctctatctcctgtggtgcaactttccccctgtaagtttgtgaggctttaaagagaattagcaattctcccgattaaaccccagctttgtcgtgcaagcctccgtgatacgccccaacattcttccattattgcgaactcctttgtgaagcgcgaaggcgtgcagcatctccccgtgccattctcttgaatctgggcagaacccattgtttctccaccctttggccctccgttgggggccccgtgggggcccatttctcccgtggcgtgttccttgcagccccttctttctcttgccaccacacgcacgcacccctcttcagacattggcctaccacttccgtcgcggcactttccagcttccacccgtagagaacgctccctctccaggcgagggctcctctatacgcgccaccagaaacgacacccctttggacgtttcagacccaccgccagaacgaccactctgacagacagctccctaggcggctcctcgcgccttctctagcgcatctcgcgccgtcgtctcgcgcccttatctctcccaacgcacctccaacttggtccgcccaatatatctccccaagattctcgcgaactgtgcgcccccgttgcgcggcccctttctctctggcggtggccacgcgcaaccacgacggtcccaaccccttttgtgcttcccccaatattacaggcgcacgcgcggcatccccactttgcccccacccccacgaggaacccttatcacgaacctgtgcaacgccccttatggggccacagacactctctagggcagccatcactctcggcggcgcctctttcccgcgaccgcaaccactctttccaaccaccgcgcaccccgccccaccacactccccccctctcacctccgcgacacaccactcgttaaacccccccaatcaacaaacccctccccgcctacctcccccgccacctcccacacgcgccattacccaccaccttctccccccctacctccaactcccacctgcccctcactcaccaaccccacccaccgcaacacaccctctcccccccttcccctttactactaccaaaacccccaccccctcaccacccagcttcatttgactccctggcccgcaaactatggcgaacataccacaacaactctttccaccaccaatcccacaagcaaaacaccgctggcacacgaaccatctacacatccactgacgcctcagtggccaacccccctctttcaacacgaacagcccaaccacccttatccccccagactcttaccccccaagcttctaccagccacactgtggacacacccccctcgtcaacatagtctccaacaacagcgtcccctcgccccagtgatacccctcccacacaatgccaacagttatactcccaccacgctgc

SEQ ID NO: 481904 - DNA, 295 bp, Homo sapiens
gtctgacaaccaacagataataaacagggggattatagactgtgataactgctatggagaaaacagatgcagaggagtgggaggcggcctttccttcacagaagagtcagaggtggcctctctgagtaggtgaaattgagctgagccctgtagatgggaaggaagacgatgccctgggaagagcccgtggggaagaaacaggggaatgccaagtgcagaggactcagtcctgaaacaagtctgtgccttcaagtgggtatttaaggacttgtgctttcagagcagaaggtcgacg

SEQ ID NO: 481905 - DNA, 635 bp, Homo sapiens
  misc_feature (525)..(525): n is a, c, g, or t
agctggtacggtcggagtctaaggatgggagggctccgggacagcccgtcggagaaacctgcatcatcctcactaagtggatccacttgctcctcaggaataaaggctcagggaccgggagttctactctagagcccagcagcctctcagagcctccggtgactggcctgtgtcgtccgcgcctggatggacagtgtggacggcgctggtcatcctgcaagccttgttgctacccttccgtgggctgatgagtgaccaacccatgccgcctgcagcgtttgtagtcctgtggtgtgactggggtaggggtgcctccaatggccacattccatcacggactcgggatattggcacaattgcgcataggatgatcgactcaggactgtgcagcatcctggtgtgcagagcttgcatgccatgtctctaggcggacaactttctgtacgttcacgtggtgatgcccagacaatcaaatgacgacatcatggttcacaggagaccgtattagacggatctgtacttctnctgtacacgcgtcccttcgggaacatgttgcgccctggtaacgtgctagccggggaatagcgcgatgacggcagcgttggcagaatgtcatctgacccaagaattgcata

SEQ ID NO: 481906 - DNA, 941 bp, Homo sapiens
tcacagaacagaaagcagagcctcaggatgatgggaaaagtactgagtcagatgtaaaggccgatggagacagcaaaggcagcggaataggtggattctcattgcaaaaaggccctgagtcataaagagctatatgaaagagcccgagaaactgctggtatcatacgaagaggagcagtttagcgtgtgctggagaaatttacggtatttacctaaagggccattagaggccgtggtaataagcccgtcgcccacgtgtatgaatgtgtcctgcgcaagtagctcatcggcgcgttacatgcgagtaacagggaggctgtgctggatgcttttctggatgatggcttccttgtccccacatttgaacagttggcatgctttgcagatagaatatgaacgaaaaaatgtggacttgcaactgaccgtcctgagtgccaaagccgtactctcaggttctggcaggtccctgctcaggggcctgctactcccagaacttcacgcagtgccctataggagaggatgctctctgatctgccagccttggggatcagcgggatccggctacctacatcctcagagtggaccgtggaactgatcgtggcaactaccaagactggacggaatggtcgcgatttctgcaggccagtggaagcagaagggctggaggctgtgcaatgtccgctcccttgaatggccgatggctgatcttgtttggagtcaccttgctgggcaaggcccaatccttccgaatacctgcaagcatggggcagggctgccaaaaagaccaaaggtgtgcaatgtccatttcccaagtaggaaaagccggggcaagggatgagccccaaggaatcctaccaaactgttgggggacaccccacttgtgtaaacacaaaaaggttttataggaaagctccccagaatacagagaatcaaggtgcccc

SEQ ID NO: 481907 - DNA, 164 bp, Homo sapiens
ttagaggatccccaccagacaaatcgctccaccaactaagaacggccatgctaactagttactcgacccccaagcgccacaccatgagccccagcaactaataacggccatgcaccacgcgccacgtgcctcccgatgagccaccctaagtgccacccgaagcg

SEQ ID NO: 481908 - DNA, 3231 bp, Homo sapiens
  misc_feature (67)..(67): n is a, c, g, or t
gtacagcatgttactgtacggaatactgtaggcagttgtaacacaatggtaagtatttctgtatccnaacattttagacatagaaaaggtacagtaaaaatatggtataatcttatgggaccatcatggtatatgtggtccatcattgatggaatcgtttttatgcagcacatgactgtatataatcaacaaacaactctactttcttgttttcgtttgttgtgtttttgctttacacatttgatagggaacatagaagttgtgacctttcatttcagtggaaagcattgagccagaatatatttattcctaaaccatcgagccacacatgcattgatgaaccctgaaagaatccacagtaattgactaacaggcagtactgaatgaaagatgtcatatgtggtgaaaaatatttaatatatcagtttcttgggctcacatacagccctttagttccaagtgcttggttagattagaaaatgggatgaacacaatttgatgctgaagcagctgctgagcagcacccagggagtctaggtcatacgccctatattgttttcggcccacttattgttgagttgaaaagtctcatatttgtagactagagtgtatgtgtttacaggcccatgttgtatctgagttttctctggcaactaagatctctttctaaacgttctagaaagatactggtatcttactggcccattatttagtaagttttagaatacatgtacatcagtgttttcaactgcttggtggacatttcactgatgcataatcaaagtagcagattataatcatcagagtgatctgacaaggaaattctgtatttgcttccataaagaaaaataatcaaaacatatatcagatataatatatatgcagtatatcacataggaaattttattgtaggaaattagagaaggatgctactcaattcattctctagcaggaagaatacagcttaaaaatcacttgggtccctttaataaagaaaagtgtgattctgtgtgtgtgttggaactgaaacttggagaacacgtgccagtcgactgtgaaatggttgctggataaaaccacagatgtggttttatccgagaaatgtgggactgaaattattttgataagaggtacataagagagctgcagaaaagactgtagcttctgaggaggcaggagtaccttgttaatatccaaaccacccctgagttctaatgttccaactccacctaaacgaggaattggaaactttaaatggaattatctaatttaaattcttagttttttctttgtctttctcagctgatacttgtagttttgttttgttttttaaccaccaagaacacttgcaagtttgttactgaaaacatcactaaaggaaaagaagagtttcaaaatgcttgaaaagtagtatgtggttgggaattgtttttgttcaagtccctggaagtcctcttggcttagctcccttgttcctgttcccacttcatttccttacttaacattcccctattttgagcatgtcaataagtgcatgatgaatggcacagttgaatgatcatgttaactttaattgcttcctttgttgctgtaaacagtttcttgttaagtttcagccaagtctgtgacaatctcaccaaataagaatgaaatgggcggggtgtggtggctcacacttggaatcccagcactctgggaggctgtgtgggccgatcgcttgagctcatgagttcaagaccaacctgggcaacatggcaaaaccttgtctctacaaaaaatacaaaaattagccaggcatggtggtgcacacctgtagtcccagctacttgggaggcttaggtgggaggatggcttgagcacgggaggcagaggttgcactaagccaagatcgtgtcactgcactccagcccaggcaatagagccagaccctgtctcaaaaaaacaaaacaaacaaaacatgaatgaatgaaatggctcaccttccctattatgaactagaagaaaggatgaaggaaggttggcaggaccccagccttactctgtagtgacaacccagaggtacttttcccggaatgcagggtcaagtttatgtgtgaagggactctagaatagctggtaaaaatggctacatggtaaccattcttgacttagtccagtattcccataatttgtaattccataaatttattctcagctgtcccccagccatttctaatagaaggatgtgtaccccagttttgacaatgttcttgaaatcaagttagtgttacctgcattgcattataatggaactatatgtacatgttaaagggatccgtttgattcctttcggcaaggaattgcaaaaatagtttttaccaataccagttaaaataggataggttagactttgggggcagggtgagacagtgcagccttttcactctgaaatggcaaatcagctgtactctttgagtctaccagagattcctatttgagtgtgaatggggtgtgtgtgtgtgtgtgtgtgctcattcatcttcatgctttcttccatggtgttaattcaagctctcctaataaaggtatccaaagagtactgagaagtgaccataggtatttggcatgagtaaatgtagttccttttgccaaaaaaactctcaaaagttacaactggagttcttcgcgataaaaggttggggaaatcagccatggctttagccttgttcccaagtacacatcttcttatccacaaggatgaaactctgtagggctcaccctgagggctcatgtgtggcattgagagggtagcagtgaccagaacaccacaaggcccacaagatgttttgaatgagggaacatttaatgtcatttgttaggagatagaaaccaaataataaaggacaaggaccacgctcattccgtggagaagaggtgaactccctctgctgactatttggaatggactgaatgaggaggtctctccagccagaaggagtattgaggtcatcaggcctcagaaaacaatgtacacataatctcgggctgtgaacaagagaaaggagggggggaaacatgaaagtcaatcttaacaatttttgcaatacctcttatttgcagaccattggatttatgttattgcactctcggtgtgatttatcgtatgtatctgataggttttatgaattgttttgagttgtaaactcctataccctttattaaaatggacctaattaagtgaaaaaaaaaaaa

SEQ ID NO: 481909 - DNA, 257 bp, Homo sapiens
atatcgtggatcattcacttgcttatgacgctgatacaacgatatgcgctaccacggtatgatcattttaagttgccacgtgagaacatcaactacgatgactagaacaatggccatggtgtgtgcacaatgggcatgtggacataatagactcccagtctgttagctgcctggtcgccatttaacgtatctgcttttggaacaagtgcagccttgcctgtttcttatttacttacacctttggttggccttggtgc

SEQ ID NO: 481910 - DNA, 2911 bp, Homo sapiens
  misc_feature (67)..(67): n is a, c, g, or t
gtacagcatgttactgtacggaatactgtaggcagttgtaacacaatggtaagtatttctgtatccnaacattttagacatagaaaaggtacagtaaaaatatggtataatcttatgggaccatcatggtatatgtggtccatcattgatggaatcgtttttatgcagcacatgactgtatataatcaacaaacaactctactttcttgttttcgtttgttgtgtttttgctttacacatttgatagggaacatagaagttgtgacctttcattttgtagactagagtgtatgtgtttacaggcccatgttgtatctgagttttctctggcaactaagatctctttctaaacgttctagaaagatactggtatcttactggcccattatttagtaagttttagaatacatgtacatcagtgttttcaactgcttggtggacatttcactgatgcataatcaaagtagcagattataatcatcagagtgatctgacaaggaaattctgtatttgcttccataaagaaaaataatcaaaacatatatcagatataatatatatgcagtatatcacataggaaattttattgtaggaaattagagaaggatgctactcaattcattctctagcaggaagaatacagcttaaaaatcacttgggtccctttaataaagaaaagtgtgattctgtgtgtgtgttggaactgaaacttggagaacacgtgccagtcgactgtgaaatggttgctggataaaaccacagatgtggttttatccgagaaatgtgggactgaaattattttgataagaggtacataagagagctgcagaaaagactgtagcttctgaggaggcaggagtaccttgttaatatccaaaccacccctgagttctaatgttccaactccacctaaacgaggaattggaaactttaaatggaattatctaatttaaattcttagttttttctttgtctttctcagctgatacttgtagttttgttttgttttttaaccaccaagaacacttgcaagtttgttactgaaaacatcactaaaggaaaagaagagtttcaaaatgcttgaaaagtagtatgtggttgggaattgtttttgttcaagtccctggaagtcctcttggcttagctcccttgttcctgttcccacttcatttccttacttaacattcccctattttgagcatgtcaataagtgcatgatgaatggcacagttgaatgatcatgttaactttaattgcttcctttgttgctgtaaacagtttcttgttaagtttcagccaagtctgtgacaatctcaccaaataagaatgaaatgggcggggtgtggtggctcacacttggaatcccagcactctgggaggctgtgtgggccgatcgcttgagctcatgagttcaagaccaacctgggcaacatggcaaaaccttgtctctacaaaaaatacaaaaattagccaggcatggtggtgcacacctgtagtcccagctacttgggaggcttaggtgggaggatggcttgagcacgggaggcagaggttgcactaagccaagatcgtgtcactgcactccagcccaggcaatagagccagaccctgtctcaaaaaaacaaaacaaacaaaacatgaatgaatgaaatggctcaccttccctattatgaactagaagaaaggatgaaggaaggttggcaggaccccagccttactctgtagtgacaacccagaggtacttttcccggaatgcagggtcaagtttatgtgtgaagggactctagaatagctggtaaaaatggctacatggtaaccattcttgacttagtccagtattcccataatttgtaattccataaatttattctcagctgtcccccagccatttctaatagaaggatgtgtaccccagttttgacaatgttcttgaaatcaagttagtgttacctgcattgcattataatggaactatatgtacatgttaaagggatccgtttgattcctttcggcaaggaattgcaaaaatagtttttaccaataccagttaaaataggataggttagactttgggggcagggtgagacagtgcagccttttcactctgaaatggcaaatcagctgtactctttgagtctaccagagattcctatttgagtgtgaatggggtgtgtgtgtgtgtgtgtgtgctcattcatcttcatgctttcttccatggtgttaattcaagctctcctaataaaggtatccaaagagtactgagaagtgaccataggtatttggcatgagtaaatgtagttccttttgccaaaaaaactctcaaaagttacaactggagttcttcgcgataaaaggttggggaaatcagccatggctttagccttgttcccaagtacacatcttcttatccacaaggatgaaactctgtagggctcaccctgagggctcatgtgtggcattgagagggtagcagtgaccagaacaccacaaggcccacaagatgttttgaatgagggaacatttaatgtcatttgttaggagatagaaaccaaataataaaggacaaggaccacgctcattccgtggagaagaggtgaactccctctgctgactatttggaatggactgaatgaggaggtctctccagccagaaggagtattgaggtcatcaggcctcagaaaacaatgtacacataatctcgggctgtgaacaagagaaaggagggggggaaacatgaaagtcaatcttaacaatttttgcaatacctcttatttgcagaccattggatttatgttattgcactctcggtgtgatttatcgtatgtatctgataggttttatgaattgttttgagttgtaaactcctataccctttattaaaatggacctaattaagtgaaaaaaaaaaaa

SEQ ID NO: 481911 - DNA, 213 bp, Homo sapiens
acaaccatagaatggatttggagttggtagtaggtatggttctcataccagagttctcttaaaaaaaaaaaaagggccattgggaattgccttatttattttaaaaaccatggctacctagtgggtaggatccccaggccagcggcggggttgattaaataatcttgacaatgagcagcggccatctgggggaatttcattctatggggggcc

SEQ ID NO: 481912 - DNA, 365 bp, Homo sapiens
  misc_feature (360)..(360): n is a, c, g, or t
catgaggcaacaaagggaccaggaacacaaactatctactaagaggtatatgccccactacaatatataagactatcttagtgtgaggccaccggttcttactttacaatagcagacgccataattaagaccacatagcaataacagtatcaatattctcactgaaaacacgaattcactacatatataacctaacaacattctcctcagaaataatttgccacatatcccgctagccccccgagaccacatatgtattaggatacaccgcctatctataagtatcccacggcggttcattttatagtaaaaaaacatgagaaagacaaaaacaagaaacacaataaaaaggctgggtgngcggg

SEQ ID NO: 481913 - DNA, 1573 bp, Homo sapiens
gatacgaagtcgagccggtacccaacacagacactctggcaggctgaggcgggcggatcacaaggtcatgagttcaagaccaacctgggcaacatggcaaaaccttgtctctacaaaaaatacaaaaattagccaggcatggtggtgcacacctgtagtcccagctacttgggaggcttaggtgggaggatggcttgagcacgggaggcagaggttgcactaagccaagatcgtgtcactgcactccagcccaggcaatagagccagaccctgtctcaaaaaaacaaaacaaacaaaacatgaatgaatgaaatggctcaccttccctattatgaactagaagaaaggatgaaggaaggttggcaggaccccagccttactctgtagtgacaacccagaggtacttttcccggaatgcagggtcaagtttatgtgtgaagggactctagaatagctggtaaaaatggctacatggtaaccattcttgacttagtccagtattcccataatttgtaattccataaatttattctcagctgtcccccagccatttctaatagaaggatgtgtaccccagttttgacaatgttcttgaaatcaagttagtgttacctgcattgcattataatggaactatatgtacatgttaaagggatccgtttgattcctttcggcaaggaattgcaaaaatagtttttaccaataccagttaaaataggataggttagactttgggggcagggtgagacagtgcagccttttcactctgaaatggcaaatcagctgtactctttgagtctaccagagattcctatttgagtgtgaatggggtgtgtgtgtgtgtgtgtgtgctcattcatcttcatgctttcttccatggtgttaattcaagctctcctaataaaggtatccaaagagtactgagaagtgaccataggtatttggcatgagtaaatgtagttccttttgccaaaaaaactctcaaaagttacaactggagttcttcgcgataaaaggttggggaaatcagccatggctttagccttgttcccaagtacacatcttcttatccacaaggatgaaactctgtagggctcaccctgagggctcatgtgtggcattgagagggtagcagtgaccagaacaccacaaggcccacaagatgttttgaatgagggaacatttaatgtcatttgttaggagatagaaaccaaataataaaggacaaggaccacgctcattccgtggagaagaggtgaactccctctgctgactatttggaatggactgaatgaggaggtctctccagccagaaggagtattgaggtcatcaggcctcagaaaacaatgtacacataatctcgggctgtgaacaagagaaaggagggggggaaacatgaaagtcaatcttaacaatttttgcaatacctcttatttgcagaccattggatttatgttattgcactctcggtgtgatttatcgtatgtatctgataggttttatgaattgttttgagttgtaaactcctataccctttattaaaatggacctaattaagtgaaaaaaaaaaaa

SEQ ID NO: 481914 - DNA, 937 bp, Homo sapiens
  misc_feature (34)..(34): n is a, c, g, or t
atactttaatcaagctaatttaatatataaaaancttacctgaaacgatctcttattttcaccgctacagtgcatagtatgggactgggactccagtggcaagcttgacttcattggacaattcacctcgacattcaaggatatgagaggagcattgcaaggtaaacaggtgcagcgggagtgcctaattccaaaacaatgtcaagaaaaagaattacaagaccttaggcactgtgattgtagatttgtgcttgaattccattatgcttatttatttagaactacttatttgataggttctcaaatccaatgttcttaatttgttaaattctccttatctggagcgttgtcttcaattatcagatagatattttatctactttaaatctatacttttttattttattaatattatttttacagtatattatacgtaatatatattacaatctaaataagtattaattataattttatattgtttttttctacatctctatctatctcaaatttgttccttctgtaacgtagtttttattagatattattcttattcgtgttctgatctagatatcttcttaacataatttatataatgtaatataaattatattaaatatataaaataaaagtcttactaacataatatcgctttcacctattagattaacataatttattaaatgctatacaaactcttcgtattacgattgtgtaccggctgttatgcagctgttaatatttcttcaccatgcgacctgacactagacaaatcaccgtattcgtatgtagattttgataatcttctatcaacctccttctaagttagtagtattttaagaatttctcactaggagccagttcaatactttctgtttttatttggtgtttagattttgtatactattatatcggttaccatcaaaaaactataaag

SEQ ID NO: 481915 - DNA, 100 bp, Homo sapiens
cgagaagatattcggatgccatcccgagctgaaggcctccatcaagatgggggaagatttcgtgaagaccctgaagtgagccgctgtgacgagtgcccag

SEQ ID NO: 481916 - DNA, 1564 bp, Homo sapiens
ggcgactctaggatcccagaagacactctgggagctgtgttgggcgatcgctgagctcatgagttcaagaccaacctgggcaacatggcaaaaccttgtctctacaaaaaatacaaaaattagccaggcatggtggtgcacacctgtagtcccagctacttgggaggcttaggtgggaggatggcttgagcacgggaggcagaggttgcactaagccaagatcgtgtcactgcactccagcccaggcaatagagccagaccctgtctcaaaaaaacaaaacaaacaaaacatgaatgaatgaaatggctcaccttccctattatgaactagaagaaaggatgaaggaaggttggcaggaccccagccttactctgtagtgacaacccagaggtacttttcccggaatgcagggtcaagtttatgtgtgaagggactctagaatagctggtaaaaatggctacatggtaaccattcttgacttagtccagtattcccataatttgtaattccataaatttattctcagctgtcccccagccatttctaatagaaggatgtgtaccccagttttgacaatgttcttgaaatcaagttagtgttacctgcattgcattataatggaactatatgtacatgttaaagggatccgtttgattcctttcggcaaggaattgcaaaaatagtttttaccaataccagttaaaataggataggttagactttgggggcagggtgagacagtgcagccttttcactctgaaatggcaaatcagctgtactctttgagtctaccagagattcctatttgagtgtgaatggggtgtgtgtgtgtgtgtgtgtgctcattcatcttcatgctttcttccatggtgttaattcaagctctcctaataaaggtatccaaagagtactgagaagtgaccataggtatttggcatgagtaaatgtagttccttttgccaaaaaaactctcaaaagttacaactggagttcttcgcgataaaaggttggggaaatcagccatggctttagccttgttcccaagtacacatcttcttatccacaaggatgaaactctgtagggctcaccctgagggctcatgtgtggcattgagagggtagcagtgaccagaacaccacaaggcccacaagatgttttgaatgagggaacatttaatgtcatttgttaggagatagaaaccaaataataaaggacaaggaccacgctcattccgtggagaagaggtgaactccctctgctgactatttggaatggactgaatgaggaggtctctccagccagaaggagtattgaggtcatcaggcctcagaaaacaatgtacacataatctcgggctgtgaacaagagaaaggagggggggaaacatgaaagtcaatcttaacaatttttgcaatacctcttatttgcagaccattggatttatgttattgcactctcggtgtgatttatcgtatgtatctgataggttttatgaattgttttgagttgtaaactcctataccctttattaaaatggacctaattaagtgaaaaaaaaaaaa

SEQ ID NO: 481917 - DNA, 184 bp, Homo sapiens
  misc_feature (42)..(42): n is a, c, g, or t
ggaaaccgtattaattcctcattcatgtgtcggaaatacacntagccgtcagtgattgtcacttcccagagagccatgcgacgcagtatctgggtgccaaagctctccaggaactacctgaaggaaggctacatggagaagagggggcccaagacataacggaaggtgcttcccggacagcgct

SEQ ID NO: 481918 - DNA, 165 bp, Homo sapiens
ctcgtccccgtgtccaggctggtgttgaactcctgggctcaagagtgtgtgtgtgtgtgtgtgtgtgtgactgtggtggggttgtagcctagcagtgtgagtgtgggtggtgggtgccccgctctgtgtgtgttttaactatcgtggggtgtctcctcctttttc

SEQ ID NO: 481919 - DNA, 857 bp, Homo sapiens
  misc_feature (40)..(40): n is a, c, g, or t
  misc_feature (136)..(136): n is a, c, g, or t
  misc_feature (239)..(241): n is a, c, g, or t
  misc_feature (245)..(245): n is a, c, g, or t
  misc_feature (260)..(261): n is a, c, g, or t
  misc_feature (273)..(274): n is a, c, g, or t
  misc_feature (282)..(282): n is a, c, g, or t
  misc_feature (285)..(285): n is a, c, g, or t
  misc_feature (294)..(295): n is a, c, g, or t
  misc_feature (301)..(301): n is a, c, g, or t
  misc_feature (317)..(319): n is a, c, g, or t
  misc_feature (335)..(335): n is a, c, g, or t
  misc_feature (343)..(343): n is a, c, g, or t
  misc_feature (348)..(348): n is a, c, g, or t
  misc_feature (351)..(351): n is a, c, g, or t
  misc_feature (353)..(353): n is a, c, g, or t
  misc_feature (359)..(359): n is a, c, g, or t
  misc_feature (367)..(367): n is a, c, g, or t
  misc_feature (378)..(378): n is a, c, g, or t
  misc_feature (380)..(381): n is a, c, g, or t
  misc_feature (386)..(386): n is a, c, g, or t
  misc_feature (393)..(393): n is a, c, g, or t
  misc_feature (397)..(397): n is a, c, g, or t
  misc_feature (399)..(399): n is a, c, g, or t
  misc_feature (411)..(411): n is a, c, g, or t
  misc_feature (424)..(424): n is a, c, g, or t
  misc_feature (429)..(430): n is a, c, g, or t
  misc_feature (440)..(440): n is a, c, g, or t
  misc_feature (463)..(463): n is a, c, g, or t
  misc_feature (471)..(471): n is a, c, g, or t
  misc_feature (502)..(502): n is a, c, g, or t
  misc_feature (506)..(506): n is a, c, g, or t
  misc_feature (527)..(527): n is a, c, g, or t
  misc_feature (542)..(543): n is a, c, g, or t
  misc_feature (548)..(548): n is a, c, g, or t
  misc_feature (565)..(565): n is a, c, g, or t
  misc_feature (594)..(594): n is a, c, g, or t
  misc_feature (601)..(601): n is a, c, g, or t
  misc_feature (676)..(676): n is a, c, g, or t
  misc_feature (734)..(734): n is a, c, g, or t
  misc_feature (739)..(739): n is a, c, g, or t
  misc_feature (777)..(777): n is a, c, g, or t
  misc_feature (839)..(839): n is a, c, g, or t
gtgcacaaaggtcacaggtgcaggtacatgaattagaagngtgcatctaggattatggccaaactgttttaaaaatgcagaaatgtaaaattacatcttgaaaatatgaagagatggtctacacacttcaaaaatnaaatgttgcttataccagagatgtatgacaatcacgggattcaagtgacaagcagtaagatctcaaaaattaatactggtcaaagataacgggaatatttttnnntttnactgaaaatacattnnctactagaatannaaatctancangaactcatnnaaaaanattacaaaatctaaannnaattacttaatatttnttattacntaaanaanangattanattaacanaaaaatagacntnnatttnaatttcnaatntnacgttaattaanttctccaaaaatnaaatnnaaccaaaacnggttcaaactccaaatgaaagtntgcaaggntcagattaaaacatggaatgtttcagatganagtnataaaaacactattggttttnttctttattgaatgnnataanatgttgacatttctttnaaacttggaactactaaattttatttttncaaattnttctacattttttttttagtggtgcaagttgtcttaagtagcttaggaagtcaatctctacaaagtacttctgtntgttgccattctgataaaacaaaaactattcattaacttaaccatatgtgtatttttnttgcnataacacttaacacatgaacagacatctattatttctncactaaaacaaaagagtacaatagtgttggtctaactatcagtattgtatttaaaaaaggtnacattaaaaacaaaaaac

SEQ ID NO: 481920 - DNA, 183 bp, Homo sapiens
gcggccccgcattcaatatgatgaactaaatgtcgaagacaagaagagatctgtaaaatgtgatattttacttccactatataatacttgtgactgggagaggtaagtggaaattcaattatgatgaaaaacctatcttataaagtaatgtaggacaatacatggggacatatagatggcaaa

SEQ ID NO: 481921 - DNA, 1476 bp, Homo sapiens
tatttaaggtttgagggggaatgctggaaatggtaaggggtatggaaacttttcatataagtaatgctagggtgagtggtaggaagttttctactcattagagaggtgtatgagtgggctcgaataccggaatcgggggatatgctgtccagaatttccataagaaaccagggccaggttcaaactatagggtcctgtggtgccacaaccatactgtccgtgctaacagtccacggggacaaagctgcgctcatactgtagtacccctcagagcacaaacattggtcaccgctgctgtacgccacgatgtcgtactaatcaaccaaaaacaacattctgtctccgttcgtaactacccagtaactactacgaacacaaatacgaggccgatcaagaagccacacaacccgactagacaactcccaaacacgatcacacactaaaccactcgaaacaacaatctctcccacacacatctcccccattaccgaaccacaaggcgagatcacacaacaagtcgagaccatctccgacatctgtcacacacctagtgacataacatcagctatgcaacaaccacatacacatcaacaatatactcaacttgatccccatacgacgtatccctcatcacactgactccacctatgacactactacatctctcaactgtcacttgataaccatctaaagatgtcactcacaaatatactgcccacccgtccccacccacccttcatacctctactcacacatcaccacttcacctctcaactctcatctgcataaacacctcacacatacccaaaactcacaaccaccacacaaactcaatcacacctcacccaaaacatcacacaacccataccaaccacttccatcacatcctcatcccccaacacatccctcactcacatccactcttccactaacatcatttcgttcttccatgtactacagccttcccctcctctctaactttataccacacacatctacactacaactcctaatctcaacacatcgactcacacatacctaccatcataactcacacctaacgtatatcttcacttcatccttacatatacaactttaactaccctctaccttaaaaacatcatctatcactacgatcttcagtctcacatcacacctcccactatctgtaatattatataacgtagataactaacagttaaactaataaatcatatgattctaatctcattaatctaatgtacactaatctacttcaatgacatctcctaccatatatatatcttacaccacatactagtaactctgaactaaagaataaatcataactaacatatctcacatataaaaacaaaatcaaacttcaccaccaacaacactataataaatactgaaaaaacatatatcaatatataatactccacaacgaatcactctacataatcctacaaagagcaaatataacacaccatcaca

SEQ ID NO: 481922 - DNA, 119 bp, Homo sapiens
agtttttttggggggggggggggaagctcctgagccggggctatttctggcgctggcgctggctccagagaaggcagtccgcagtttgctacccccccaaaaggggggggcccccggtg

SEQ ID NO: 481923 - DNA, 88 bp, Homo sapiens
  misc_feature (34)..(34): n is a, c, g, or t
ccagctctgaaaaacaaaaaaccttttttgtttntaaggtttgcctgttttaaaattttataaaaaaaaactgtgggcttttgtgtca

SEQ ID NO: 481924 - DNA, 976 bp, Homo sapiens
  misc_feature (415)..(415): n is a, c, g, or t
  misc_feature (424)..(424): n is a, c, g, or t
  misc_feature (441)..(441): n is a, c, g, or t
  misc_feature (445)..(445): n is a, c, g, or t
  misc_feature (447)..(448): n is a, c, g, or t
  misc_feature (481)..(481): n is a, c, g, or t
  misc_feature (492)..(492): n is a, c, g, or t
  misc_feature (521)..(522): n is a, c, g, or t
  misc_feature (568)..(568): n is a, c, g, or t
  misc_feature (579)..(579): n is a, c, g, or t
  misc_feature (633)..(633): n is a, c, g, or t
  misc_feature (646)..(646): n is a, c, g, or t
  misc_feature (668)..(668): n is a, c, g, or t
  misc_feature (694)..(694): n is a, c, g, or t
  misc_feature (734)..(734): n is a, c, g, or t
  misc_feature (780)..(780): n is a, c, g, or t
  misc_feature (805)..(805): n is a, c, g, or t
  misc_feature (832)..(832): n is a, c, g, or t
  misc_feature (913)..(913): n is a, c, g, or t
ggaagggtccaatcctgcccacgcacacgctattaagtcaaccctgtcccccaggcccctgtcctccctccacccaggagctcctccatggcaatccaggctttccgcccaaggtggccccgtcatcacgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaaagaagaaagctcaataaaaagatgcacaagcaccaaaagcaccacaagtaccacaagcatggcaagcattcctcctcttcctcctcctcttccagcagtgattctgactgatacaggcgctggacccttccctcnagtctcccngttctgctctcccatcnagcntnnagatgccatgttgtactgggggaatgtagcccntgtgctccccnaccccctacctccccctgagcctcacccnngctgttgagccctgagtggctaggggaaatgggaagaggattgccntggcctggccntcttgttgctgcttggttagatcatatagctaatgaattaggcaggggagctantttgttgaagatngatgaactaaatgttgaagacnagtttgagaatctgtaaaatgtgatnttttactatccacttataatacttgtgattggggaggttngtggaaattcaattatgatgaaaaacctatcttttattgtaatgtnggcatacttggggaatttagtggcnaatacattccccagcaggccttttgtnggttgcactaactgcaaggttgctgggaagtagagtccatttggttgatgagctttgactgcggttttggaaccttacctntcctcctagccccaatgctgtcttgggtcctattccaaataaagttatttttcctggtctcca

SEQ ID NO: 481925 - DNA, 868 bp, Homo sapiens
agataagtgatcagccataaagtacattatctggtaataacgtttatggggtcggggtaaggctggtggtaggatacttctctgccatgcccaattatactggattcatggccctagaactacaaacaaaattcatgggttttcttgtatctttagatctagctggcatggaactcactgtgtgcaccagactggcctcaaactgctcttatgtaataatcacatacttaataggaatttctattacgttgaagattgagattgaaaaattaggaactcattgggagcgggagagatagctcagcagttaagagcattgcaagaggactcaggttcaattcccagatacacacacagcaacaatctaactgtctagtgactccaactcaagaagcagaggcaagtggatgtctgtgagttcaaggccaacctggactacagaaacaagttctaggacaaccaggctacacagagaaaccctgtctcgaaaaaacaaaagaacaaaagtcacttctgtccaccatatgtgttctgggtatcaaacttgggtcatcgggctttatgtaaaccaccctctgagccatctcagcgcgccctgtaatatggacttttgggtggatctaacactggtagcatgactcccacatccacttagggtacagttaaatagctccagggggttaggtactggtacttgctgttcattgtgctaatctcttgtctaagattcctctcctgatgcctgggtaagactgaaaaaggcagcgagggaacaggcattggcggccaggccttgctggaacgggaacggtcccccttggtgggcggccgcaaagcccatttcgccccttttattcacatacattaa

SEQ ID NO: 481926 - DNA, 320 bp, Homo sapiens
tccaggtgcagaaggtggagaagctcattgtggggaaaaagccgatcggagtcgctgcatcccgggctcggctgtgtgctctctcgtgccccaccgtcggtgtggtctgctacgtgccggctctttgatggttccagtacccaagacaagccccagtaaactcgagactacaccacgcgacgaaatctgtcctgcttcaagcgagcctcctggctggtcaccaaggactcttccacgaacgaagaagaactctggtgaccgtagcagcttccggacagtccttctaccttgtagcggcatgcagagtcctgcgtcttcga

SEQ ID NO: 481927 - DNA, 114 bp, Homo sapiens
  misc_feature (48)..(48): n is a, c, g, or t
gaacaggtcaaaaagaacctttattacttttaggatgccactatgctntcttgcagatgcctttggagcaggtgcttctgggctggagctttttgacccttctgtcgtcttctc

SEQ ID NO: 481928 - DNA, 158 bp, Homo sapiens
  misc_feature (43)..(43): n is a, c, g, or t
  misc_feature (52)..(52): n is a, c, g, or t
  misc_feature (59)..(59): n is a, c, g, or t
taatatcatcaactgtagcctagtgttccacactaatgcaagnttgggcatnggggaantcgtgttggagagagagatatgtgagaactctgtactttcttttcaatgtttctgtaaacataaagcagctctatttgctttacattgaaaaaaaaaaa

SEQ ID NO: 481929 - DNA, 498 bp, Homo sapiens
cccaaacataagatgaaggttttccctaaagttatctttcagaaagaaggaatgctttacaatttaaatccttacttcttgaggcagacaccaagttattttatactaaatactaacacagggcctaaaaaacaacaaaacaaacgcgtcaatgaaaagccgggacattgataaggagacattccaagtatgccgtcatgccgagggaaagggaagggggttggggatttcaaaacaggactggaaagtcccagtcccagaggcttctctccagtaagtcggtgaatgggctgaagatggctgaggtgttcatcataagtcagggacactgaggtttgaaaggatgtcaggccatctctagatatgggatacgttggtcagggttacaacaagaaagtagttttataaaagggggaggatccggtttaaaacgcagatttaatacttattgcgggagagtgattacaaatagtagctgccatgggagaagggctctga

SEQ ID NO: 481930 - DNA, 194 bp, Homo sapiens
  misc_feature (169)..(169): n is a, c, g, or t
ggggcacacaggttaaggaggcactcactcctttttaaggtggcctctgagagtgagtaccttccttaacgttgtaccttaggcacctcatatgtctcatgctggtcctagccttgcccaggtgcaaaccaccttatcagctgggtatggaatccgttcacttaatgcngctagcgcggggatccttagatcag

SEQ ID NO: 481931 - DNA, 956 bp, Homo sapiens
  misc_feature (44)..(44): n is a, c, g, or t
  misc_feature (61)..(64): n is a, c, g, or t
  misc_feature (83)..(83): n is a, c, g, or t
  misc_feature (92)..(93): n is a, c, g, or t
  misc_feature (103)..(103): n is a, c, g, or t
  misc_feature (107)..(107): n is a, c, g, or t
  misc_feature (110)..(110): n is a, c, g, or t
  misc_feature (113)..(114): n is a, c, g, or t
  misc_feature (116)..(117): n is a, c, g, or t
  misc_feature (123)..(123): n is a, c, g, or t
  misc_feature (126)..(126): n is a, c, g, or t
  misc_feature (133)..(135): n is a, c, g, or t
  misc_feature (137)..(137): n is a, c, g, or t
  misc_feature (157)..(157): n is a, c, g, or t
  misc_feature (240)..(240): n is a, c, g, or t
  misc_feature (249)..(249): n is a, c, g, or t
  misc_feature (309)..(309): n is a, c, g, or t
  misc_feature (534)..(537): n is a, c, g, or t
  misc_feature (570)..(570): n is a, c, g, or t
  misc_feature (580)..(580): n is a, c, g, or t
  misc_feature (595)..(595): n is a, c, g, or t
  misc_feature (638)..(639): n is a, c, g, or t
  misc_feature (643)..(643): n is a, c, g, or t
  misc_feature (651)..(651): n is a, c, g, or t
  misc_feature (659)..(659): n is a, c, g, or t
  misc_feature (665)..(665): n is a, c, g, or t
  misc_feature (667)..(667): n is a, c, g, or t
  misc_feature (741)..(741): n is a, c, g, or t
  misc_feature (745)..(745): n is a, c, g, or t
  misc_feature (861)..(861): n is a, c, g, or t
  misc_feature (868)..(868): n is a, c, g, or t
  misc_feature (890)..(890): n is a, c, g, or t
  misc_feature (894)..(894): n is a, c, g, or t
  misc_feature (904)..(904): n is a, c, g, or t
taccagaatttagatgttaattccccagaggaaaaatgccatgncaagttttccccgaaannnnacatgtagacagtgaagcntctgaagtnnggggtcaaangggnagnggnngnntttttnggnatcttgnnngnccctagttttaaagaaagtngaatccatctggggcatgtctgcatcacagggtatcactcaagagtcatcatcaggccaaaaagactctgaagggaaccaggngggtttggnccttgctgtggaaagacgctactgaaagtataagagaacaccctaatgcacgcgtcaggnacgaaaccgtaccatgccccgctaagacatgggaccagagaacacgtcaacgtcaggccgctccaggaaaaccatccacaaagacaacagaagctaacccgaggtcgacactgccatgaagagtgttggctgaaaccgcagttaccagtgtctttactggacgcgaacatccctaaggacacagctgtgctgcttcctaagcatacgtgaccacgatactgtctnnnnccgggtctccttagcgccatcactgcaccaggnccagcatgcntcaagtcctccaganccttctcctgagacagcactaggggccacgtcacaccccaggnngcancccttcancgtgcccntacccngnccggtctgccctgctggggccggtgggtatcatggggacccctgtgtagacacggacaccggagagcgtggganaggnggcgtctcagagctccccacccacacactcaagggtcagcgtcactcatgtttccttctgttcccatggtgcctccaaaagggtttccaaacaaagtcatcattgattaccctggngtatgtnaataagccaaacaccagcagcnaganaccaccaagntagttaccactttaaaagaagatgagctggagaacgagcagctctctgatgg

SEQ ID NO: 481932 - DNA, 314 bp, Homo sapiens
cctctagacgtctgatctgcgtgctgtaaagcttgtttgtggcctgtctatttacaccgtccgagactagtgataacctctggtgtgctagatggggacaaaacagtgactgtggagttcaagcatgacgatcggttcaatgaagagagcggagctctcctgcattgtgccctgctttataccagctgtgcagggcagcgtcgagctgggctgggcaggaagtgtttcatccgcttggtatagaagacggtgaagaatgggtagagagcactaaaagaatagacatggcacgggattggctcatttctctcttc

SEQ ID NO: 481933 - DNA, 174 bp, Homo sapiens
cacgatggtctcgatctcttgaactcatgatcctccccccatcagcgctcccaaagtgctaggattacaggtatgagccaccttgcccagccgatgatttattagtctcttacgatcatggactcctttaggaaacctagcctatagacaaaatgctcagcatatacataatat

SEQ ID NO: 481934 - DNA, 227 bp, Homo sapiens
tatccagactcacgtttattatctgtgctttctgtgggtaccgcttgttgaagggctaagaacgattcaaagtacctagtagctgggcgagcagctactgattctgcgtctgagggcttggcttcctgagcctccgttgctgcccttcccccagctcagtcgccctccaggtgcaagagagctggttggcacaatcgatggagccaggcttggtgatcttggtgagt

SEQ ID NO: 481935 - DNA, 1280 bp, Homo sapiens
ggcggcgcggcgtaaagcgccattacgcagagagaaagttacgaggttcgtggccgcggtttccccaggcagctggcgctggaggcttcggcgtcacgtgctggtctggatttttctcgatgcactggggaaagcggtggactcttatcgtgggagggctcttgatctgtgatttatagataggcacagctactcccgttcgggaacccaacggcagacaggtcctagtgcccatcagatacccgcggccgggactcggagctgtggggtgtggggaggcggaggcaccaactaagagcgacctagcatcgcaaagccgccctcggggcgctcatggcgggacgcctcctgggaaaggctttagccgcggtgtctctctctctggccttggcctctgtgactatcaggtcctcgcgctgccgcggcatccaggcgttcagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgaaagtaatttttctcccaagtttaacgaaaaggatgggcatgttgagagaaagagcaagaatggcctgtatgagattgaaaatggaagaccgagaaatcctgcaggacggactggactggtgggccgggggcttttggggcgatggggcccaaatcacgctgcagatcccattataaccagatggaaaagggatagcagtggaaataaaatcatgcatcctgtttctgggaagcatatcttacaatttgttgcaataaaaaggaaagactgtggagaatgggcaatcccaggggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtgatatataagggatatgttgatgatcctcgaaacactgataatgcatggatggagacagaagctgtgaactaccatgacgaaacaggtgagataatcgctcgtcgccttaatccaagccctacagttttcacacttctagtaagcctctacctgcacga

SEQ ID NO: 481936 - DNA, 1140 bp, Homo sapiens
  misc_feature (421)..(421): n is a, c, g, or t
ggcggcgcggcgtaaagcgccattacgcagagagaaagttacgaggttcgtggccgcggtttccccaggcagctggcgctggaggcttcggcgtcacgtgctggtctggataattctcggagtgcaaatggatggttcgatgaagcacaaaacggaaaggagtacgagatcagtaaaatagatgtaaaggacatggaagcaccgcttaacaaagatgcccgaacatctaaacaggaccaaatatcccgacatagaaccggcaacccgagggatctacggtaacgtgtaggggagtggtaggggagggcgtgaggcaccagagctaagtaggcgacccgagcatgcgcgaaagccagtccacaggaatctactcataacaatattatctaccggaaaagaaggattatatgtgcagctaagnaacgacacttcgacaaggccataatcctgctaatgatgaaggcaataacctggactggaatctcattaaacataccaaagggattgaagaagcacataaaaccagacaaactattagtggccagacataataacccgatgcatacaatgaggaaatatcaaaatgaaggataccgggatgaatgacagctacaacagatagggaacacatgatcaaacgaccatgacgccagatggacagaataagagaacagggaagccaaaaaagccgaaataaagaatgagaagatcaataggaaaatgaaaaaaaatatctaatggctaattgggtggcgaaaaaggaagaaacaggggaactattacgactaattgtataaatgagaagaaccccgataatgagaatctgttatactgacaaaaaactatttattgttgtagaaaaatagacacggcgcgaatgagaaaattgaatgtacacttgggggaaatccacaaaaaataataaacgtatggacagatgcttaattaaagaaaggggcattataatgggactgatttagacatttcgagtgattttaaactcttatgggaaaaactctaacaagaaagggaagagcgaatagagcgaagagggaattttccgggggggggcagattaattgttatggggaattaagaaatttcgggaaagacaacagctgtaacaaatttactgtgcaa

SEQ ID NO: 481937 - DNA, 638 bp, Homo sapiens
aaaggcccaactatgaagatgtgttgtttcataattcacatatcaagagtggccttgcatccatgtcacagtgtccccaaatggtggacaaattggtaaaattcccagcaaaacaaagtacaatctttgcccagtttataagataattgcatccctggaaaaatcaacatgtcttaaaaccaccccaaaataactcatgtttatgtatgaaatggagttatgttatactgatgattagaagcggatttttttgtctgtgtgaatgtccagaggacaataaacagggtgagaaacggggacatgacttcattattcaagaccatcttgtgcattgcaggagacttgtcaccttctcctgggcccagtaaatgccagtagtccccccacaccccatcactgtgacaactaaaaaccctcatgccaatatccagattgcctcacctccgtgagtccagactgtgggagttacctccagaagaaccaaaacaagaaatagttaaaagaggttgcctctgggaaggaggccactgtctaggagggagggctgggggactcttgttttttatcatgatttttagccccgtgttctatttaatttttaccatatgtatgcattacatatacatataattttttaa

SEQ ID NO: 481938 - DNA, 358 bp, Homo sapiens
acctcctaccccacggaaaaaaaaaaattttaatagagacagggtctttctgtattgcccaggctggttttgaattctggggttcaagcaatctcccgccttagcctctcaaagtgctggaattacaggtgtgagctaccatgcccggcctatattagattatcttgaccagtgctgtctaacagaactttctacaatgatggaaatgttgtatagtttatgctgtccaatatggtaggcactagccacatctagctattgggcacttgaagtgtggctagtgccatcgagcaactgaattcttaatttatttaattttaataaatttaaattgccactgtggctactggctactact

SEQ ID NO: 481939 - DNA, 362 bp, Homo sapiens
ttttttctaccagaatagaaaccgtatcatcccattctctcctggactacaaggttgtctgcagagaaatctgcttcagtcttgtatatgatgacacttttctcttactgtttttagaattcttttgtctttgacttaagatagtttgactacaatgtaccttagaggggatctttttgagttgaatctatttggggacctttgagcttcttgggtctggatgttcatatttgttcccagacttgggaagttttcagctattatttaattaaacaaattttctacgccttttatcttctccttctggtattctcataaaatgcatatttggttacttaatgctatcatataaatcttgtagg

SEQ ID NO: 481940 - DNA, 396 bp, Homo sapiens
ttggggccgggcggttcatttacttcaggaatcaaaaaggcccctttgggcttcaccccccaggattcctgagttgaagggcagatgccaatttaaggaagaatttttttccccccctttgcgggatgaaaagctttccccccggggggttttttttccccaaaagagggctttttcaggccctagttgtttttggttcagcaactccaaaaaatgtcccccccgtgggggttccccagttcctgcccttggcctgaagtcccagcattgagggcgggccctctttttcaacttttgggctcccctttgcctaaaccctagggccccctgggcatttggtctccccctgtccccccacccccttccattttttaatgtttttcaaaaagggggtta

SEQ ID NO: 481941 - DNA, 567 bp, Homo sapiens
gtgcagacatataagctaaaataacaaacaagtaattcatcacaaaataaataaaagttatatctgtctatactgaaacatatataactactaaatattgtcctgctggctactgctgctctcaagtacatagtcatcctcatagctgtatcctgatgaataatgatgtcacgtgtggagaaactacaaatgtagtacaactgaacgaaagaaaacccttggagataagtttagtgaggggattgaaatccccaaaaagataacattattcttctgcttacaaaaactgaaataccctgtactagttcctaacaattctcattacatactatgccagattacaaaatacttattattaaaatgaaatctatatattgcctttcttatcaatcatcttactgtgccatcacaattagaagtacttaggttagacaacaacacttagagcctccagatacacttttaagacttatttagcttagtgagatggtatatacatgcacataagtaagggtgggtaaaatattttgtagaagtattcggtcctatattaatgctctttgtatg

SEQ ID NO: 481942 - DNA, 848 bp, Homo sapiens
  misc_feature (18)..(18): n is a, c, g, or t
  misc_feature (64)..(64): n is a, c, g, or t
  misc_feature (71)..(71): n is a, c, g, or t
  misc_feature (102)..(102): n is a, c, g, or t
  misc_feature (104)..(104): n is a, c, g, or t
  misc_feature (106)..(106): n is a, c, g, or t
  misc_feature (111)..(111): n is a, c, g, or t
  misc_feature (125)..(125): n is a, c, g, or t
  misc_feature (148)..(148): n is a, c, g, or t
  misc_feature (160)..(160): n is a, c, g, or t
  misc_feature (181)..(181): n is a, c, g, or t
  misc_feature (188)..(188): n is a, c, g, or t
  misc_feature (217)..(217): n is a, c, g, or t
  misc_feature (245)..(245): n is a, c, g, or t
  misc_feature (255)..(255): n is a, c, g, or t
  misc_feature (276)..(276): n is a, c, g, or t
  misc_feature (278)..(278): n is a, c, g, or t
  misc_feature (282)..(282): n is a, c, g, or t
  misc_feature (303)..(303): n is a, c, g, or t
  misc_feature (327)..(327): n is a, c, g, or t
  misc_feature (331)..(331): n is a, c, g, or t
  misc_feature (336)..(336): n is a, c, g, or t
  misc_feature (383)..(383): n is a, c, g, or t
  misc_feature (473)..(473): n is a, c, g, or t
  misc_feature (510)..(510): n is a, c, g, or t
  misc_feature (519)..(519): n is a, c, g, or t
  misc_feature (550)..(550): n is a, c, g, or t
  misc_feature (571)..(573): n is a, c, g, or t
  misc_feature (580)..(580): n is a, c, g, or t
  misc_feature (587)..(587): n is a, c, g, or t
  misc_feature (602)..(602): n is a, c, g, or t
  misc_feature (606)..(606): n is a, c, g, or t
  misc_feature (631)..(631): n is a, c, g, or t
  misc_feature (641)..(642): n is a, c, g, or t
  misc_feature (658)..(658): n is a, c, g, or t
  misc_feature (739)..(739): n is a, c, g, or t
  misc_feature (748)..(748): n is a, c, g, or t
  misc_feature (755)..(755): n is a, c, g, or t
  misc_feature (759)..(759): n is a, c, g, or t
  misc_feature (770)..(771): n is a, c, g, or t
  misc_feature (775)..(775): n is a, c, g, or t
  misc_feature (795)..(795): n is a, c, g, or t
cccttttttcctggcttntttatcctcctttaccgtgcattttattgggcggtttaagctaatnaggatanaggatctttctaataaatgactaacattaangngntgctntgttgttttttttngattattctttcaaacatcatanttgatttctatngatgcccaatttccttctgtngtaccantgacccgcccccctcaaaccccatacttnattgctgaggattaagaagatcctcttnttggcccgtnctttttctgatgttaatattntngtcngtttcaatacatctaactaanaagaactatgggtctagggttgtngctntcgcngccctgagttctataaccacgatggttttcctgttagatcttacganaatgttgtggacgttccccattctatttgaggagaaaacaaagaactcagttgctttctgtttttgcgaagttactatgctttgggctanagtgttgatgtctaagatagtggtagcaaatattggngttatctangaatcagatgatgctttagtgtgatgaactnaaagaggaatgtttctaggannngtctganggggtanaagggattgcaacanaaangccatttactgctgtgattgaatantgtcaatgtnnttctgtctatttcctntagttggtgaaaatatttcaatatgctgctgtcccaaaagcctggccattagagggtaaacaagactcctttacagggttnataaaggancaagatnttangggagctatannagcntaactttaatctgcttaaanaatatttctctcgaaagctgcttacagagctctgcaaatagtctgtttgtggc

SEQ ID NO: 481943 - DNA, 93 bp, Homo sapiens
acttgctgctcgacttttcttgggggtggagtttcctctgtgaggggctgcagctatccttcctgtgtatacaaatacagtattttccagggt

SEQ ID NO: 481944 - DNA, 614 bp, Homo sapiens
ggtgtggagaatactcatatgtatatagataatgtgtatgtgtacagacataagactagttcagttcctcagccattgcgatctcatctctacacttatagccaccgtaaagtcgtgtctggctcagttacatagtctgtagatcattggcatgatcatagatagcctcagacctcaacctgctcagtctcatgcagctctcgcaattcagcctctgcagtagttggtgagcataggtgtgagccatagctcagatctaacttttggaaatttagtaaatgtcatgtttcgccatgttgctcagactggtctcaaactcctgtcgtaaggtgatcagaaagccatggcctctcagtgatctgagctttatagtgtgatgtactgtgatgtattgcatcccctttgagcagctccttttatcactgcctctagagtctgagccattggcagggcgtataaatgtagtgtcttcttttcatttaaaatagcattagcacgaagagtatggtacagttataggattacaagttgtatctcacctgtaaaaggtgcactatagtttttagacctcaatatacattagcacagaatgtgaatgagtagttcaagttttg

SEQ ID NO: 481945 - DNA, 95 bp, Homo sapiens
ggcacgaggacttggcagtgaagcatttttcagttgaaggacagttggaattcagagcccttctatttgtcccacgacgtgctccttttgatccg

SEQ ID NO: 481946 - DNA, 140 bp, Homo sapiens
atgttttctcatagagtaattatatgaacagtttatatgacctccttttggtctgaacatacttttgaacagaatttctttttttaaaaaaaaaacagagatggggtcttactatgttgcccaggctggtgtcgaactcc

SEQ ID NO: 481947 - DNA, 391 bp, Homo sapiens
atattattcagcagcctgcaaggattttaatatacacttcaggctgaccgaaaagggagagtatttgctgttatagaatgggctctcctcctccggcggcgtcgaagaaggtggagttgaggttgcggactgatcgtagtatagtgatgccagcagctagtactgggagagataggagaagtaggactgctgtgattagaacggatcagacgaagaggggcgtttgctattgacatatggcaggttgttttatattgataattgttgagacgaaattgatgacccctaagatagaggagacacctgctaggtgtaaggagaagactggtagttctacggaggctccagggtgagaggagttccctgctaacggagggtagactgttcaacc

SEQ ID NO: 481948 - DNA, 191 bp, Homo sapiens
ccccgggtctgtatgtcactcaaactcctcctacatcttgcggtcacttcctttctgcccaataacgtaacggtgacggtcaaagggcacctctactttaatggtgacaggaaccaatgcctccagagcttccttggcagcctcacacttttctttccggcccgagatgatgatgatgtcacacctccttg

SEQ ID NO: 481949 - DNA, 347 bp, Homo sapiens
cgtgtctgtaatcccagctgttcaggaggctgaggcaggagaatcacttgaacctgggaggtggaggttgcagtgagccaagatcgcacagctgtactccagcctgggtgacaagagtgagaatccgtcccccccccaaaacacaccaccacacgtaacttttattatagtatattgctataattattctattttgttattaatgttgttactctctgtgcctaatttattttaactttattgtagttatgtgtggataggaatatagtgttcgtagggtttagtactatctgtggctccaggcatcacctgaggtcttgctgattcccctgcagcctgtggctccg

SEQ ID NO: 481950 - DNA, 726 bp, Homo sapiens
agcgaaatggcatttgaaccaccaaaaagaaataaagggctgagtgtggtggctcacgcctgtaatcccagcactttggggagcccaggcgggcagattgcttgaacccaggagttcaagaccagcctgggcagcatggtgaaaccctgtatctacaaaaaatacaaaaattagccaggcatggtggtgggtgcctgtagttccagctacctgggaggctgaggtgggaaaatgacttgagcccaggaggaggaggctgcagtgagctaagattgcaccactgcactccaacctgggtgacaagagtgaaactgtgtctctcaaaaaaaaaaaaaaacaaacaaaaacaaaaacaaaacaaaacaaaacaaaacgaggtagggattccccgtgttttcctctcttaaattttaaagtttatcagttccgtaaagtctcgggtaaccaaacatactgaagaacgagcaacagaagttcacgtttcagggacgggctcacacctgttaatcccagcacttggggagatggcggtaaagggatctctggagcccaggagttcaagaccagctggggcaacatagcaagactccatctcttaaaaattcaaaatagtaacatttagccaggtgtatgcagacagatctgcagcagttactcaggaggctgaggtggaaaggatcgtgggtgcaccagaagttcagaggctgcaagtgagcctatattgac

SEQ ID NO: 481951 - DNA, 139 bp, Homo sapiens
  misc_feature (19)..(19): n is a, c, g, or t
  misc_feature (22)..(22): n is a, c, g, or t
  misc_feature (122)..(122): n is a, c, g, or t
  misc_feature (126)..(126): n is a, c, g, or t
gctccacttcccacataanacnagacctctcacaaaagagttcactgatatgtgaatgcagctttctccccatggtagccaggacagggtgcacattaaggcaaccccaaaaacacctcttnctgnctgcctctgcaaa

SEQ ID NO: 481952 - DNA, 102 bp, Homo sapiens
agcggaacagcatggactgacatgcccaaggttgaagcatgaataaaagacggggctcctggtggatgagtttaaggagctgtttacccaccagattacaat

SEQ ID NO: 481953 - DNA, 171 bp, Homo sapiens
acgtctagctgttcttgtgtaacccagcatgtgagattccgtttatgatgtgcaagagtgtcatgagcatggagaagtcaagcgggcctagagcagaggtggaggagatgaatgacgcagctggaagagctggaggacgagctgcaggccaccgacagatgccaagactgc

SEQ ID NO: 481954 - DNA, 192 bp, Homo sapiens
  misc_feature (106)..(106): n is a, c, g, or t
  misc_feature (129)..(129): n is a, c, g, or t
  misc_feature (165)..(165): n is a, c, g, or t
  misc_feature (182)..(182): n is a, c, g, or t
atttatttatcaaataatttaatcccccacaatcccatgagtaagagacatttactgatccctttttatagttgaggaaacagactcagggaggggaggtgacttnccagagccacacagctggcaatntggctcctgtacttccgcatccctgaggtcactttngtgcccccgccgcatgncaggggtaaa

SEQ ID NO: 481955 - DNA, 150 bp, Homo sapiens
  misc_feature (87)..(87): n is a, c, g, or t
gctcatctatccttgagcctccattaatttatctccagggcaatggctaaactaggtccttttcttggcaacctgcactgtccaganctggagatggagatatacagggcgaggacatcaggagggcacccaggcgtatttcagctgagc

SEQ ID NO: 481956 - DNA, 354 bp, Homo sapiens
tctactggatctctccttggtgtatccgctacagtctctctgtctgtctgccaggttggcgtgctcgttggttgcagttcccagctcctgtggtggcaccgcctcctcccgggttcacgccattctcctgcctcagcctcctgagtagctgggactacaggcacctgccaccatgcgcagctaattttttgtatttttagtagagacggggtttcgccatgttagacaggatggtctccatctcctgagtttgtgatctgcccgccttggcctcccaaagtgctgggattgcaggtgtgagtcaccgcgcctggccttttttttttttttttttttaaaaatagggtctcactc

SEQ ID NO: 481957 - DNA, 862 bp, Homo sapiens
  misc_feature (14)..(14): n is a, c, g, or t
  misc_feature (118)..(118): n is a, c, g, or t
  misc_feature (181)..(181): n is a, c, g, or t
  misc_feature (219)..(220): n is a, c, g, or t
  misc_feature (235)..(235): n is a, c, g, or t
  misc_feature (237)..(237): n is a, c, g, or t
  misc_feature (307)..(307): n is a, c, g, or t
  misc_feature (313)..(314): n is a, c, g, or t
  misc_feature (317)..(319): n is a, c, g, or t
  misc_feature (322)..(322): n is a, c, g, or t
  misc_feature (445)..(445): n is a, c, g, or t
  misc_feature (519)..(519): n is a, c, g, or t
  misc_feature (549)..(549): n is a, c, g, or t
  misc_feature (575)..(575): n is a, c, g, or t
  misc_feature (609)..(609): n is a, c, g, or t
  misc_feature (612)..(612): n is a, c, g, or t
  misc_feature (631)..(631): n is a, c, g, or t
  misc_feature (635)..(635): n is a, c, g, or t
  misc_feature (650)..(650): n is a, c, g, or t
  misc_feature (662)..(662): n is a, c, g, or t
  misc_feature (668)..(669): n is a, c, g, or t
  misc_feature (689)..(689): n is a, c, g, or t
  misc_feature (756)..(756): n is a, c, g, or t
  misc_feature (842)..(842): n is a, c, g, or t
cagtgtctcacccntatcatacaacgactcactggcgctcccatcattctatatatttattgagcatttacagtgtactatggcacatatagaacatacagaaaacattgtccctgcncttgaggagcttacattctaaaagaaaaaatacaccttttttaaaatggcattgttgtttggnggtttctgcaaagtatctgaggaaatattttgtaaagnnagcattgggtaaaantnaaccccagtcattatttagagaatagaggaggaagaaagaagaaggattttaaaggcagacaatgacagnccattnnggnnnggnagggttttaaagggagataaacacagtctcatcaactaaggagagatttgctgcagtaaataggatgagggaaatagtcgtgtgggatgcaagcaaaggatagcagggtgccttagacactgngtggagccagaaagatcatgcggcgcgtttttccaagtacactggccaccaagtaagaatggttggtgacaagncagaaggctataaacacggaaggtaatgcntgtgcacctgacaaatagagagaatnaaggatcaaaattgaaggcaggctataagagtancangaaattcttaaaaaccaanaagngatttggaagcacgnaacttacagttnatgctnnccaatgtcatgatgggccangaacattgtggcttcctaagttagaaaatgccatatgccaaaattttaaatgggacacactacattnttttctaatcaatccccccctctcccagaaaaaatagggactcatttttttcagggtgggggaggaagagaggggatcatgggacntggaaacaagtagttatatt

SEQ ID NO: 481958 - DNA, 198 bp, Homo sapiens
tctagaggtccccgtctgagcaagtggggaagtagagcataaggtagaatcagggggcgtgttaagctggttttctggcaacgggatgtcccacgttgggctgtcacccctcgggaatccactgtatacgaaaattccaaatattagtggggcataggggcaagcacctgtagtctcagccacgtgggaggtggaggg

SEQ ID NO: 481959 - DNA, 379 bp, Homo sapiens
tgcaactctgctcccgggttcaagagatctcctgctcagctcccaagtagttgggactacaggatgtgcacacgcccagttatttttggaatttagtaacacgggttcaccatgttgtccaggatgtctcaatctcttgtcctcgtgatccacgtgcctcggcctcccaaagtgctggagttaacaggcgtgagccactgcgtccagccaacagcaatttcgtagtgtcaactatctagactgggttcacacctgtaatcgtaacactctgggcggctgaggtgggaagatcacttgaggccaggagttcaagaccagcctggccaacacagtgagaccccgtctctgcatctctgcatctctgcctaaaggagaaaaa

SEQ ID NO: 481960 - DNA, 374 bp, Homo sapiens
  misc_feature (43)..(43): n is a, c, g, or t
catcctttggagttcggaggtatgtgatgtccgtggacctagnaacctggtagctgacgtgtttaagagctggggcaacaggccaggcgtggtggctcgcctgtaatcccagcactttgggaggccgaggcgggtggatcatgaggtcaggagttcgagaccagcctggccaagatgttgaaaccgcatctctactaaaaatacaaaaattaactgggcgtggtggcgggtgcctgtaatcccatctactcgggaggctgaggcagagaattgcttaaacctgggaggcagaggttgcagtgagccaagatagagtcactgcattccatccagcctgggtgccagagcaagactctgtctcaaaaaaaaaaaac

SEQ ID NO: 481961 - DNA, 548 bp, Homo sapiens
gcccagtgtccgacgattcctcctccttggtcgccgcgtccttgtgctagggcgtctagcacaaacatggcctatgaaatcttcctagcacatgataagatctggttcgactaaggttcatagatatgacgactgctagaatgggagattctacgcagcgagatgacacggtgccctgtggcatgtgtgcccttgcccgtccaagggcatgaatcggcggccagcgatgatccgtccggtggagcattggcgagcaggcccagagaagaacagtccaggaagatcctctggcctggtaagccctctaaggtccctcgggggtcctccagcggacatcgcatcgggagaccacggtgagcatcggtcgtccggattgccatgtctggaaagtggagaaccagagttctgcgtggcgtggtacattgacgctgtacgcaggaccatctccaacgctggaggcccgggtgaacgtgctggacgaagagctcgactgggcaccgggccacggtacccaacagatcgcagctacgtatcatcccatgcgccat

SEQ ID NO: 481962 - DNA, 290 bp, Homo sapiens
gccatcagactgcaacaacttcgtccattctgactgttctcctctagtctggacactcggcgtgtgcatgcacacgccgaatgtccatactgagcaggtcgtgatggacgaagttgttgccaacttcgtccacaacgatatgcaacaacttcgtccactacgacctgccatcaagagtctggtgtttcggcgtgtgcaccattgggatttagaagtgttgggtccctcggcgtgtgcatgcacacgccgaatcaccatacttcttcaggtctgggtggacgaagttgttg

SEQ ID NO: 481963 - DNA, 691 bp, Homo sapiens
gagtgtgaaatcttcagagaagaatgtctctttagttctttgcaagaaggtagagataaatgacagcgtttgtcaaaaatggcaatggtatcagaattcctcaagcaggcctggtttattgaaacatgacagtagcgaagcgaatatgttcaaactagtgaaagtctagtccaataggtggtcccgagaatctagcggtgagcctccgtatccgtacgcttcatatccatcctcgggttgtcgctgccgttgcgttaaggtccataactggttaagaggtgtggatgatagcataccagtcatttgatcattcctaagcttaagcgagaacaaagtgcacacgcgtctaagctagatcaagagcgagcgatatctccaggcaaacatgtggaaagcaccctgggatgaatgatcaccttgaagataagctcccttacagggtcacctttgagagaggttgtgtaatgctctgctaaaatgctccagacgtcgatttggattgctgaatgaactatcggtgctgccatggaagggtcctcgcgtaacttgcactcaatgaactactcgtgatcgcatgcatttgacttcacgtaactgaccatagtaacactcagagagttttaacagggtctaacagagaggaactgaatgcagcagattctggcctatgacctttaaaccgtgcagtcac

SEQ ID NO: 481964 - DNA, 173 bp, Homo sapiens
tatccatgaccgtgattcgacatctcggactcccaaattgtgggattacaggtgtgaactaccacgcctggaccaatctatctagcttacatagtttctgaggagatgtcagatgtaatttatattttagctcttctgtaggcaagttgagttttttccccctctagcttcac

SEQ ID NO: 481965 - DNA, 830 bp, Homo sapiens
  misc_feature (713)..(713): n is a, c, g, or t
  misc_feature (736)..(736): n is a, c, g, or t
gcaacttaggctagtacgaggccccgtgttaatcggccgaggctgaaagggatggttgagaaagggcatcgcatctttgaactactttcatcaggctcttgatctgaagcatggggtctctgcttatcgatccctttggcagtgccacaagaccaaatcacaccaacacatcttagagacatgggtaggctggaggcactgtacacctggtctattgctgctgctttaagaaacagaatctcagggtcttctcagtaactgaaccccatggtgggaagaaagaatactaaattagaataaacccctactcccaccccaccccacctcagtgcaattcccaggagcgcttgctaatgatcgttgcccttctgaccttcactttccgaacttcattggcctggaattcaggtgtacagttgtggtggatgaagccaataccgcctgtaagctacaggataaaaagagactactactaagtgacaagaagcaggactgaatgcctttggggaaaggcgatggagtccttgctccttcccccacaccccatggggctcaccgccattgctatggccatcccagcctctgtgactgtgtccatgggagaggaaaccagtggggtcttaagagtgattttcttggtcagagcagaagtcaggtcctgaggagacaaacgtcaccagtgtgggaaagcatcccttacacctcaaggtgtnactgagtcccccacaaaaaggcncttttgttgacctgcatgctaacaagcaaatgatcctataaatccaccccaagccaatctggtgacttagcccagagaccgtgataatacacct

SEQ ID NO: 481966 - DNA, 799 bp, Homo sapiens
agaaattgaggtgccttggcccttgccttgggattaaaggggtttatatgccgccgggggtcgctacaaatgccttcgggagtgaccgtgtgaaggtttgtgaggtcgttagttgtctcgtgggactatataccccgtcgacgtttccggtgtctcgccgagccccatgcacctcgatgcggtctctgggcccttgtgcccccccggcgcaacgcctgtcttctcaggacggggtactttgttcgtacccccaaagccgaacttgcgtgaacccactaccccaagtcctcccactataacaaaggcggttttcctccaccacgggacccaacctctttgcttttattatgaacaaatgctttcccaaggagtatccccccacaaggcctattccaaattctcttgccaccagggggaaacttttcttagacgaaacaatttcgtaaccaattgcgctaaaaaacttccaattgttcaacttcaatctctgtgcaaccaagcaaatatgggcgtccccctcttaaaagatcacgaggtgagtcaattcttccctccaccgagtctcgaaaaaagttgatccaccggtgtcgcccccaagatcttcttctccgcccaaaatcaccctcgttggctttctaaaagagcggccgatcgtcccaccgctcctgtctgtgtcgttacaataaatgtttggcgacactgcacataggtacgaatgatgaaggcggccgggccaagaaaaaagaatgggggagacccaaaaaaaaaaggaataacacccggttttaaaaaaaataac

SEQ ID NO: 481967 - DNA, 586 bp, Homo sapiens
gagcggggtcgtttgaatggctgcgggcccgggccctcacctcacctgaggtccggccgcccaggggtgcgctatgccgtcggtgaggtgaccagtcgccaccgcccccgcctccccctccggcggcggcagcctcggatgaggaggaggaggacgacggctgaggcggaagacgccagcgcacgaccatgacacgagatcgcccacccactcagatccagcgagcggattcgacgagcatgtgcagcacgacatcaacactggacgaggcggcgcgggccgaggccatgggaccacggctacgcgcagccactgagacgaaagctacacgctggagggcaacatgatctatcattggtcaagacatggtgacctacatactgctggcattgcagcacacaatcgtgtatcccagacatggtagacgcaaacggggaacagctgggcacacggacaactagtgggtctctctctaacctaggaaatccctgcaactggttcccggaggccagacgcattactcgaaataggttactaactcacgactgaacgacagtgggcagaccatgcgcacactctacccccc

SEQ ID NO: 481968 - DNA, 931 bp, Homo sapiens
actagttctagatcgcgagcggccgctctttgtaaactattttcaatattgtttttcactttccttatcaagagattgtttatacatctctttcctccatgaggtaatggaaggtatatgcatcgtgtctgtaatactcagagtaggtataagatttttacacaaaatccttatgtaagatacattccatttaataaaaatagaaatgtatggttgcatctgtctttttataccctaaaaaaaaaaaaaaaaaaaaaaaaaaaaaaaaccaaacacaaaccaacaaaacaaaaacacaaaacaaaaaaaaaaacaaaaaacaaaacaacaaaaacaagcaaaagaggggggcgcgccacaacaaacactacgcagacggagaaaccaacaaaaccgacgaccacaacgccataactcgacgcgagagacaccaaccagagacagatatcaccacaaaaacacaacgcgacgcgcaccccacacacaaaaaaccgcaggcgaggagaaccaccaccccgcacagcagcgacactgcgagagaaagacaaccaaaaacgggggagcacacaaagacagagggaacaagacaaactcacacacaaccagagcaagaaacaaaaacaaccacgcacaggtccaccgccaacaacacaaccaaatacgggaggagaaaaagaaaaacagcagagaaacagcaaaaaaaacaaacaccgcgagaagaaacaaaaaaaaaaacgaaaaagacgaaaacagcacaaaacagaaaaaaagggacagaaaggagagagaacaagaaacggagacgagaaagaacgaacggacagacacgacagaagaacagagcaacacaaagcaaaacagaaagacaacgggaagaacgaaaccgcaagacgaaaaaaacaagagacaaacagatgagacagcaggagag

SEQ ID NO: 481969 - DNA, 130 bp, Homo sapiens
ccagcccgttctgcctcgacagctgtgtgcaccccagtgcctacttagaaaggggctatcagagaaggcatgtgctgtgtccctactaccgtgccctgtcctaacctcgcatctaggacccagggacagg

SEQ ID NO: 481970 - DNA, 475 bp, Homo sapiens
  misc_feature (1)..(1): n is a, c, g, or t
  misc_feature (68)..(68): n is a, c, g, or t
ntcaggcccatcttggcgagacggggtctccctctgtcgccaggctggagttcagaggctctgcttcngtggtcccaggctcttaccttcctggctccagcggtcctcccaactcagcctcctcaatagctgggcccacgggtacgggactccacacctggctaatttttgaatttttttgtagagacagggtcttgctatgttacacaggctggcaggcccatcttcttaactgagagaccagtttatgctttcctctagggccatcatatacaaagtccagaaatttagtgtgtgtaaaggtagcttttaagtcaagcaataagatgaaattgtcagtaaatgttactgggatcggccgggcgcggtgcttatgcctgtaatcacaacactttgggaggccagtgtgcgcagatcacctgaggtcaggaatttgagaccagcctagccaacatggtgaaaccctgactctact

SEQ ID NO: 481971 - DNA, 151 bp, Homo sapiens
agtgcactccacaaacagtgtatagccagtggaatgtgaatgttataattaaggagatttgtagggagattagctatagagagggagagtttttttcgtgatagtggttcactggataagtggcgttggcttgcctgtttgtgaggggtag

SEQ ID NO: 481972 - DNA, 401 bp, Homo sapiens
cagcactgctccgctgatcactgctccaaagagacccgggccttcaactgatgcccacgatggggtatggtgggctgggacagacggctcccatctcaggttgaggggcttgggcgaaccctcatgctgcacatggccaggtgtatctctgctcctgtccacgaatgtccaccacacgtcgcccatcttctggaaggttccagtcccctgcaggcctggttctcccaccgagctccgtgtcctgggtctggtcctccccatctcgcttccaggtcagtgtgatcttcgccgcgttgaaccctcagggccctgcacctcagggtggcttcatggtcatagacagcgtgctgagtcatatgcgttttgggggcgtccgtgcgctgcaccttctccttcccgtt

SEQ ID NO: 481973 - DNA, 155 bp, Homo sapiens
gaagctgaccagaggttaccctaatatccgggtgtcattcaagggactaatctcacatatttcataatgtaagatgatgggtaataaatgatttcatcaataggcctgtgtctggtatatggcctattattaattggtgacataattgtttccat

SEQ ID NO: 481974 - DNA, 406 bp, Homo sapiens
  misc_feature (34)..(34): n is a, c, g, or t
  misc_feature (88)..(88): n is a, c, g, or t
  misc_feature (103)..(103): n is a, c, g, or t
  misc_feature (112)..(112): n is a, c, g, or t
  misc_feature (128)..(128): n is a, c, g, or t
  misc_feature (139)..(139): n is a, c, g, or t
  misc_feature (152)..(152): n is a, c, g, or t
  misc_feature (160)..(160): n is a, c, g, or t
  misc_feature (169)..(169): n is a, c, g, or t
  misc_feature (196)..(196): n is a, c, g, or t
  misc_feature (201)..(201): n is a, c, g, or t
  misc_feature (214)..(214): n is a, c, g, or t
  misc_feature (239)..(240): n is a, c, g, or t
  misc_feature (297)..(297): n is a, c, g, or t
  misc_feature (318)..(318): n is a, c, g, or t
  misc_feature (322)..(322): n is a, c, g, or t
  misc_feature (363)..(364): n is a, c, g, or t
tcccattgggccttctgcgtgtaagggtttcgangggggcgggagactgcctttcaggctgcacctcctggggctgcaggcactggcngtggcagaggagctnagggtgctnctccagcgtgctgtgngcatagtgctngctgccgtgctgnctctgctntgccccttnggactttctgcccgctgtatgaccttnagtcnctgtgttcgaatntcagacaagggggcttgttttgttnncacgactgtgaagatcctgcttgagcagaagtcctactacaggtacttgaactgttnctggctctgacgttttccacntctnctgagtttctattgctgtgactgctgtgtgcgtggaccgannggccacactgcttatgactcccggcactgggtccggacgcaa

SEQ ID NO: 481975 - DNA, 228 bp, Homo sapiens
aacaaggggtatgggaagatggctccatgcttgacatcccagcattctgggaggacgagatgggaggatcacttgaggacaggagttcaagaccacactgggcaagatggcaaaaccccgtctctattaaaagtacaaaaaattcagccaggtgtggtggtgggtgcctgtaatcccagctacctggaagactcaggaacaagaaccgtttgaacccaggaggcggag

SEQ ID NO: 481976 - DNA, 385 bp, Homo sapiens
tgtcacgcctgaagtagttattgagaaagtcgtccctttccccttttctataaccaaatagacaggaatggaagattctcctcggggcctgaaagcttgcgggatgaataactcctcctcctcaggcccagtcccaaggtacaaacttgcaccagcagcaagatagcagaggcaggaagagagctggctggaagacacgtaccccctgaagatcaagagggaggtcgccctggtactacatagcagtcacgttaggctgggacaattcctgtttacagaggactataaaacccctgccccatcctcacttggggctgatgccattttaggcctcagcctgtctgcatgcaggcgctcattaaaacagcatgttgctccaaaaaaa

SEQ ID NO: 481977 - DNA, 654 bp, Homo sapiens
  misc_feature (436)..(436): n is a, c, g, or t
gctgggaagtgaagagtggcttagctatttacccgctctttggggacaggcaaactaaatgcatcccttcttacctaactcccaaccccggccctgggctgaggcatatgaatgctatagtgtgcattaaaataaatgtttttatctcctggaaaaaaaaaaaaaaaaaaaaaaaaaaaaaaaggggggggggtaaaaagtatttccttggagggggcccaacgtttacggcggtacccaggttttcttggtacaaggggggctcccttataggggaggtcgtgatatttataatgctaggagcaggagcgggtggtttaacaacgagtcgtgatggggaaaacagtggtaacgctgggaatccttcggggaaggagacccttatactttcggggggggtggtgcaaccattacttgggggagacaaaaatatacncccttacagagagagatttttaaggcgctctataggggagaaatatattaaaactttctttaacagggtgtatatactgtggtggtacaaaccctatagggcgtcgaatatatggttgtggttggtattagaagaggttttgggcgttacagggagttattggattttattgagaaaaattttttataccacgggagcgtttcttaagaaaaagatgc

SEQ ID NO: 481978 - DNA, 1404 bp, Homo sapiens
acctcgtcataaacctattctagtacccgatgcgctggggccgcgctgggtccaagtgaagttagtgatcatggtcatctcctgagaccctatggaccatcgcatgatctagctgtagtagttcgctcttgcgattcatcaacacaaagctcacagaaaacggcacccggagccgtacctgaacgatcttcgaacataattcctacagtagaggctacttgcatggtcatttactttggatctagtctaccagcgaagtcctcgaactgacctcgtattattccaccacgctcaccgtgacccagtaccacttgaacaagccaaaacaacaactcaataccacaatcaatatacaaaaacaaaaaaatcaaacaaaaacacaacaaaagcaaaataaagaaaatataacaaacatcgaccaacacaaccctcaaacaaaaaaacaactacacaaacataaaaacacaaaccatacgcacacaacacacacacaacaacagacaaacgaccaacgagctagaacaaagagcgaagcacggagatagaagaagaagcgaaaggggagagagagtacaccgacgtggccagaaccgaaggagcacgcaagcatactctgactggcgcccgtcgcacagcagcggcaacgaaatgacgaagacgcgcgcagagaacaagggcgcgacggagcgcagagccgcgccacgacgcagcgacgacccacagacaacgaacaaggagaagggatccgcaggtgacgagacgagaacgacggccgcgagcgtccgtcgccgcaacgagacacagcagcagcacgacgacgagaagacgcgaaggacgagaagcgcaggctgagcgcacaaaactcccagcgacgaccggatgacacgcagaccaggccaacaacagtggacaggacagcgaagaccgagccagaacagacacgagcagacgcacatgagcacacagacgccaccgggagaggcgacgggcacccggcaggcgcaagcggaggcgcgctgcggcgagagggcaaagcagcagcaacgcggggctgccaccgccgcgggcacactgcacgcagcggacgtaggcgcgcgcggcgcaggagacacgacgagagaagcgctccccattcccaagcactcatacaactaataccaaactacccacacaactccatcttactcgtctgtcactaacgtcatcggtgtgacttcacattatctgtaacatcgcatatcaagtcatacctactacaccgccaccacacactcaacacaacgcatcatcagctcatctcttactctcgtcatgtacggaacacacaaatcaacatccgcactaccacccctcaccacgcacgctgcacacgtaagcgttatcttcgtctacaatctaatataa

SEQ ID NO: 481979 - DNA, 740 bp, Homo sapiens
  misc_feature (39)..(39): n is a, c, g, or t
  misc_feature (73)..(73): n is a, c, g, or t
  misc_feature (76)..(76): n is a, c, g, or t
  misc_feature (81)..(81): n is a, c, g, or t
  misc_feature (156)..(156): n is a, c, g, or t
  misc_feature (182)..(182): n is a, c, g, or t
  misc_feature (220)..(220): n is a, c, g, or t
  misc_feature (222)..(222): n is a, c, g, or t
  misc_feature (229)..(229): n is a, c, g, or t
  misc_feature (233)..(233): n is a, c, g, or t
  misc_feature (236)..(236): n is a, c, g, or t
  misc_feature (240)..(240): n is a, c, g, or t
  misc_feature (266)..(266): n is a, c, g, or t
  misc_feature (286)..(286): n is a, c, g, or t
  misc_feature (305)..(305): n is a, c, g, or t
  misc_feature (345)..(345): n is a, c, g, or t
  misc_feature (359)..(359): n is a, c, g, or t
  misc_feature (365)..(365): n is a, c, g, or t
  misc_feature (373)..(373): n is a, c, g, or t
  misc_feature (383)..(383): n is a, c, g, or t
  misc_feature (400)..(400): n is a, c, g, or t
  misc_feature (407)..(407): n is a, c, g, or t
  misc_feature (431)..(431): n is a, c, g, or t
  misc_feature (434)..(434): n is a, c, g, or t
  misc_feature (443)..(443): n is a, c, g, or t
  misc_feature (460)..(460): n is a, c, g, or t
  misc_feature (467)..(467): n is a, c, g, or t
  misc_feature (503)..(503): n is a, c, g, or t
  misc_feature (584)..(584): n is a, c, g, or t
  misc_feature (588)..(588): n is a, c, g, or t
  misc_feature (593)..(593): n is a, c, g, or t
  misc_feature (610)..(611): n is a, c, g, or t
  misc_feature (614)..(616): n is a, c, g, or t
  misc_feature (739)..(739): n is a, c, g, or t
tttggggtcggggggggggggtggatggtactgtttttnaaaactatttacttaaaactgccacacgcaaaanagnaaacnaaggtggtccacaattttttctcctttccttctgagggttttacgatgctttgttatcattaaccagtctttttnctcctttccttaaatggccatttggnacaaacagttctgagaccgttcttccaccactgtttangngtggggnggcnggnattnggggtaatattcatttagccttctgngctttctgggcggacttggngaccttgccagccccagcngccttcttgtcccctgctttgatgcccccccccgcccctntctgtctcctatcncgaacngcaaagcnccccaaaggnggatagtctgacccgcnctcaccncccatgggcttgccaggccccatntcnccaatggcngcctcccccgccttccnggctttngggccatcttccagctttttaccagaccggcgatcnatcttttccttcagctcagcaaacttgcatgccatgtgggccgtgtggcaatccaatcccggggcctagccggcgcttatntggnctggntggttcaggataatcanntgnnnagtgaagccagctgcttccattggtgggtcatttttgctgtcaccagcaacgttgccacgacgaacatccttgacagacacattcttgacattgaagcccacattgtccccaggaagagcttna

SEQ ID NO: 481980 - DNA, 332 bp, Homo sapiens
cgcattccttacgtgtgggctgcatatactgacttccttccaaagagtacagtgtggaaaatagagggagaagagtaactttacagtggagaagactggcaaactacctcagccaggtgaccaaggtcaacatcaacaatgaccagtcatgttgatggtatgtatccttgatatcatgaaaatgggcactgtacctgtgatcctcctctcctaccccataatcccagtctaatgaggaaaaacattaggacaaatacaaattgatggaatatttctacaaaattacctggacccaacattccttcaaagtgttcagggtattcaaaaccggg

SEQ ID NO: 481981 - DNA, 307 bp, Homo sapiens
  misc_feature (79)..(79): n is a, c, g, or t
  misc_feature (131)..(131): n is a, c, g, or t
  misc_feature (140)..(140): n is a, c, g, or t
  misc_feature (181)..(181): n is a, c, g, or t
  misc_feature (297)..(297): n is a, c, g, or t
ccttgtctgtgattgtctgtgttgttgtgcttagatttcaggtatcaggcatgtggtcatgctgtaatccagcacttgngaggttgaggtgggaggatcacttgaggtcaggagtcgagacagcctggcancatgcaaancctgtatctactaaaatacaaaatttagcccggtgtgcggnatgtgcctattatcccagctactcaggaggctgaggcaggagaatggcttgaacctgggaacctgagaggcggaggttgcagtgagggaagatggtgccactgcactccagcctangcgacagagc

SEQ ID NO: 481982 - DNA, 135 bp, Homo sapiens
aaattggtttgttgttcaagcataaaagaagactacacttcaaaacgatagttgtgatttccgctcagctcatgaggcacccacttatcaagctttatccaagtgagcaatttctcactccttgggacggggtac

SEQ ID NO: 481983 - DNA, 480 bp, Homo sapiens
  misc_feature (44)..(44): n is a, c, g, or t
  misc_feature (49)..(49): n is a, c, g, or t
  misc_feature (76)..(76): n is a, c, g, or t
  misc_feature (469)..(469): n is a, c, g, or t
aataaaataattccaccatataatattaaagccatatgtaattngttantttaaagacctttcatttttcctcctncccccactagagccttgaaggacccagacataccttatttgtaattatcctttcctatcctcctaggatggagcatagggcctaacatatttgatggtttgttgaatttgaataatgagaaagtaaagatccaaactgggcctcagagcaggacagaaatggaaatgctactttagatagaaaaaacagtgtttggtttgaggcgggaagctatgatacagccaaggtgcaggcagctagggaaactcagttactcttagcttctaaacatcagttatatggctctgaataatgttggtcaaaagataatcatctcacaactttccaatgaccactagaaagttgaaattttaaagttctaaatgttttctgtaaaagtagtttttgtaatgnacattttttgt

SEQ ID NO: 481984 - DNA, 114 bp, Homo sapiens
tttttccaagggaaaattcccaattgttaaattttttttcctttttacccccttattggaaggctttttttttgttgttttggggggggggattggattttttatttttccgga

SEQ ID NO: 481985 - DNA, 161 bp, Homo sapiens
  misc_feature (85)..(85): n is a, c, g, or t
tcgctctagaggatctcaactacaaaacacagccataagtgcttgtaaccaggaagaacataaaaaagatgtagtgttcgaaaanctgggaatcaaaaactaaccgcggagaaggtaggaggatgttctagaatccccagagaagaagctgggggaaacat

SEQ ID NO: 481986 - DNA, 563 bp, Homo sapiens
  misc_feature (8)..(8): n is a, c, g, or t
  misc_feature (34)..(34): n is a, c, g, or t
  misc_feature (49)..(49): n is a, c, g, or t
  misc_feature (61)..(61): n is a, c, g, or t
  misc_feature (71)..(71): n is a, c, g, or t
  misc_feature (80)..(80): n is a, c, g, or t
  misc_feature (84)..(84): n is a, c, g, or t
  misc_feature (115)..(115): n is a, c, g, or t
  misc_feature (124)..(124): n is a, c, g, or t
  misc_feature (147)..(147): n is a, c, g, or t
  misc_feature (153)..(154): n is a, c, g, or t
  misc_feature (158)..(158): n is a, c, g, or t
  misc_feature (162)..(162): n is a, c, g, or t
  misc_feature (175)..(175): n is a, c, g, or t
  misc_feature (201)..(201): n is a, c, g, or t
  misc_feature (213)..(213): n is a, c, g, or t
  misc_feature (240)..(240): n is a, c, g, or t
  misc_feature (247)..(247): n is a, c, g, or t
  misc_feature (257)..(257): n is a, c, g, or t
  misc_feature (264)..(264): n is a, c, g, or t
  misc_feature (321)..(321): n is a, c, g, or t
  misc_feature (342)..(342): n is a, c, g, or t
  misc_feature (344)..(344): n is a, c, g, or t
  misc_feature (397)..(397): n is a, c, g, or t
  misc_feature (415)..(415): n is a, c, g, or t
  misc_feature (429)..(429): n is a, c, g, or t
  misc_feature (431)..(431): n is a, c, g, or t
  misc_feature (434)..(434): n is a, c, g, or t
  misc_feature (439)..(439): n is a, c, g, or t
  misc_feature (463)..(463): n is a, c, g, or t
  misc_feature (469)..(469): n is a, c, g, or t
  misc_feature (472)..(472): n is a, c, g, or t
  misc_feature (493)..(493): n is a, c, g, or t
  misc_feature (502)..(502): n is a, c, g, or t
  misc_feature (508)..(508): n is a, c, g, or t
tactttanaaactttattgaggacaaaagtgggnggctcccagtcccangggcagaccganaaaaaaaaanggctaaaangaanaagtacggcagggcaggagtggttgtctcancatggaganccctggggggcagcagaaccaantggaannaaanacanggcatcctgccantcgagtaatgtagccacagggttggngcagacccgggnggggcctgagggaggggctcggctggngtaaaangcacactcancgtccanacgagcctcgtggaagcagtggatggcggttaaacacgaattgaggcgctccctcanggctagggttcgaggggccanantgctgaggcctgcctggcctgctgggggtctcaaaaactaggagtgagcaganaggggggctggcacaaancgggtgttgggaananaanatcangctggtggttgctggagcccactnactgcngcngggtggtagactggactctanacttctatnttccanggtgcagggctctgatgcccccagctctaccctagggcagggccctgggggtcca

SEQ ID NO: 481987 - DNA, 177 bp, Homo sapiens
cccactgtaccggtagtgagatcaacaatataaatctaggcaacccaaatcgactgaatggacccttcctgtagagcaaggacataccaaagtaaactgaaaagaacagcctggccagtatggtgaagccatgtctctactaaaaatacaaaattggccgggccgaccgcgatcacg

SEQ ID NO: 481988 - DNA, 165 bp, Homo sapiens
  misc_feature (121)..(121): n is a, c, g, or t
tacacatgcaaccatgcggcgctcattttaagttatttgtagagacagggtattgctgtgttgcccagctggtcttgaacacctaggcgcaagtaatcttcccatcttttttggttgggcntttttatatcttaggcaatgaatttctattgcttttctttttag

SEQ ID NO: 481989 - DNA, 153 bp, Homo sapiens
tctgggctctctgccttctatgtgggaatgaggatcttcccaacagactctccctcttccaaaagtatgtgtatcagtatgctccttctgggcatttagagatggacagaacagggtgtgcgatctatgctgtgagaactcccagccggaatt

SEQ ID NO: 481990 - DNA, 318 bp, Homo sapiens
gtcgacatccagcgctcatagcattcgcgcaggttgcccacgaaggcctttttgtcggtctgggagtcgtgaatcagacagcacaactcacccagttcactctgttgcaggcgatggaacaccacatccagtgccgcgcgcttttcgcacacgaacagcacccgcaggccgcgaccggcatagtcagcgatcaggttggtgatggtctgggacttgccggtacccgcggcccctgaatgatgaaattgcgcccggtaccgacaggctgacggcggcattctgcgtcgcatcgccggccaccacgttccattgttccgg

SEQ ID NO: 481991 - DNA, 1439 bp, Homo sapiens
ctcttgcttcttaggcggaccgaggacgccatggccgagtgcccgacactcggtggaggcagatcacctgaccacccgtgaccgccatgtgggcctggtgagaatgttcgatgtatataggacagagaagcagccacgccatggctgccctataaccatcgagtataaaggataggttacatgttacagggtgcacttgcagtcgaggaagacgtcgtcctggggcaggcctatgaacacccacaccagataggccacaaagcctgctgacctatcatgtgtgcagctctaccctgatggacgaataacgatcctacagactaccagctattctggcgcattagtgataccaccgtcaacgacttgacggcagatggacaggacaatgactacatcgagacatgcatgcccacgactgactgagtgatcatatgggcacgaaccatgatctacctatatcagaccaaccacaaggggcacttggaagacccaatgagacacacgccataaccacaatatggggactgttctagatagtatgtcaatggtaacaacccatatcgtgctatcaacatacatgcccatggatggtccatatactctgcaaaaccacaccgaccagggtcagtcctgggagctggaaacaatgggcaccaagagaaaaagaagggaactgcagcaaataaaaccgaaagcgagaccctagcaacagcagacctggacaagggacgctcaagcaacatcaatgcacacggaccaaacagacacgaaacgccaccacccatgaccacagggagagcaaatacacacaaacgagccagcaacgtcagaaaacacagggctgccccacaggcgtaaaataccctgtgtacacctcagactaatcaataaatgactgtgcactgattgcggccataccacgaacacagtaatgtatgacaccgatgctagtatccgatctacagtaaacttagcagatgtaacagtggtgttgatagtccctaacctcattatgacggcggaacattctagaaagaacacgcgtcagcagttaacatcgtaagaagagacaatcttaaagcatcctcgtgcacctgctggagtatgacagtggtggatcacgcctgcaagttatgacacagactgtcaaagaatctacgtcggagaaacaagactggtacagggatcactccatggacaacatccctcaatcgtcagaccacgagacagtcagagcgagaagcaccaacggaccatggtactgcgcaaccaagagacgaagaaacaacggaacgagagcgagcactgctgaccaccctgccgcaggaaggcagcaacagccgcagagccaagcggagagcccaaggaagaccctcgcctgccagaccagtgaggcacacaccacaccagcaaagaagcgagcaacaaccaaacgcagc

SEQ ID NO: 481992 - DNA, 116 bp, Homo sapiens
ctctaaaatatgattagatctgtggctgtgaatgttataattcaggagatatgtagggagattagtatagagaggtagagtatataacgtgatagtggtacactacgttatgtgcg

SEQ ID NO: 481993 - DNA, 86 bp, Homo sapiens
ggatttgctggtgcagtacaactaggcttaatagggactcgaattgagctcgaattcgagcctcgaactcgaattaagcttctaac

SEQ ID NO: 481994 - DNA, 363 bp, Homo sapiens
  misc_feature (8)..(8): n is a, c, g, or t
tggcgtanaagagactctcaccacagtcatgactctgaagacttctggacccccagatatcagctcaagaccctttgggctgtgacgcacgagactcgacagcacagagaaagtgaccaagcccctgcctcaaccatgggactgcactgcatgcacgggaagggctcacctctccctcagacttcacgcccaccaacttgccgttctccatgatgatgtcatccacaggtatgtacagtatatatgtacccccatagatggcactcaatctgtggtgagagcagctccggtgaaggcccctcccaggagaaacgtgcaccaattccactgcacccttcctccaccaaagtgcaaagaaggctg

SEQ ID NO: 481995 - DNA, 91 bp, Homo sapiens
gagaagacgacagaagggaagacaaaaagaaatgaactgaggaagaaagaatggaagacaatttaaagttgtttcattaattaccatatct

SEQ ID NO: 481996 - DNA, 209 bp, Homo sapiens
tatgatgacactcgttctggcaactaggtagtgcttttattccaaggaactatacgctccataggtaagatcccatccgtctgtgttggacatctcacccccagtgctaacactgagtgtctgaacagaatagatacttaataaatgtgtatgatgtacaccatgcaggggatggcagaagcacatgggcagaggaataagaagaacat

SEQ ID NO: 481997 - DNA, 210 bp, Homo sapiens
  misc_feature (118)..(118): n is a, c, g, or t
gctagatctctccctggggagagtgcttggtctttgaaacagtcaaaggaggaaggaagaaaagagaggcagaacaattataataaagcaacttaacccattgagagacataaggatncttcaaggcgcagttcttgattgagaggacaattccttgggccaagttattggaagactttttagggagggtgacttttttaagggggtttt

SEQ ID NO: 481998 - DNA, 263 bp, Homo sapiens
ctttgacatttgatcagaccaaacagtgctgtttcccggggaggaaacacattttaataaacacatcatcccgcaggctcccacctttacctcatgtttcataccttgtttatcaaatgagcgactcaaaatgattaaaaataatgctgttctttagtagcaactaaaatgtgtcttaccgtcatttatatctttgtcaccggaaagaagcatttttgatactttactgcgagtcaaaaatcaatacgcagaatggcatttga

SEQ ID NO: 481999 - DNA, 1976 bp, Homo sapiens
  misc_feature (362)..(362): n is a, c, g, or t
  misc_feature (469)..(469): n is a, c, g, or t
  misc_feature (1976)..(1976): n is a, c, g, or t
gcggcaactcaggggcgagccgcggcaacaagacgagacgcggcgtggcagctctcacgggccacgcagcctcttcaagttgactgcagtccatcacccacggtcattattaatttgttcttcctggcctaaggtcagctgattagcaaccttagttagtctgcagtctccattctctttttgctgaatcacgtcaagtattcacaagttccagggggcaggaggtggacatctttgggggacattattccgccaccagaaaacccaggagcagccacagcccaagacgaggcagggaaggagtgctgctgtctgccggtgaagatgaactgcttctgaccctcccgagcgagatattgagnagaaagaatttgccaagatgctagtcacacaccaagtacagaggctatgttggtcggctgcggcaaaaagaccactcgcggcgtggcagctctcactggccctgctncctcttcaagttgactgcagtccatcacccacggtcattattaatttgtttttgcaaaggccaggcaggtgaatctaatggagatggaaaccaccacacctgcttccctggtctctgatgttggtgttaacctctgcaattcctcaagcaaagcactccttctatcaggctcactgtcttgctggagggaggaagttccacaggctctcacttggttctttctgccgtaacaacccttactcctccggccaaggagccaatgtgagcattcagctggcagctaagaatgtgtatcccaataaacagggcagacctacagacccactggacccactagagatggacttgggccacagtgccttccatgacttcagtaaacagaggggtgtggtgatcttgtcaaagtcctggcgtcaatgtcagtgtccggctacacaccatgttcccgtcctcgaaaagcctctctgtacccctctatgttggtgacacaaccctggcaaatggccacagactcctttggggacagagtaggagcgtaactggtgggagtggttggcatgctttgtattgggagagccgcacgccctagggcttccagcctcctcttcagtttggcagctgtgagtctgaatttcactcaaatctggaaactgggtgagagactgtggcagctgctgtccggctggcagagcctgacgtgtctctgatcatactcactgggtcagcaacaccctactgaccttgtccagaatcccacatcccagttgatatcagggcaatcagtttcctggctgttttccccaatatcaacccgggcttacagaagacagtcaccacagagctcctgccaggagttcactcattcgtgcatttcttccttttttttttcttttggagatggagtctcgctctgtcgcccaggctgagtgcagtggagcgatctcggctcatggcaacctccgcctccgtgggttcaagcgattctctgtgcctcagcctcccaggtagctgggatagcaggtgtgtgccaccacgcccagctaattttgtattttagtagagatggggtttcatcatgttgcccaggctggtctcaaattcctgacctcaggtgatctgccctcagcctcccaaagtgctgggattacaggcttcagccaccaacccagcctcattcatacatttcttatggtcgtgtttgagacagggtctttctctgtcacccaggatgggtgcagtgtggtgatcatgcctcagtgcagcgatcatggctcagtgcagcctcaaactctgtgggctcaaagcaagtgttccaaactcagactcctgagtagctaggactataggcccacagaccattgcccggtaaattttattttgacaaaaggggcccacttgttgcccagtatcttgatctgggccaagaaactccccctctgggccccaggcgtgggtaaaggggggcaccgaccggcctggggaacaaggggccaccacaatataaatn

SEQ ID NO: 482000 - DNA, 425 bp, Homo sapiens
tatggcggagattgtgcacaggatggagagtatggggccaaggatatatccgaagggatggctgcaacactgagttgagaagtgcggaggtctgcatcaccaaaggtgtaggagcaatcctgcctgctggagctgtgagtaaagggccctggaccaggcccgttgttcccactttctgtggttaaggggcgcatcgagtggcgaaggagagagcccagtgaactaaacagccctttagaaagttcgctttgcttcctgctggcgctctttctagcactaactttggtatgcatttaatctgtaaaattagtactatcaccttacgttggagtagcactttacagtttgactctagatgctcttttcattccatcctgctacctactcacatcaagtgcttttccccttgaccaacggtatgccaa

SEQ ID NO: 482001 - DNA, 275 bp, Homo sapiens
aatggaatctcgctctgttgcccaggctcaaaaagaaaaaataaaggcctgcttaacaaatgaaatgcatatggtgtctggaatgcgcttgaaagtaaaggagagtgggcgtgaggtcttataaaaaaacaaaataggccctgagttgatcattgttaaactggatagaggccattcattatgatgaaggggctcattatactatactgcacttctgtgtactgaagatttcctgaactaaaaagagtcaaagtacatgccttaaacttgaggat

SEQ ID NO: 482002 - DNA, 1338 bp, Homo sapiens
  misc_feature (67)..(67): n is a, c, g, or t
cagaatagtaagtaccacagtgccacacaagcagagacacacagtggggtaggagtgtgtgtgtttnccactaggtatatcgctgattctcttagtaattagattgtatgtgtgcttctagctagtggcttggttgtgctacacacatgctgtgttgaagtggtgtatgatcctctcgctttgttgtttgtgtataatgaaagacacacttgtagtgttgtgtttggttggtttgcgatatgctgctgtgtgataagcatcttcgtcctcctatgtttagtgtgtgacctgtcgctctctccctcctctgctccggtagttatatgtcttggtgtgctctctacgcaactagctggttgactaactgttgtggggcgacccgaccagtaggtctctgctgtgtgtccgcccctcggtcgtaggttgttgataattatctcctgtgttgggggcgtcagctctctccccccccgctgttgttctcttttgtcaggagatgttgtctatatgagacggctgtcttctttctgcaaaaataattgatgcggtggcgcgcgccgcccgttgcccgagagtaccatctaatgtggttcttctccctgtggggtcccccaaaaaaccgcccccgagaagaatttcttcccccaaagaagtttgttgggaaaaaatacacctcgccccaaaacaaagttttgtgcccataaatagcttttcccctagagcctctcatttaacaaattggaaagtatgcttataatttctctgaacataatctctctctcccctccgagaaacctctctcgcaaatttaaagccctctgtttaatagccacaagaggttctctcacagaggttcccccccttctctttcatagcgcgcgcgtcgcttgccccgcgagggggtccacatatgttcacctcggcgggtgtactccacccgcgtaaggttagttgctacatgtgtgcccatgtgagagatatacaccacgcactccgcacgtttatgtttctgtggtcaccacacttctctgatctatgatgtccccatcttactccgtgagagagatattataagtagtccacggtgggactccttctcttgtgtgaccacacactcagggccccttgcgcccacagaatgtggtcccacacaaccaccccctcttttagacccggtgagttttcttaggagctctcttccctcttgaggcgccacatgggaagaggatggccctctctctacccgcacccgcgctcgtcctccgtaggaggcccacacacacgtctcatcccacgagttctatagcgttctctcggtctaatacaaagaacaaacaa

SEQ ID NO: 482003 - DNA, 106 bp, Homo sapiens
  misc_feature (45)..(45): n is a, c, g, or t
  misc_feature (86)..(86): n is a, c, g, or t
  misc_feature (90)..(90): n is a, c, g, or t
ctagaggatccaggacaggcagacggcggcagactagtggagcanagttgctgggggaacaccacgccactcgttggagcctcgcngggnggctcaactggagccc

SEQ ID NO: 482004 - DNA, 305 bp, Homo sapiens
tcgaccagctactgcgggagagctgaggccaggagaaagtgctgtgaacccggggtggcagaggttgcagtgagctttgcagtgagccaagatcgcgccactgtactctagccttgctgacagagcgagactccgtctcaaacaaaaattttaggccgggagcagtggctcacacctgtaatcccagcactttgggaggccgaggcgggcggatcacaaggtcaggagttcgagactagtctggccaacatggtgaaaccccgtctctactaaaaatacaaaaattagccaggtgtggtggtggg

SEQ ID NO: 482005 - DNA, 329 bp, Homo sapiens
cctataatgaaatgaatgcttgcttttgccccctctccaattcatgtgttgaagccctcgtctccatgtgatggtaattggtgatggggcctttggaagatgatgaggtttgggtgaggtcatgagggttgacccaccatgatgggattaaggcccttatgagaagaggccagaacttggttatcctcttccaatgtgaggacacagcaagaaggtggctgtctgcaagctagctagagagccctcaccagacatttaatctgccagcatcttgatcttggacatctagcctccagactgtaaacaataaatgtctattattgaagcta

SEQ ID NO: 482006 - DNA, 275 bp, Homo sapiens
ataatcagccgagtaccggttcgccatgtttcccacttcgtggtgtccgttttacttagcagatactggaaccgttactttaagacgtgttttccaattcagaagttgctctacgttagagtatgatggacttttatgtctgtaacacccccgacagacactttaatgtatggcacagtgacaatgtgaatggttgagtaatgtatacgagaaatttctatgtccatttgtggacttccaagtgactaagtagaccccaagaatatgtaatacaa

SEQ ID NO: 482007 - DNA, 380 bp, Homo sapiens
  misc_feature (56)..(56): n is a, c, g, or t
cgggccatggttaaactttggggaaaggctggggctttgggctttatatcacctgntttgccccgccccgcctgggggccccccccccttgttgtgtttcccccgcaatttcaaggataagccttcctgcggggccctgggccgctctccccaccctgttttgagccaaaacaaacatgagccccctgcttggaacaaccaactgttctggttgctggtcaaagggaggggaggcttttcaaacaggtgtgggttcccccgtgggcccaaagtggccccctgggcatattcccctgggtattcctttgtgccccaggagcgattatagtgacccccgttttctgcaaaggctgttaaagtaaaggcgttgggaggtggga

SEQ ID NO: 482008 - DNA, 617 bp, Homo sapiens
  misc_feature (77)..(77): n is a, c, g, or t
  misc_feature (83)..(83): n is a, c, g, or t
  misc_feature (92)..(92): n is a, c, g, or t
  misc_feature (99)..(99): n is a, c, g, or t
  misc_feature (101)..(101): n is a, c, g, or t
  misc_feature (107)..(107): n is a, c, g, or t
  misc_feature (117)..(117): n is a, c, g, or t
  misc_feature (119)..(119): n is a, c, g, or t
  misc_feature (130)..(130): n is a, c, g, or t
  misc_feature (136)..(136): n is a, c, g, or t
  misc_feature (138)..(138): n is a, c, g, or t
  misc_feature (147)..(147): n is a, c, g, or t
  misc_feature (156)..(156): n is a, c, g, or t
  misc_feature (158)..(158): n is a, c, g, or t
  misc_feature (166)..(167): n is a, c, g, or t
  misc_feature (184)..(184): n is a, c, g, or t
  misc_feature (190)..(190): n is a, c, g, or t
  misc_feature (198)..(198): n is a, c, g, or t
  misc_feature (200)..(200): n is a, c, g, or t
  misc_feature (202)..(202): n is a, c, g, or t
  misc_feature (205)..(205): n is a, c, g, or t
  misc_feature (212)..(212): n is a, c, g, or t
  misc_feature (214)..(214): n is a, c, g, or t
  misc_feature (287)..(287): n is a, c, g, or t
  misc_feature (290)..(290): n is a, c, g, or t
  misc_feature (293)..(293): n is a, c, g, or t
  misc_feature (296)..(296): n is a, c, g, or t
  misc_feature (301)..(301): n is a, c, g, or t
  misc_feature (317)..(317): n is a, c, g, or t
  misc_feature (321)..(321): n is a, c, g, or t
  misc_feature (325)..(325): n is a, c, g, or t
  misc_feature (331)..(331): n is a, c, g, or t
  misc_feature (337)..(337): n is a, c, g, or t
  misc_feature (342)..(342): n is a, c, g, or t
  misc_feature (356)..(356): n is a, c, g, or t
  misc_feature (361)..(361): n is a, c, g, or t
  misc_feature (365)..(365): n is a, c, g, or t
  misc_feature (378)..(378): n is a, c, g, or t
  misc_feature (384)..(384): n is a, c, g, or t
  misc_feature (388)..(388): n is a, c, g, or t
  misc_feature (420)..(420): n is a, c, g, or t
  misc_feature (466)..(466): n is a, c, g, or t
  misc_feature (474)..(474): n is a, c, g, or t
cggaaattcggccattatggccgggggccagaccggggggccgtaccggaggcaggttgaagccgttgccgtggccntgaccnggggtaacnagcgtgngntggccngccagaggantntgaaaaggcanagcgantnggttaaggnaaagcgccnanatgacggnntttttgttgccgcccgnaggcanagggactngnanatnatgcagnanaagcagaaaagggcaaccgagaagaaggaggaccccaggtagcttgggggtttcgggtccaaccttttggccnttngcntgngtgcntgaagccagtccaacnaggntggngtttcntcctgnagggntaacaggtccaagnaccgntggnattcctttggccntgagtntgancgggtccctttggggcttccttcccttaaggnagcctttttccccttgggccattcccggggttaagggggttacccnttccaagngtttttaattcctgtggggctaaccccaaggttttaaaggtagctttgtaaaaaaaaaagatttataattaaatgttcccacagccctggtgattcccttcaccttggaaggattggggtcacaattcagttcccccactttc

SEQ ID NO: 482009 - DNA, 563 bp, Homo sapiens
  misc_feature (77)..(77): n is a, c, g, or t
  misc_feature (83)..(83): n is a, c, g, or t
  misc_feature (92)..(92): n is a, c, g, or t
  misc_feature (99)..(99): n is a, c, g, or t
  misc_feature (101)..(101): n is a, c, g, or t
  misc_feature (107)..(107): n is a, c, g, or t
  misc_feature (117)..(117): n is a, c, g, or t
  misc_feature (119)..(119): n is a, c, g, or t
  misc_feature (130)..(130): n is a, c, g, or t
  misc_feature (136)..(136): n is a, c, g, or t
  misc_feature (138)..(138): n is a, c, g, or t
  misc_feature (147)..(147): n is a, c, g, or t
  misc_feature (156)..(156): n is a, c, g, or t
  misc_feature (158)..(158): n is a, c, g, or t
  misc_feature (166)..(167): n is a, c, g, or t
  misc_feature (184)..(184): n is a, c, g, or t
  misc_feature (190)..(190): n is a, c, g, or t
  misc_feature (198)..(198): n is a, c, g, or t
  misc_feature (200)..(200): n is a, c, g, or t
  misc_feature (202)..(202): n is a, c, g, or t
  misc_feature (205)..(205): n is a, c, g, or t
  misc_feature (212)..(212): n is a, c, g, or t
  misc_feature (214)..(214): n is a, c, g, or t
  misc_feature (233)..(233): n is a, c, g, or t
  misc_feature (236)..(236): n is a, c, g, or t
  misc_feature (239)..(239): n is a, c, g, or t
  misc_feature (242)..(242): n is a, c, g, or t
  misc_feature (247)..(247): n is a, c, g, or t
  misc_feature (263)..(263): n is a, c, g, or t
  misc_feature (267)..(267): n is a, c, g, or t
  misc_feature (271)..(271): n is a, c, g, or t
  misc_feature (277)..(277): n is a, c, g, or t
  misc_feature (283)..(283): n is a, c, g, or t
  misc_feature (288)..(288): n is a, c, g, or t
  misc_feature (302)..(302): n is a, c, g, or t
  misc_feature (307)..(307): n is a, c, g, or t
  misc_feature (311)..(311): n is a, c, g, or t
  misc_feature (324)..(324): n is a, c, g, or t
  misc_feature (330)..(330): n is a, c, g, or t
  misc_feature (334)..(334): n is a, c, g, or t
  misc_feature (366)..(366): n is a, c, g, or t
  misc_feature (412)..(412): n is a, c, g, or t
  misc_feature (420)..(420): n is a, c, g, or t
cggaaattcggccattatggccgggggccagaccggggggccgtaccggaggcaggttgaagccgttgccgtggccntgaccnggggtaacnagcgtgngntggccngccagaggantntgaaaaggcanagcgantnggttaaggnaaagcgccnanatgacggnntttttgttgccgcccgnaggcanagggactngnanatnatgcagnanaagcagaaccttttggccnttngcntgngtgcntgaagccagtccaacnaggntggngtttcntcctgnagggntaacaggtccaagnaccgntggnattcctttggccntgagtntgancgggtccctttggggcttccttcccttaaggnagcctttttccccttgggccattcccggggttaagggggttacccnttccaagngtttttaattcctgtggggctaaccccaaggttttaaaggtagctttgtaaaaaaaaaagatttataattaaatgttcccacagccctggtgattcccttcaccttggaaggattggggtcacaattcagttcccccactttc

SEQ ID NO: 482010 - DNA, 121 bp, Homo sapiens
cccggtgcggggtcctgtggccccgttggcaccgttgggccgtttaagtcgggggcggccactggggcccggcccgtaagccggggccccagtgaatccctggtgtttttggcacgtctcc

SEQ ID NO: 482011 - DNA, 448 bp, Homo sapiens
  misc_feature (67)..(67): n is a, c, g, or t
  misc_feature (70)..(70): n is a, c, g, or t
  misc_feature (74)..(75): n is a, c, g, or t
  misc_feature (97)..(97): n is a, c, g, or t
  misc_feature (120)..(120): n is a, c, g, or t
  misc_feature (130)..(130): n is a, c, g, or t
  misc_feature (159)..(160): n is a, c, g, or t
  misc_feature (177)..(177): n is a, c, g, or t
  misc_feature (214)..(214): n is a, c, g, or t
caccgcactagccacccctcccagactgtggacgggaggatggagtcgatggccgtcgctaccgacnggngcgnncaggccgggggtcccagcggcntcaggtctgtcggcttcccagcntcgggcggantgcgtcggagaaagctgctcatgaactcnngctagcgcatcaaccgnatcatgggctttcacaggcccgggagcggctaagggncatgatttgctccatttcttactttacaacttgcgtacatgggattatacaaatattttcccaagagtgaaaagaagataaagacaacagtactaacagctgcacttctattgtccgggaattccctgcccgaagtgataaatccgatcaatggataccttatagcaaaatgggcgaagtcttcacagatctctgtgtctactttttccacttttatccttttgtcatgaactg

SEQ ID NO: 482012 - DNA, 711 bp, Homo sapiens
  misc_feature (212)..(212): n is a, c, g, or t
  misc_feature (404)..(404): n is a, c, g, or t
tttcgagtcgttttggttcgcggttgccggggccccctcccctttttttcccctcaaaaacccgggcccgcccgcctccggttcttgcttagccccgggggggttccattttccccgggcacgctttctcctctgggcctttttgggtgcccatttatccaagttgttcaaaaacggcgtggggtcggtccggattttccgggtttgtctgnccccgggtgccggcggaccaagcccaattaaggcaaaccgggtttcccccccccccccctccggggggggtggttctccgcgatttttagatccacatttttaacccccggtcccgtttgggggttttccccccggggggggggttggcgttgggattaaaaagtttccccgggatttttgggagacccctncccccccttccccccttttttggggggggtggggcccccccaggggaatttttggttccggcccagggggttttaaaaaccccccgggggttaaaaaaaccccccggccccggggcccccccttttttttttggggggggggggggtttccccccccccccctttttttttttaaagaccccccaggggggccaagggtttttttggtttcccccccccccgggggttccgggggcccccttttggggttaattttttttcccataccttccctttttttgggttttccccccccggggggggttta

SEQ ID NO: 482013 - DNA, 466 bp, Homo sapiens
aagtacaaaggccaaaagggctggtttctccaaaatggaaccccttccaaaacagtctcccaccgacccctataaagtggaagggtttccccccattttttttgcccccaatgggggcaaaaaaaaccccgtttaattttagggtggggaccaaaattttgggccttttagccagtttttaaaaaaaccttcccccaaacttagccgggcccaagaaaaacttttaaagccttaggttttccgaaagttggaagaagccaacccccctcgtggccccttgttggggggttcccccccaggcccgccaccaaaaacaggatttcggaatccctttttttttttttaaatttttaaaccttgggggttcccctcctgcctttaaaacttaaaaacccctaaaggcttaaaaattttgtccccattttttccaaggaaacctttttttttttcctttttttgggtttta

SEQ ID NO: 482014 - DNA, 517 bp, Homo sapiens
gctgcaatatagcaggctgaagagtctgagaggagaggccttttaggtaggagggaaaccagagcatgtattgccaaaggaagaagaaagtgtccatcctggctaacacagtgaaaacccgtctctagtaaaaaggcaaaaaaaaattagctgggcgtggtggcagacgccgagagtcccagatactcaggaggctgaggcaggagaatgtcgtgaacccgggaggcagtgctcgagatcgcgccactgcactccagcctgggcgaaagagcaagactccgcctcaaaaaaaaagaagaaaaaggtgcctcaagcaaaagggtgtgggctggggcgatgctcatgcctgtaatccttacactgtgcgaggccaaggccagcagatcgcttgaggccagtagtttgagactagcctgaccaacatggcaaaacctcatgtttactataaatataaaaattagctaggcatggtggtgtgcacctgtaatcccacctactctggaggctgagacaggag

SEQ ID NO: 482015 - DNA, 235 bp, Homo sapiens
agatataactgaagctttatctggactgggggaatgggggtgtaaaaacacaaaccccaaaacccctatttaaaactactccaactaactggatggggctcactccatcccatcccaccccccatctttctatatatacccaactcgaaccctatcaaacacccagcattcacatacactttgtcctttctttttaacatcactaaacacattagaacatccctgaacttctctc

SEQ ID NO: 482016 - DNA, 474 bp, Homo sapiens
gccaaacccactggagcgcactaccatgccgtcttaggcactgcaggtaccctcattaagcgtcagcgattgacatcggaagctggcgcactagacgtagttcctcatgtcttatgaatagcgaagtacctaggaagatcatggcaaggtgagccatggctgagaagcaggtgcccagacaggctaccgaggagcagctgatagagcacaccccgatgtggatcatactagtgttcgggtctacagatagagccgacaaacctaccgagactgcgatcgctggatgtccaagttagaatcactacacgaacctaagtgtgcccacagagccttgtaactcacctcggcatctaactgctagtccaaagaggcacagctcattgtgctctactgagaactcgtgtacagagcgtctaagagtcatcatcgatagcacgcgctaatgcaatcgccaatttaggtgattaagatgcc

SEQ ID NO: 482017 - DNA, 236 bp, Homo sapiens
ccagttacacagctccattacaacagctcatctaataaattaaaaaataaactgataagtgatccttgtttggtggacacttcagagcaagatgttccttggcagggatatactgacctggtttagctttggccctgtgcatgctcaggctttcaggtattctttgaggttggattcaaatggatataaattctcagaacgaactacatcaaaatagtcatagctgtcgtaactgg

SEQ ID NO: 482018 - DNA, 363 bp, Homo sapiens
gtgggcgctgcagtctctggggggctttctaaacctatgacaggacaggctggacttgcttcagaaccttctatgacagacacgggcactaaatgtgaaaaaccaataagctggtgactcatgaatacacacgaggaaaagcagaggtttattttatctgccttttcaaccacatttttccctctgatgaaggattggtcagatgtctttgagaagtgttaaactaattcacatggtagtgtagggccaacatacaagctaccagtctaatgtgtatagtagactttgggaaaagcgattttttctcatgtattcattctgaatagttgaaatgtatatttgtacagtcttttagacctattc

SEQ ID NO: 482019 - DNA, 124 bp, Homo sapiens
catcttgctcccatcagtccatcaaaccagctcattgtgtacacgtcgttagactgctgttcttaataaccaacaagagtcaatgtatagaaatccctgatgggagaagactgcggggtaccga

SEQ ID NO: 482020 - DNA, 574 bp, Homo sapiens
aatgatagaagatagtagatgcaaaatatgccatattattaaaaaaaaactatgaaaaataaaaaaagcactcccaataccccatatccataggtattaacacgctagatatatactggtggctgtgtactgtatagtgtgtgtatttcaacacaggtatatgtacatttttttacggcacttcagaccttatctcacataaacattatcgtcaatagacatccagtattttaagaagaaaaagtctgtgtgaagtttccagtacttgagatcagagattgaagtatgtctcttctatgtttttcctggatcttgcatgaccttgcatgtgcactatgcaattacagcatctcacactccccggatattcccacattttcaggtgccagattcaaagacaggtgaagtttcagatttatctcacttcctcacagttgattgtggtcagtcgtccatgcaccaccacttccatcttccctgtattatcttgtatttcataataagtgaattcaccccttacatttttcttatgtacctcaaacaccccattcacaaaacttcctttagtttgtga

SEQ ID NO: 482021 - DNA, 193 bp, Homo sapiens
ccatgtttggccagacgtgtcgcggcctgtatggcgcgtacagcgtcagccggcgtatcttctacgtgcagagcgttccggcgattgcggcgacgttgccgtgctcgtggcaccctgactagcgcgccggcttcgccgatacccacatcgatatcgtcgccttgaacaccgcctcgccctgcgggtttgctca

SEQ ID NO: 482022 - DNA, 128 bp, Homo sapiens
tgtttatcgactgccacctcagctcacaagcagcctcacaggcgctcactaccatgcccaactaattttgtattcttttttttatagagacgaggtttcaccatgttgcctaggctggtctggaactc

SEQ ID NO: 482023 - DNA, 124 bp, Homo sapiens
gatgtagtgtgaacagtgacggtctgacaccgtgtctcactctagcaacagtgcagacaacgctaaaccaagcatacacgggtcatgccaccagggtgtgtcatcgtcaccactggctcgggga

SEQ ID NO: 482024 - DNA, 234 bp, Homo sapiens
tcccttttcttcttcacctctcctcctcccgattctcctctaatacatcatccgaaaaccgtgacctcctccgagccgccagaaatccacgacgagaagatcatgattgcaacgatgcgaaagtttccaccgaacagcatccttccaccaagtaacattagactcccaccccacatcaggcaccaggaggccccctttaacacaatcccactagaaatcccctccctccgccta

SEQ ID NO: 482025 - DNA, 161 bp, Homo sapiens
  misc_feature (46)..(46): n is a, c, g, or t
gcactcaactgctactctaggaaaaagcagcctcgaggctggtggntttcagagcaggaggccgacgttttctccagcaaagaaagagcccaccacttgcaggggacaggaggaacgaacggagaccgggcccgagacacaaaaaaaagctgctggccctg

SEQ ID NO: 482026 - DNA, 1295 bp, Homo sapiens
  misc_feature (304)..(304): n is a, c, g, or t
  misc_feature (414)..(414): n is a, c, g, or t
  misc_feature (487)..(487): n is a, c, g, or t
  misc_feature (948)..(948): n is a, c, g, or t
cagggacccctttcttgtgagggggcgcccaacgagaattttccccccccacaggggttctaacacacacacgcggatttgtgatagaattgtgcgttgcgccgccctgttggagtggcgcccccctttatagaaatatgggttggcggccaacccacgaggggttcccatacgagcccctctcctgtataagggggcggcgtcctggggggggcccacatttttggcgggttttgggggcccacaacagaaatttttggggggggagactcaatatgtgcgaacgcccctcccccactccttntggcccccccactttccaaagagggcttgcgccgcccttgccaccacacgtgatctgcgcttatagagccacaccgtgttcttgtcccacgagcctctccgctcgctgtnctgcggtgttcccctcgagagagtcccccatcagggggcaccacactgtgcgccactgctcacacttggcccntctcatagagagtctctactgtcacgactcagtgtgggtgttctcgggagagagtgtggttgttgacacagcgggcccccttcggcagagagtgacccgcgcctctgtgtgggcaaccaacagcgccctcgggggcgccccaccacaggagacacacacacctcgcgagagcccccccccgtcggtagactcccctacacaccatcgccacagctgtctctcgggcgcccctcgcgagagagatttgagagggacacagaggtttgtggtctattactctgcgtgggccacacactcggggtctagagagctctcgcgcgcggtttgttgggtgtgatagtctctgagagggcacagagagagagtagagagacacacactcgcgtctatacactcgagaggggggacacactcgcgggggcgtctctatactcgagaggcgctctctctcccactcgggngggtctctctaatactctcaataagtgggcacacacacacctctttatatagagagagtggggtgcacagcctccccctcctccacccacactcttcctcttccctcgttccctcggaattttcaagggaactttggtgggccttccccttgagccctaatgtaagctgctatatataaagttaaagtgtgccctcacggcacagggaagagagggctcacacacagaagtttccttctgtaacgtggccacaggccagacacccccgtcccttcacccccaccctgctccccaaccgcccccccccatttgggtggctgtttttaaaaagtaaagtttttagagga

SEQ ID NO: 482027 - DNA, 509 bp, Homo sapiens
  misc_feature (24)..(24): n is a, c, g, or t
agaggatccccaatgaaacatggnctctagggcaagcaacatggtgtagtatagaaaacactggcctggaaatcaggtgacttggaatcaccattgagttgtacggtcccttcacttctctgggccttggttttgtcagcaataaagggtggggattagactggaagatctttaatattcagctttaatactctgattgtatgagttttaagcttcatattggactgatatgacttttgtggctgtaatgaaatccagaaaagagagcttataccactgtgtttgtagattagtagtagcttgaatactattaatgcttcccaaaaaaaaatcacttttttactcaattacttttttttttcctggaatgtcttttttccttctctacttacaaagcctcactttacccacttataattgacacttgaatggcattgttcttgtgctttgatttaggttttcatattgatttttctcctgcctcctctccctgtttcatttttcattgt

SEQ ID NO: 482028 - DNA, 601 bp, Homo sapiens
ctctataggatcccctgatgcgatgtgcgcgatgtgcagagccctgcaacgtgagcacgctaaaggcttacttcagatgctgatggctacaggggctactgagctggtcgacatgccccctagagcggtttcacctgcgtgtccccgtgcagtagggtgctactgtgaacatggaggtgcagtgcgagcatctgcccatgtggggcccgctgcagctgtgtgtccttctccatctacagtgcctggggcgagcattgtgagcatctgatcgtgagattcgatggcgttcttcggcatcttctttggggtcctgggcggcctcttgctgctgggggtcgggacgttcgtggtcctgcgcttctggggtttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatccagacaagactataccttatccataggcgcaggtgca

SEQ ID NO: 482029 - DNA, 315 bp, Homo sapiens
  misc_feature (25)..(25): n is a, c, g, or t
taatagcgacgcaatatacatagtntcctctcatgctcaggttctccacaaatgaagactataaacaaggtttttttaaactgtattttagtgacagaaacctatgtgctcttgaataaaaataaagagctgttatcaccatgctactgtcacaacatttgctgtttgtaactgcttttctttcaaaagtctaaaaacttttttctatatgttgtgtttatactcatgtatctcacagaactgagggaagggacccattaatcaagacctttcttttaaatatgtgtaatatttacatatacatacacgcgtcgg

SEQ ID NO: 482030 - DNA, 182 bp, Homo sapiens
agaatcacagccctgccgaggttcaaagcccacgggttctcactaacgcttgaggcagggccaatcaataccctaagcttcaaactcatgctgtgtaaggaaacctgtaagaactgacacctctgggttgcaatgagccgaggtcacgccactgcactccagcctaggatacagtagggaga

SEQ ID NO: 482031 - DNA, 212 bp, Homo sapiens
gtgggactatacttttgatgagattgtcacattgtcgacagatgggcacgatccttaaccaaaatctctggaacattaagagatctggggactgccagtcagtgggctgtaatgttgatggccgccatctcatgacatcatcgatgacatcaaccagtggtgctgtggaattgcccagccagttaagtcccaaggaaacacatttcaataaa

SEQ ID NO: 482032 - DNA, 822 bp, Homo sapiens
  misc_feature (642)..(642): n is a, c, g, or t
  misc_feature (655)..(655): n is a, c, g, or t
  misc_feature (661)..(661): n is a, c, g, or t
  misc_feature (666)..(666): n is a, c, g, or t
  misc_feature (669)..(669): n is a, c, g, or t
  misc_feature (671)..(671): n is a, c, g, or t
  misc_feature (689)..(689): n is a, c, g, or t
  misc_feature (697)..(697): n is a, c, g, or t
  misc_feature (722)..(722): n is a, c, g, or t
  misc_feature (741)..(741): n is a, c, g, or t
  misc_feature (744)..(744): n is a, c, g, or t
  misc_feature (748)..(748): n is a, c, g, or t
  misc_feature (753)..(753): n is a, c, g, or t
  misc_feature (759)..(759): n is a, c, g, or t
ggttttctgtttcccagctctcctggggctggggttctgggaatgtgacccttgctgcagctgtgttggaggagggcaatggggctgggccagaggatgagcaaataaagggcagaaacccaggaactaggaactcttcttcagtctgcttcttttttcaggcaggacagcgagattccagaagctccgcgcccagcttgccaaggccctgggctagaggcctgccatggcacccctgaggccctttttcatactagccctggtggcatgggtttctctggctgaccaagagtcatgcaagggccgctgcactcagggtttcatggccagcaagaagtgtcagtgtgacgagctttgcacttactatcagagctgctgtgccgactacatggagcagtgcaagccccaagtaacgcggggggacgtgttcactatgccagaggatgattattggagctatgactacgtggaggagcccaagaacaataccaacaccggtgtgcaacccgagaacacctctccacccggtgacctaaatcctcggacggacggcactctaaagccgacagcttcctagatcctgaggaacagccaagcaccccagcgctaaagtggagcacaggaggagatctaagggccganacatgatcaaggncctganttccngangnagaactgtgcgtggaagnctttgagncttacggatctcagaagggtccccnttggctccagggcgactgnttnagcnaaaanaggggnggccgggttcccatttcccgatgttggggttgggggccccggggggtcgctaagtggggggac

SEQ ID NO: 482033 - DNA, 230 bp, Homo sapiens
gccggggccccccccattttccccccaattgtttcttccaaaagggagggggggggaaacccttggaacccccccttggtttacttgattacccgggcccccctttttccccccccaacccccaagcccttttttaatgccccggggtttttttttttttttttttggccccccccccttgttaaaccccaaacccggggaattttcctttaaaaatttggtttttaata

SEQ ID NO: 482034 - DNA, 382 bp, Homo sapiens
actctatcacagactgaactcacttgtagaattcattgtagtgaagcttgttacaggtttggaggtgctgcattctattgtagataattcagaacttgaatctgattctaaggtcattaactttaggaaggttctccatttttaaaatggtggaactcttctgggtttccccttcaggccatcaaattttttagtaaatttgtaatagcaaacagcatcatcacaaaagatgttctgcttcctttgcaacctgaaccagttcctgagaatagctgctattaaaataggagcttctccagcatgggctacatggtgtaaaccctgcctataccataaataccaaaattagccagacttcatatgggttccccagggtaccgag

SEQ ID NO: 482035 - DNA, 263 bp, Homo sapiens
cgagataccgaatgaaaacaaatcttaagaacacggattcagtactcggccccttatgcgttaaccactatcaaggcaataatatagctatacgttattttaaaatcagactatgtcttctgtatgaaactggagagacaataaacatcaccatgtcccagttactgtaaacgagtaatgactattttccacatcaacttttaccaatgcgtaagcattactccatgtgctgtaattacagtgtctcactcacctgaagccga

SEQ ID NO: 482036 - DNA, 1341 bp, Homo sapiens
ccctgccctctcacctctgacacccagccccaggagccagagcactcctggcctccacctctgactcttcagcagctgaagattaatgcaggagaaagagcaatagcccaatacagggatgaatagagattacaatacatcctaagatcctatcaataccaattaatgcccagaaaatcggcatgcgctgtagccctgagccatgtctaagcgagagcatcggttgcggggtgaggagtggcactccccgctgagattatcctccgaatcgcgacaggttagtgagccattctcatgtgttgttctctatcccaatgccgcgtgcatcagtcctggtaagccattagaatgagagctggcgccatacttggagcatgcacgtaggtgttctcagacacagaaaagatagagaatatacagaagactgggaaacaactgaagagaaacaatacaaagtatacatgagaagagaagaacagaagagagaataccaatccaacaggatacaacaacaagagaaggagggtgggccgtccaggataccccaaggcttcctcctttcaatgatacgcacctgaatatcggaggggtcacattccccaacatgttctacagtgataaaatggaagcgtgcgtgggcggcctgcaggtggaaaaggcaccaggactctcatattcatgttcaataaacaattagacaaagaggaggcattgggtaatttaccccttttcatatccatatcattcacacgcagtagtcagttcccacacaaagcgagcaataccttggggtggttgacatccacatttgaggcttccagctatcgcgcacctgcggagatcccatttatcagcgattcgctgcagtgagttggttaacctatttctgagacgacgaccaagagggctagattggtgctccacacacagaagtagccactgcacacgagtacttccttggagaatgtacatcgacacgatatatatcagcgacggaaggaggaccacaatgcaatggaggaacttaccataggagggtagagttaaacaaaataagtatcattggatatgagccatggtgatagttacaagtccaaagtacccccgttcccatacaacagagattcatttatgtcgaacactctaaaacgtaattccattccagtcatcctttgagcacgatttccagttatccattaccatttgagtgaatgagccaccacttgcaggtaggagagtctagcgcaacgaggatatcttgggtcccactttctgtgggaggataggagaacatcccgatgggtatagccgatcttccaccagcaaaaggagaaagtcgta

SEQ ID NO: 482037 - DNA, 147 bp, Homo sapiens
tgaggccatcccttgcagatatgccctgcggctggatggtcactgacaccctcacagacagtcattgtaatccagatctccagcaaagtcagctcccactagtctgccattgggccagcgtgagccaagcgagtgccattgggcaca

SEQ ID NO: 482038 - DNA, 174 bp, Homo sapiens
tgctgagattgcaggtgtgagccatcacgcccagcccgggttttaagacagggagtgaaatgactcaggtggtgtgactcaggtggtgtgactcaggtggtgtgactcaggtggtgtgactcaggtggtgtgactcaggtggtgtgactcaggtggtgtgactcaggtggtgtg

SEQ ID NO: 482039 - DNA, 219 bp, Homo sapiens
atggaggaacaaacgaatcacaagttccaaggccctgctttgttttcttaaaagtactttatcccaggaaatttgtttgtattgagatatttacagttttatagtaatgtacatatcgttagggtcagccatttttaatgatctcggatgagacaaagcagccttcgagagcgtactctgtcctacttctaactttacttgtggtgtgaccatatgcat

SEQ ID NO: 482040 - DNA, 453 bp, Homo sapiens
gaacctggaagacattatattaagtgaaataagccagacacagacaaatactgcaagctctcactcgtggaatttaaaaagctgatcttatagaaatacaaaatagaacagtagttaccagagactggggaggggagggaggagggtatcatggagagagattggtcagtgggtacaaagttacaattaggtaggtgggataagttctggtgtcctattgcacagtaggatgactgtagttgtatatttcaaaatagctagaagagaggattttgaatgtttttactacaaagaaaagataaatgtttgagatgatgggaatgctaattaccctgatttgatcattgcacaatgtatacatgtattgaaatatcacattgtaccccataaatatgtacaattgtgtgtcaaatttttttaaataaaataaatatttttagacctttctaaaaa

SEQ ID NO: 482041 - DNA, 282 bp, Homo sapiens
cttcaaagaggagcggtggtcctgacatggttttgggacgcagagaagaaaggatggttgaggttggggaatcacccctgttccgggctggaagcaacttgcagaccacagagatttccagtgcgaagtgatgtgtgccctcccttgctatgtcccttgctggcccctgtgctgatcagagccacagaaagtgggctcactttggggaccctctagtccccctagtgacaagagaagagaaggtggtgactggattgtcatcaggcagggacgtgtcaatcc

SEQ ID NO: 482042 - DNA, 912 bp, Homo sapiens
gagcggagtggcgggctgtggcgcggacgcggaacccggcgcggcgggtgcacgaatggtcatggcgtatttcgtcgagaatcccggggggaacacaaatagtggctttgatgtcctctaccataatatgaaaccattggacagatatcaaccaaaagaactaagcagattttgtaagggaacgagctaccatagcaggaggcatactccagtgtccatgaccaaaactagcaaacatctgcaaggcaaattgattcaccaacttggcgaaccatttttgcaaccagttatgggcactgtatttcaacaaccattctaacagaggaccattacgcaacattggccacttgggatcttgttcagaccaatttaccaagacttcactcaacaggacagttcaggaaagtaatgcgagaaggaaccaagtacaccgtctcataaacacgactagacgacgaacgtttgcaaggaactctggaacgctgtccaaagccattcagaagcataacctcaggccccttccagaaacatccacagcgcacacttaccaatggcccaaggtggtgtaggcaaccatggaagcggttctgaacaaacgtgaccggcagcttacgacaaaaggacgcaacttacgaccaacacgcgcgcaggtcggttcaacagcttcgttacaggaaagatggctcaccaggaattagccctaattaaagcgcgctccctaattggttgggcacacaacattacattcgccatttcacgccacaacaggcgtggaactttcgcggacgaccaggcacaacacttggcaccaggaaaacaccagggtctccagcaaagccttctcccaacggaactctttggcacacgacacacttccagctccttccatgtccacctttaacgcgcgacacc

SEQ ID NO: 482043 - DNA, 266 bp, Homo sapiens
ttggagtagtgggacgagagcggaggagaggggggggggctttgggggaaacggcacctacgattttactctggagttccgtaggggaggtgatggccagccaagacgatccactcggccaacggagcaggggtaccaaccaccccgggctcggaactaataggaaaagtagactctttgtgaagaaacgagccagggactggaacaccctggtggaaacctgttgacagaccttccactttctcttcagaataagtagctggggt

SEQ ID NO: 482044 - DNA, 469 bp, Homo sapiens
  misc_feature (24)..(24): n is a, c, g, or t
  misc_feature (48)..(48): n is a, c, g, or t
  misc_feature (61)..(61): n is a, c, g, or t
  misc_feature (180)..(181): n is a, c, g, or t
  misc_feature (335)..(335): n is a, c, g, or t
  misc_feature (458)..(458): n is a, c, g, or t
gttgaagacttccgcagtcggcgncgcgggaggctggctcgcacagcngcgatcacgccanagccaacactaccccagacagttttgcgaagagacggtctttcatcgttatatccaccggcgcgtgagttttaaattgttgagaatctggttcttttgctttgctagaagcgcgcgggnnatagtaccgatcaatttttcataattcaatcgtcgtgtgaagagtaattccttttaaatccgtgcgctaccccctcgtatggcctctcgctacgggctcgaagcggtttttctcacggccggaatgcgcaagttttactggttgcacgacggcncccccggacggcggaaaaaatttccgggccctgccacgaagcaggcgtgcttaatagttgaacagtgcaaagtcggggatacgcagcgaacgcggaatacccggcagttttgacagggataanagggcacgccg

SEQ ID NO: 482045 - DNA, 1671 bp, Homo sapiens
cctgtgcctctgcgtgctgtgggtggggtttcgtcatgtgcctgcctcactctcgccctgtgtgttttggtgtgatttgctgctgtttgattgttgggggcggggcgggtcgcctcctcccttgcttgtgttcacagcgtctgtgttcttgattgatcccgcttgccgtcctcttacggtggggatccccctgctgtgtgcctcgcgtcccgtttcctataatgcgttccgtgggtggatatttataagcgtcgttgtgacacactctcgttgatcgatctgtggtcgttcaacacccgctcgtacaggggtgtgtgttatacacgcccgttgttcgatttgcggtgaggggaatttttgtgtgggggttgttttccccctcttacaataagtggggtgcaatatctgggccgactgcacacaaacattgtttttttcctcctcccccctattatgatgcgccggtttgtatctcttgtgggattgtctttaggcaaatcgctcctctaaactccccctttctctaatggagttgtggtcccgtctttgtgggcccccatatattggcggggagagaacacccacaaggcccatttatcttttgggcggctactaactggagggggccttttatactcaccacaaaggaggtactgattttctgccattaaagtgctcttcgtggggggcctcctttaacacccccactcggggtcttcaagtgctacatctcctcccctctaagggggccctttttatattccctttggtgcaccacaggggcgcaaccgtccctcatcagagcgggtccctttttacccctcatggggggagccccacccttgggaggagccatttttattttcctcctgggtcgcccaacactgtcgtcccaaaacattgggggatattgttatcctctccagagagccctaaacacagtaaacccgggtccccctttgtggggccctatacacagcgaagtcttttctgtgggacacagacgccaaagagtgccacccacagggagactctgtatcccgctctgcgcacctgtgggcgccccctataaggcgcgcccctcctcgcatgggcgcgccacggagttttgttgcccttaaagtaagacctttgccgttttgcccatgtggggaagatgcgtgtctcttctgcacatgtgcgtgatattaccacacgttctttgggcaccacgggcgtgagatcgcgcccacatatgcacagaccacagaaggtttgccctcttatagaattttcccaaaagaggggatactagaatgcttcgccattccacactgttataacccgaccgcgttcacacatgaggagacccactcacggacgaggtcaccttggtttgccacaatagcacacacggctggaatatactatacctgggcgaagggaaaaaaagaccacgtgcgggtttcccactttgaaacctgggaaaccacattccaaagtacacagtaactggttgaaacctgagccacactttcagcgttgcacgggaatagaatgctcacacttggttgcacggaccattatcgggtttaacaactcaaagagaatcaacccactgggaatttttggtcacatagacctcacccgtgcttcaaataccctgatataatctgaaaggggctcagatta

SEQ ID NO: 482046 - DNA, 177 bp, Homo sapiens
  misc_feature (172)..(172): n is a, c, g, or t
atccggtctgcgaatatgtaaactcacatttttcactcatctcaggagaaaggtttcttataggcattctcaatgtcctgtagataggcagaggtgatcttcatttcatgtggatctcctttcttctgaatccccgctctggacctctgcaaggaaccactctgcaaggaanccacg

SEQ ID NO: 482047 - DNA, 185 bp, Homo sapiens
aaggaagctatatgacttcttcatgtttagaatagctagagcaagaccaagcgtggtggctcacgcctgaaatgccagcactttgggaggcggaggcgggtgaatcacttgaggccaggagttcaagaccagcctggccaacatggtgaaaccccgtatctaccaaaaaaaaaaaagggaattct

SEQ ID NO: 482048 - DNA, 145 bp, Homo sapiens
tgtatagcgaatgtagtgagatagtataggcggatgacacatggtcctctgcatcttacatcttgagtcaccaagccagagcaggatccgacctcgaatggacacattaccagtgaaaggggcatttcttgtcccaatgtcggtg

SEQ ID NO: 482049 - DNA, 174 bp, Homo sapiens
ccttggaactgcctgttgcagcttcttccctggattgactgttttcaagtcctggagtccttatttttatttatttatttgagacagagtcttgctctgtcccccaggctggagtgcagtggcgtgatctcggctcactagcaagctccgcctcccgggttcacgccattctcc

SEQ ID NO: 482050 - DNA, 330 bp, Homo sapiens
cccggcaagaaatctcccggggtgggggggggccccccccgaaaagcctttaaaaccccttttttggttgggggagaacacccccctcccttttaaaaaaagggttctcacccttttgaccccccccccaaggtgtttttcccccccaaaaaattttaaagggtgaaaaaaaaaaaaaccgtgaaaaatttcccccccccccctaataaccccctgaaaaaaaccccccaggggggcccctttcaacgactatttttacccaagttaaaaggggcccataacggtaaagcctcccccggttagggagccacttaaaagcctcagaagtca

SEQ ID NO: 482051 - DNA, 513 bp, Homo sapiens
tgatatatctttgctatgaaacctcactataaacgcatatgtgcttgtgtgagaaatggtggacaacgctatatattagtagtcacgacagagcagacttcttgaaaaggagtattactagacataaaaaggaacttttcatcatgatgaaaggacacatgtcaaaaatgggaaattctgtcatatttgaaaattaaggaacacacacttctgatttccccacagggcaaagatgaaaccacaagagaaagcataaagcagaaagaaggacaactgctatagactggatgtctggtgtgccttcaaaattatgttgaagcctcatcaccagtgtgatgacctttggatgtggggcctttgggaggtgaatggtgatgagagtaaagcccgtatgaatgaacgaatcctgtaccatgcctgagatttatgaccttataaaagagttcctagagagcatcctcatttcttccaccatggaaagtttacaatgaagacagctgtctatgaaccagg

SEQ ID NO: 482052 - DNA, 106 bp, Homo sapiens
gatgcagaaggagatcaccgcctctggcgcccagcaccatgaagatcaatgatcatcgcacccccagaagcgcaagtactcggttgtggatcggttcgctccactc

SEQ ID NO: 482053 - DNA, 111 bp, Homo sapiens
tatcagcagaatattcttggacaattattgggaagtttcagctatcagggacagcagctctttagtcccccagcattactactaagcatagcgggctctgatgcttgctct

SEQ ID NO: 482054 - DNA, 419 bp, Homo sapiens
  misc_feature (56)..(56): n is a, c, g, or t
  misc_feature (85)..(85): n is a, c, g, or t
atgttagatatttgcaccatttatatgtgcactatttggtaacatctagtactatnaattttacttgctgacttttgaaaatctnagttggggagtattagatatcctattagtgattgctgtaagtcacttacaaatattagaagttcattcaaggggttgggaagatgactcagtggtaaagtactcaatgaccaaacctggtaacctgggtttgaattcccaccccaaaactagagagagtgcatgcatgtctgtaatcccagcatactcctataggaaataggaggctgagacaaaatcataggaagtttatgggttccttagcctgcgggatacagcagtgataaaaagagaccttgtcttagacaactgctgtacaggtatgcctctactcaagcacacacatcatacacacg

SEQ ID NO: 482055 - DNA, 105 bp, Homo sapiens
tgatcaaagattgggagagggatagaatagatcatagtaatgtttattgcctctagggctttttataggaatgaggcccactgaagcctggcgagaatgctataa

SEQ ID NO: 482056 - DNA, 934 bp, Homo sapiens
tgtgaaactgagtctcactctgtgcacaggttggggtgcagtggccaatcccagctcattgaccctccacctcctgggtccaagggatcccttgtgcctcagcctcctgattactaggattacggcttgtgccataatcctactaattttaacatttttagtaaacacgaggtttggctgtgttacccaggctagtcttgaactccgtggcctcgttatccgcccacctcagcctcccgaaagtgctgggatcataggagggagccaccgtgccgttggccaaatttctcataagctttaaaatgaggtacaaatatgggctaattggtaaggtgattatgatcttgggatatacatgtcggtaaaacttttaaccctagttttctcacacacacaaataggtacctgagaaatgatacggcttgcgtgttatcggtgacgtgaacgccaggatgtttatactttggcggaaccctggttgcttggaattttaaaaaagccgccttgcattgactccaaagggcttcttaagcaatttcccctaggagtattgtatttccaccccttcaaaaaaaaaacaaccccattcttggatttgacccaaggccctgagggaaccaaaatggcgtcttaaatgcctcggggatttggcaggcggggtggcaccttaacctcctggactattattgtgacaagcgccccgctgtttggctcgcgacggacggggctaacacggaatagccgggaaccaggagagataaccgaggtggaaacagccagcgagtatcactggggaagccaaacgcagctgacaatagagagaccgcacacgactaggcgacaaccagggatagacacagatttgctgctctgcgacgataatgcatatctactcatgcctcacaccgaactaatacatattaactattacatt

SEQ ID NO: 482057 - DNA, 139 bp, Homo sapiens
gcacaagatatagccaatcaatacatttccctcaacgctatttgactctcaaaggtaacaccatgtatattatcatcaaagagaaggtcaaaggggatatatcgccactgaaattgtttacacagtgaccatgagctta

SEQ ID NO: 482058 - DNA, 334 bp, Homo sapiens
tttggggttttttttaagggggggcaaaaccccattttttttttttgggggtttttcggggggggaaaaccccccccgggggcccccgtttcttttttttgggatgttttttggcccaaccccccgggggggttttttttttttggttgggaggggtttgcctttccccccggaaagggttttttttttttttttgggagggttttttttggcccccattttttttttttttaaaggaggcccccaatttttggttttttttttttttgggggaaccttgggccccccccccccgtttttgtgtgggggaaaaaaaaagggggcccggccccca

SEQ ID NO: 482059 - DNA, 1020 bp, Homo sapiens
  misc_feature (1013)..(1013): n is a, c, g, or t
gtacgccgctgtggttgcggtccgtgcagtgtaagcgcgtgcgttccgttggtgtccctggatcatggcgctgtagttctcccgggagcccggggtatccccctgggcgggtaggccgcaaggtctgtggtcgggagcttctgctcattcgggatcgacatagtattgttatatcagacgtagggctatttgccatctgaagagcctgttacctacgtacgtggctgcacactatcggattcactcgttgctgtgtgttcctactgattccttgactctgcaatgagaatacctcatagtagatggtggtgggagccacttttggactgaatttggtttattaccaagttgttcagtccagctgcctggttgtagggtctccacagtatggataggtgtggacgggtcctgcaaatgcatggagtcgatcatgagggtgaacaagagtggcagaaagatgacgtggtgctcccttgtggaatagtctccgtaatggtgtcatccgaggtatgtcattcgcgttcggtggtccagtacagtatcaacagctgacgtgtgaactgtttcttggacacttgttggcagatggccttgtccattctgtctctgctgattttatccgggtcacaggattcggctggtcctgatactgtgggtatggggtcgtggcccggagtatgattaccgaattctgaggcatgtcgcctgcgcatggactacttgactgaccaagcttagtgccggggctacaagatgtcggtgatgccgcgggagccccgggggtcccctggactgtcaattggaacggggcttccgaaaagggtatctgtggggagatgatacacaagcgtatgtttatagtggacaccacaacgatcttgtaaggtgttgtaccccattccggagatggtacacgagcatggtattgtcgagtaatgacgagcgcgcactatctatatcaagagaaaacacgcagtagacaagtgcaggtgtggacagaactgattctccgnacccgtt

SEQ ID NO: 482060 - DNA, 411 bp, Homo sapiens
gatgcagggtcttactctgtcgcccaagctgtagggcagtggtacaatctcggctcactgcaacctcagccttctgggctcaagtgatcctcccacctcagcttcccaagtagctgggactacagaaacatgccaccatgcccgcctaatttttgtattttttgtagacacaggatttcgccatgttggccaggctggtctagaactcctggactcaagtgctatccgcccatcttggcctcctaaagtgctgggattacaggcctgtgccaccacacttgggccccaaactgtatataatttaagtcatatagattcacatataacaaatagagtaaaaaagattaaagtagaacaaaattaaggttgattaagagggcacaaagggaagttttttgttttgttttcgtc

SEQ ID NO: 482061 - DNA, 124 bp, Homo sapiens
tcacttgaacccgggagacggaggttgcagtgagctaagtaaatgccattgcactccagccttagcaacagagcaaggctctgtctcataaataaataaatgaataactgaaagaatttcatat

SEQ ID NO: 482062 - DNA, 291 bp, Homo sapiens
  misc_feature (16)..(16): n is a, c, g, or t
  misc_feature (72)..(72): n is a, c, g, or t
  misc_feature (78)..(78): n is a, c, g, or t
  misc_feature (159)..(159): n is a, c, g, or t
  misc_feature (283)..(283): n is a, c, g, or t
  misc_feature (286)..(286): n is a, c, g, or t
cagctgcagtttgggnggattgggtggagtatgtgtgtgtgtcagtgctcagctaagaactgtagggaaganggatgnccttcacgcagaactccttttgggatatacatgatgcagaaaggatcctacatggagagagacagaactctctcagctganactctcagagattcctgatgggctttctcttgaagtccaaaggcgtctgcattgtttcctttctttgcccatccatgaatgttctgttttgttttgttttttttaataagaattccggctgatntantgtga

SEQ ID NO: 482063 - DNA, 123 bp, Homo sapiens
tggtccagcctcccggctcctctggaaggagatgagattatcctacaaagtgagtggccacaaatgccaggacagcggatgtcctggagctgtggggggaccattgggagaagaacacacact

SEQ ID NO: 482064 - DNA, 158 bp, Homo sapiens
cgtacctatcaaatggaggatggaggcaatcataatgtcaccagggcccagaacctacgatgaggccactggggtgcctgcttgcctcacaggagttttgagcggagtcaataggactatgtataaccaatactttgcacagtgatgctgcacagtaa

SEQ ID NO: 482065 - DNA, 281 bp, Homo sapiens
acagagtaagggttgcgatctgctttctgtagtacaggaagcactgggcttcttgcagtgctttgggttggtcagcaaaatatatagtggggtgaaggtggactgaagaagtccagtgtgtccagttcaaacagaaataaatgacactcatcatcaacaaagacctgttgttgtgactgccttgagttttatcagaatgatgggcctagtaatccttcagaagcaccgtaattctaaataaacctcttcccatagacctttcccccataagatgtgtcttc

SEQ ID NO: 482066 - DNA, 129 bp, Homo sapiens
cggtggaaggactgggcgcaggtaggacgggcggagtcagtgtggtttgcggcgccctaggtccaggtgggtgccacctgctgctccctggaccccagtgggagggctgttggctttcagccttaccgc

SEQ ID NO: 482067 - DNA, 1338 bp, Homo sapiens
  misc_feature (544)..(544): n is a, c, g, or t
tccgcgtcgtatcctagtcggcagatgggtgcgcagcgaatgctaatcatcatgccttctggtcttgtgtggttgagtctacgttctccactgatgtgttttacgacgacgcttgttttttgcctgaccccagtcgtgttacaccacacatctgtgggggggatatatacctccccttcgtcggttatcacgccctgggtgatacatcccgccccgccaacaccaccaaatgtgtgtgagaagcccttctgcacagcttcctttttttcaaccgccacagttggggctgacgcagagtttacccaatctccttgccctccgatttgttgttcctctctttctctctttctcctctgtttcattaaaggggtttccacgcctcggcttttggttccgaacgaccctcaagaggacgaagccaactcccgtgtgcctgggggttccccgagggggaccttcctgtgctgacactgcggcccccaagagcctggcttatgggtcccccgaccattgcccagtatgagtctgggtctttgttagactntggggttcttgcctggtgttggccacagagtgacatagacaccaggtttagaggttttgttgccccaccaccccccatagcaccatcagaggccccaaaaacgggggggccctgtgcctggcccactttcacaggtccacaggccacagtggcgcccttggtatagcaccacaagtcttgtctcctcacagaaagcacagggggccacagaatgagattttccctcccctggtattgcacagcctgtttctcacaaagccccccgcattttttcccctctctctttccccactctcccacagatcgccactctcactataacaccacacatgtgcgccacaagagactatctcggagactcttctcatctcacactggtgaactctctaaatccacgtccctctgattatgtcccacagcctctgtctgaaggggcacgcggaagagcgcccttctttccttctgggcacgcgctatttctatgaataggtaaagtgggggacgcgggagaagggtgcacataagctgttttatgactgaagggaacgctggttgccgacacgtcccccaacctatgctatggctatagtcacagagtcaacacttccacgggttggtaaatgttggagtgatgataacacttcactttttacccctgtggaatgactagtgctgtatagaggttcacactgttgtaacacacacgtctgttttttatttgttaagaaaaactacagcatccttgcataatttttgatggtaataaatttgaataatccagattttcttaccca

SEQ ID NO: 482068 - DNA, 976 bp, Homo sapiens
gcttgggtatatgtggcttccttcgtgagtgtgagccaggctacaccccagcaagcatgtcaaggtgactgcagtggtattgatcttggcaccactactcttgtgtgggtgtaaccagcacggaaaagtcgagataattgccaatgatcagggaaactgaaccatccaagctatgtcgcctttacggacactgaacggttgatcggtgatgcctgcaaagaatcaagttgcattgaaccccaccaacacagaactgatgccaaacgtctgatcggacgcagatttgatgatgctgttgtccagtctgatatgaaacgattgggcctttatggtggtgaatgatgctggcaggcccaaggtccaagtagaatacaagggagagagcaaaggcttctatccagaggatgtgtctgctatggttctgacaaagatgaacgtgaaattggcagaatgcctaccttgggaagactgataccacgtgcttgtggtcacagtgccagcttacttaatgactctacagagtcatggctaccaaaagatgctggaactattgcgtggtctcaatgtacttagaataattactgagccaagtgctgtgctattgctaacggcttagacacttgaggtcggatgccgaaggcaacgtgctccctctttgaacctggggatgtgcactttgatgtgtcaatcctcgctatgaggattgcaccttggagggcaagtctacggttgtgagaccatgtgttggagagcatttgatcaccgagtgtacattaatgtggggttaaggcagcttagagggtcccagggcacagatagctgaaacgccccgaacggatgaaaaggtaaaagaaccctcttcaagaccaggcgaatgaatggcttgtgagaaagagattaaccatctgccagtgaaagagtgcttgagacgacacaacactacgaacagaattgcgggagccacacgcactgagga

SEQ ID NO: 482069 - DNA, 1016 bp, Homo sapiens
cgcttttttgtgggtcgcccccgctctcctatgtagttctcgcttcccgccatgtagccaccgcggcgtcctttggtgggcaggggtgttctctcccattgggagttctcgaggcgagcttgtggtcctggtgacactctcctggcgggagcacccaccccggtttgtttagtggcgggggccagtgacgtggcacccaaagtagtccgtgggtcgctttatggtctcgggcgggcgacacccgcccacctgggggggtattgccccccgttgtggtgaagagaggagagcgcttgcttttaattgttatgttgtttgttgttcgggtcgccgtcaatggttagacatttgtttcatatcatagaggggataggtctaagtggttgcagccggctcctccccctatgctggtgagttgggaggaagatagtcgttggccgccgaatataactatttatatgtatctgcacatcgtattcacgcaagcgggcgtttgagagagataatttctccccctctttcctggtatagaaacgcaggcgtgcttcttcttggatattctattatgtaggcacactattctgtggagagattgtgtggtgagagaacgacgagagacccatcgggagatctgccgccagaattagtggggagaaaaaaatatggggagcagacactctctcgttggggggggaagtgcagatcctcccgtgggggatgaaacatattatgtgggtgggtcttgagaatctttgaggaggaggcctctcgatctcctccccgcctgacttctctacacccgcgcttgttttctactttgctgtgcgaactgttctgcgccggcgccccattagggagaaaggaatccccgcggaagcaaccactcccttttttttaaatcccccttggggggccgcaggaaaaggttggggggtggggggccctcccgcggggggccttggggcatccccttttttttttttgaaaaccaaaaaaatgggtttcttgttgcccca

SEQ ID NO: 482070 - DNA, 726 bp, Homo sapiens
  misc_feature (550)..(550): n is a, c, g, or t
ggttttattttctaggcacaggtaagatgatccccattaacgctcttccgacggatggggtctgagggcaacatgtggggggggattcttcttacaggggaggggaaacaaaggcttccgtttttgttttctttaagacaaacagggggggatctaaaagggggggggagccagggagaaggggttgggggtacacctttttcaaaggcgaaaacgggggggctttttctctttttccgaggggttttttcgggggggcggggggcacaattggtggggggggggggaaatcaacactctttggtggggaaaccacgggggttaaaaacaacttttaacccaacggggctggggggggggggcaactttttttgaatggttggggggggaaaaaaaaaactaaaagggggttgaatgggctataggggaaaaaatttgggggtgggggagagggggtttttgggggtttgttttccacacattgtggggggaaagaaaagagggtttgggggggaattttctttttagggggggggggcctggggggggnggccccctttcaaaattcccttccccaacccccccccccccccccccccccaccccccgggggttttttggggggggggggggggggggggatttggggcccccccgggggggccggggggtttttttttttttttttttttttaaaaaaaaaggacaaaccccaaaaagggccca

SEQ ID NO: 482071 - DNA, 1547 bp, Homo sapiens
  misc_feature (1)..(1): n is a, c, g, or t
nacttgttgtgttgttttttttttctgcttgtttttggttgtctcgtgaacacgaaacaggagacagcagcgagaggcggcggcgtctgcgatgttgtttgttgttgctcgttgttctctctgttttagtttagttggacttcggctctcttcgttgtggtctgtttgtcggtgttctattccccacatattgtgttgagagcatgttcgtgtccgaccttgcagttgttagcatcccttttttgttgtgatctgtgatctgggtcatgtcctcactctccgtgttttcaggttgttggttgtctctccgcttcgattgtcgcgatatgtggcccgttgtttcatttggtcgcgggttacctctcgcggttctcacgttgtggtgggtctcagtatacccctatcgcgggtgtcctcccaggtcgggtggtcccgctccaccctcgtctgggcgtgtctggagtcaccagagggtgttcccaccaaaagtgttgctccctgtgggggggcctctacttgtgagtcctccgcggtgttagctcacctgttgggactcccacaccttcgcgtggttgcacggcgtgcacccctgggtgtgtccgcgggtggtcccactcgaaaacttttggtagacccccacatgtggccacaggggttggctcacagaaacgcgtctcaacttgtggaatgaaaagaacttcgaaaaatgtgggtgtggccccaaacgtttgtaataacccacagtgccccctggaaacttggaacacggggtttacacagggacatgtggggtagtgcttctccaccccggataaggccttgtccaaatttgtgactatcccctttgggaatttatactttgggaaaaaatccctctgccctcacctcctcttgaatttggaagaagaggcgcttccattcccgggctttttgaccccccccatacccctttgcccacaatagccttccaccggaggcccccctattcgcttaagaaattggggaacgccaccccccagaccccctttcctgtcctaaaaccttcccccgaaattggttttccaagcccttcttaatgtcgccctaggacccacaattgtggtggtggttgtgtttaaatttttgctttccaagcttctgtatgcacggaacctggccccacacgcaccacccccgtatcccctctctgttgaaggagagctcttgtggaaactgttggggtttggttttccacgcgaccacgaaagagacaatgaatggaataattttgtggcttctggggccctttctccaccccccactctcaccactaacccttgctgtaacccatctcaccaaatgggaaaagagcccatgcccaccccacactctccccccaagggcccccacactgtaaacttcccagagcccctgaagttctctagaacccctggacaccccatagactggaggcctgctggtgtcccgaacacccccgattagggtggctgtcccttccctggataactatttgccccgaatcctggaccattaatcccaattgaagt

SEQ ID NO: 482072 - DNA, 352 bp, Homo sapiens
cagaaacatcattgttttctaggaatttacagtataaaacagtagagaaaattagaaagccggctggtcacggtggctcacgcttataattccagcgctttgggaggccaaggcaggtggttcacttgtggtcaggagttcaagaccaggctagccaaacatggtgaaatcccgtctttactaaaaaaaataaaaattatctgagcgtgttggcgagcgcctgtaattccagttacttgggaggctgtggcaggagaattgcctgaactccggaggcagaggttacagtgagctgagatcatgccactgcactccagcctgggtgatggagtgagactgtctcaaaaaaaca

SEQ ID NO: 482073 - DNA, 751 bp, Homo sapiens
  misc_feature (12)..(12): n is a, c, g, or t
  misc_feature (74)..(74): n is a, c, g, or t
  misc_feature (78)..(78): n is a, c, g, or t
  misc_feature (80)..(80): n is a, c, g, or t
  misc_feature (85)..(85): n is a, c, g, or t
  misc_feature (92)..(92): n is a, c, g, or t
  misc_feature (94)..(94): n is a, c, g, or t
  misc_feature (127)..(127): n is a, c, g, or t
  misc_feature (142)..(142): n is a, c, g, or t
  misc_feature (146)..(146): n is a, c, g, or t
  misc_feature (148)..(148): n is a, c, g, or t
  misc_feature (152)..(153): n is a, c, g, or t
  misc_feature (207)..(207): n is a, c, g, or t
  misc_feature (234)..(234): n is a, c, g, or t
  misc_feature (244)..(244): n is a, c, g, or t
  misc_feature (250)..(252): n is a, c, g, or t
  misc_feature (292)..(292): n is a, c, g, or t
  misc_feature (303)..(303): n is a, c, g, or t
  misc_feature (314)..(314): n is a, c, g, or t
  misc_feature (325)..(325): n is a, c, g, or t
  misc_feature (355)..(356): n is a, c, g, or t
  misc_feature (359)..(359): n is a, c, g, or t
  misc_feature (404)..(404): n is a, c, g, or t
  misc_feature (412)..(412): n is a, c, g, or t
  misc_feature (434)..(434): n is a, c, g, or t
  misc_feature (442)..(442): n is a, c, g, or t
  misc_feature (450)..(450): n is a, c, g, or t
  misc_feature (463)..(463): n is a, c, g, or t
  misc_feature (506)..(506): n is a, c, g, or t
  misc_feature (537)..(537): n is a, c, g, or t
  misc_feature (576)..(576): n is a, c, g, or t
  misc_feature (606)..(606): n is a, c, g, or t
  misc_feature (623)..(623): n is a, c, g, or t
  misc_feature (630)..(630): n is a, c, g, or t
  misc_feature (740)..(740): n is a, c, g, or t
atagaatccgtngtttttcccatcctccttcgccctacgcctggcactccccccgccccccagtcttccctctntttntnatgtnacaaaananatgggttaagggactataatcgtgtgtcatgtnttgggtaaatatggngggntngggnnttaaagggagtagtgagtaaccgattacatgagtatagggactatactattaanggcaaactggtgtgggcattgtgtgtnatttattttnaaaagnnnttttgttagttaagattagtgttttttaagaatgagaatntgaaaattgtnacagttttttntttttaatttnggtctcttccagagagacctatatattaannggnggtgtttcttcactttatttcttgggattttgaattatggataangtaaaaanattgttttttaggaagtaaagngatcagangatgtttnagaacagcttganatttttgggataggtttttttttttttcaactgcaataaaatnagtgcagttcagaaaactcggcctttcagtntccgagaagggagctttgtaagcactttctgttgggggnactttgttaagcagctgggggggttttganccagctcttgtgttgtntggtgtngacagggcacagactgggagtcaagtggcctgggtgcttcttcactgccaccagcacttcctaataatggcaaatttacattttgttacggtgctcacagcttacaaaanacatacatgtg

SEQ ID NO: 482074 - DNA, 345 bp, Homo sapiens
tagggggaatgatggtggtcttgggatatactacagcgagggctattgaggagtatcctgaggcatgggggtcaggggttgaggtctgtggtgagtgttttagtggggttagcgatggaggtaggatgggtgctgtgggtgaaagagtatgagtgggggggggtggtggggtgggtaaactgtataactagtggtaggaagcgtgaataatttaagaaggaggagatcatcaagactttagtccaaggaaggaagagaccaagaaataaaacctcccacttgggtcgtgtacatacgggcctcgtggtgattacatagatcagccattaaaataaaacaagcctt

SEQ ID NO: 482075 - DNA, 334 bp, Homo sapiens
gaggctttctttactacagtggagcaaaaaagattagagagaaggtgggaagggaatggacgttggagattgaaaaggttagattttagattagagaatgttttaccctgaagtcagcatgttcttaggaggggcacagaatgaagttttaagttagctcagattgagggtagctcaaagttcaggagcccacgtaaaattttacttagaccactgaagacaatttagctgatttttttcccccgatggagtcttactctgtcgccagctgaagtgcagtgtcgaactctgctcactgcaaccgatccgagagctccggcgcttagtcgatacg

SEQ ID NO: 482076 - DNA, 456 bp, Homo sapiens
  misc_feature (146)..(146): n is a, c, g, or t
ccccaaggaccccattaatttggccaggattccccccataggttgaaattgaaggggaaaaatttgttaaggggcaaccccaaaaaaaaaagggccgggtttccccacaaaagggaaacccaatcagacttaacaggaggatctcncggaagaaactcctacaagccagaagaaagtgggggccaatattcaacattctttaaagaaaagaattttcaacccagaatttcatatccagccaaactaagcttcataagtgaaggagaaataaaatcctttacagacaagcaaatgctgagagattttgtcaccaccaggtctgccctaaaagagctcctgaaggaagcactgaacatggaaaggaacgaccggtaccagccgctgcaaaatcatgccaacatgtaaagaccctcgtcttcgggcgcggttcccaattcgccctcatggcgacccttt

SEQ ID NO: 482077 - DNA, 317 bp, Homo sapiens
gctaaccccggccgcttccccccctcggagcggatccgaggggtccttagggtcatcacttaggagctcccggacgtgcctttgtattacaccctggcccagcggggtgcccgggtcaaaacatttccttgcaaaaggtttaaggagggcccctgtcaacgcgggggccagtgttgctactcccccagccccccgacacccagggtttttgttgatgctgcccctggctgtccaaagacctccaaccagaccccccctgggcctgggggtgccgctgggccagggatagactgaaccaataaaaagatgtcccgtca

SEQ ID NO: 482078 - DNA, 631 bp, Homo sapiens
ccatatagcttcttaagaagcacagccctgtgagcgcctcgatgtccttctgtgtatcctatgtcccccttcccctctggaacataagctccacaaaggcagggacctgggaatcccgttcgccgtgcacttcccctagcaaaacgcctaacgaacccaagtggacccaggactgaaaattccattatccacattcggcgtattcacccgtcgtacgatcccactcggcttcatgatgagagcatcgcaggggacgtcacatgctgatgtgtcggccagggccacggccaggggagcctgcagcatcagtcttccatagtcggggacacgttcctaggccccaaggcaagcagcggggtcaaccacaggcagcaggcggtccagatatccgggtattccagcagcagcactcaggacccacatcgagacatccggggatcctataacaacccatccggagagccgacgccagaatacaatggcacatcaagagccacggaggacacaccgcaatataaacacgcggccaaaacaaagcaacggacatggcagcaacccagaacaaacaagacgacacaacccgaaggaccggcccggacggcaacccggatcacccgggccatcacccacg

SEQ ID NO: 482079 - DNA, 581 bp, Homo sapiens
  misc_feature (113)..(113): n is a, c, g, or t
atgtccggccacagctgtcacacacgatcctcaccgagaagaactggttccactacgctgcccggatctgcgatggcgtgagaaagtcctctgctctggcagagtacagccgnctgctggcctgaggccagggagagggacttgtcatgcgggtgaccttccttgggtccgcagttgtctgcgagtgagcacagatgtccattcccccgctggggtggagagccggcagctggccctgatggattagggatcgtggcttcccgtgtcccagtatgaccattgagtgttgtccaggggccagtgcccccccacccttcacgttgggggctgtttccggcggggttgacttgtgaagcgatcccaaccccaaacctgagatggggtagcccgtcctgtgtcctccacagggacaagcagtgggaggagtctgatatggtcaccaggaagcccgggctccatcttgacctcctttttcagggacaggagcaacaggcccctcttccctgactctgagcccttccctgtaaggtgaggcagggtctggagagctctttattggaacagatctggtggttcaacta

SEQ ID NO: 482080 - DNA, 1664 bp, Homo sapiens
  misc_feature (470)..(470): n is a, c, g, or t
gctctaccccctgcttgactgggcaacacaggatgtcttgtgcagcaaggtataaagggacaaaaacacaaacttttaacacttccccaggggggctcccattcaagtctccccaacccggaacagtgtgcccccttagaaccattagaaccccacagagcattaacacttgaagcacaggactcccagaattacggctctcctcccaaactttgtggtttggttatagtttataacattcgccaacctctcactgtgtgtttggctcttataagaacaccattagaaatctcaacaccagagaatgtgagagaattattacatttgtttttggagaggttggagagcgcaaatctctataagatataaggggctcacacaattgtcgccccaagagacttgtgccccaaattgtgagagccctcatgtgtctatacaccaattataacatatattattctccttataanatatattgtgcgtgtgtgctgtgtgcaaacctttctgtgtgaatttgtggggatacacagtggtggcgttctcccccaccaggggaacacaaacaatgtgaggtctcttataaacgctatttatcaaactttaagaccccatatatgtgaaatgtgtgtacacgtgttcttataggttgtatacatctctctcaggccgggtgggcgggtggactacgtctctatatatagtgtctccccacagggctatacctctcggaaggaaaggcctgtgaggcgcccagaaggagggagactctcgcttgtgtgaagcccccccagagggggagtttctccggggggccttgtggcccagtgttgtgagctgtgtgtgaatttcccacccactcagacttgtgtcgcactctccccagaagccctttgggggggggcaaaagtgggtacgccaaaggtccaccccctttaactaaatagccataataaccacgaagcacgtcttctcaatgtctccccccatgtccatctcctctctcgcatctcttttcttctaagcatcttaaccccccccagtgtaagtgtttttgtggtagtctttaagagctttttatttcccccgaggaagcaagatttctcttctcgtggttcccccccgcaaaaatttccccgatgtgtttccccaacggcgccagacggtggtgggggactgcgcccgcgcggggtttcacttctcttaaaaggcgcccaccacacccagaggcgttcttacaaccggggtggcttttgcaacgggggtaagtaccacccctccgcctgtgttgtggggggcgcaaaacatctctgccggcgggtgacaatcgacaaggcgtccttgttagttgtgggcgctttgctggtgaccccgtataagggtcgctgtgtggttcggcgtatgagatttccccccctccgtcttttgccaacaaggttcttgtgtgcctgttgtgtcccccctggtggagagggcggcgagagacgacctctgtagggggggacaccactccgctggggcgggagcccccccccgggggtgcgctccgtgtgcagaagccccgacgttcatcaacgacacagggaggcccccttcaaacggtgttcctgtcgcgacgcacgtgtaggtgaacccctctctgctgtggtccatctcctctagacaga

SEQ ID NO: 482081 - DNA, 523 bp, Homo sapiens
  misc_feature (102)..(102): n is a, c, g, or t
  misc_feature (112)..(112): n is a, c, g, or t
  misc_feature (115)..(115): n is a, c, g, or t
  misc_feature (117)..(118): n is a, c, g, or t
  misc_feature (124)..(124): n is a, c, g, or t
  misc_feature (137)..(137): n is a, c, g, or t
  misc_feature (147)..(148): n is a, c, g, or t
  misc_feature (151)..(151): n is a, c, g, or t
  misc_feature (158)..(158): n is a, c, g, or t
  misc_feature (166)..(166): n is a, c, g, or t
  misc_feature (172)..(172): n is a, c, g, or t
  misc_feature (176)..(176): n is a, c, g, or t
  misc_feature (209)..(209): n is a, c, g, or t
  misc_feature (213)..(213): n is a, c, g, or t
  misc_feature (220)..(220): n is a, c, g, or t
  misc_feature (223)..(223): n is a, c, g, or t
  misc_feature (242)..(242): n is a, c, g, or t
  misc_feature (286)..(286): n is a, c, g, or t
  misc_feature (288)..(288): n is a, c, g, or t
  misc_feature (292)..(292): n is a, c, g, or t
  misc_feature (297)..(297): n is a, c, g, or t
  misc_feature (305)..(305): n is a, c, g, or t
  misc_feature (311)..(311): n is a, c, g, or t
  misc_feature (313)..(313): n is a, c, g, or t
  misc_feature (318)..(318): n is a, c, g, or t
  misc_feature (322)..(322): n is a, c, g, or t
  misc_feature (326)..(326): n is a, c, g, or t
  misc_feature (332)..(333): n is a, c, g, or t
  misc_feature (359)..(359): n is a, c, g, or t
  misc_feature (383)..(383): n is a, c, g, or t
  misc_feature (386)..(386): n is a, c, g, or t
  misc_feature (466)..(467): n is a, c, g, or t
  misc_feature (478)..(478): n is a, c, g, or t
  misc_feature (487)..(487): n is a, c, g, or t
  misc_feature (498)..(498): n is a, c, g, or t
  misc_feature (506)..(506): n is a, c, g, or t
  misc_feature (514)..(514): n is a, c, g, or t
  misc_feature (516)..(516): n is a, c, g, or t
gtgggaatcaaacgactgggggggccccatccgttttcttcttccccccatttaatgaccggtgaaatctggaacgcctcctggggggggcccgctgaaaantttatcccanaangnncaaagncagtgaaggtggntacgccctcnnatnggggacncccagganagtgtnccanagcagggcagcaagggcagcccttcagcctcancagncccctgncgntgagcaaagcaggtttcgngaaacccaaagttttcgcctgggaagtcccccctcagggcctgngntcgnccgtnccaaaaancttcancnggggngagngttnaagggnnaagggcccccccctgctcctcagttncagcctgacccccccccatccttnggnctttgaccctttttccccagggggcccacccctattgggggcccccaggttatttttccccccccccccccccccccccnngggtttaattntggtaatgntgggggggaangaataaanaaaggggntntttgcca

SEQ ID NO: 482082 - DNA, 238 bp, Homo sapiens
  misc_feature (126)..(126): n is a, c, g, or t
  misc_feature (196)..(196): n is a, c, g, or t
  misc_feature (234)..(234): n is a, c, g, or t
ggccatcgcgatgatcgctcggtcgataacactgccgtccaacccaccgaaacgcccgcatccggtgaaccgatggctccactggacttcgatgagaaagctcttccggcaccggtgcgtgctganttgcgtggtgtcccagccgacaccgctcacatcattgagggtcatctggttgctgctgctgaacttctcnacgaggacccggctcaggcaaatgcccacgctcaggcngctc

SEQ ID NO: 482083 - DNA, 300 bp, Homo sapiens
ggacatacccatggaatcccaccacacagatgagatgcataacacactgatgagacataaactccaaagactacaccatgggctttcaaaatattaacagagtagactggatagcgtggcagagcctcttatgtctgtgtatttaatagcaagtccagcatctactaccatgttagcaaagaaatcaccatttattccaatgattttggaagacatggatgtcttagcagcattcatcaggcaatctcttcccagttcatctgtgttaacaattaggttatcattttgggcgtacgggga

SEQ ID NO: 482084 - DNA, 205 bp, Homo sapiens
cccgtcgcgacgccagtgtgatatcccatgcgaggaagacggtggtttagacacgcatgcctcctggtcggggtgggcgtcccatgcctccctctagaagagattatgatgatatagccctcgtagagtaccacctccccctcctcccggaggcagcggccggggatgctagcagagcacggaatcttccctctttcctccaaca

SEQ ID NO: 482085 - DNA, 530 bp, Homo sapiens
  misc_feature (482)..(482): n is a, c, g, or t
  misc_feature (506)..(506): n is a, c, g, or t
tccgcgggattaaatgtgtttgcctcgcttttctcagcggcggccctgctgattctgtgttcccgtatagagataacaggtcttccacaccctgtagacctttgcccctgtgttttgatatgtaaacaggatctctgctatcccacagttctcgggtcaatacccacggagtctttcatctaagatacagcacttgtctgtggtccctttatacgctacacttgccaccttggaattaaccccgcatttattgggagtgtccattccggggttcgggggccctaccccattttgtttagtgtctcagagctccgagccttgagctcttagcgtggtcacatctatccgctctaagtctccctgttgtctaggctccggggatcgcgagattcgcaagtctcgcaatggtttcactctggtcccgctttgccacattctcgtggcacccggtagttctccagcgtcctccaggcgcgcctccncggtgttttcaatgggttcaaaanccggtgtgccggtctgtccgctgg

SEQ ID NO: 482086 - DNA, 845 bp, Homo sapiens
  misc_feature (21)..(21): n is a, c, g, or t
  misc_feature (65)..(65): n is a, c, g, or t
  misc_feature (86)..(86): n is a, c, g, or t
  misc_feature (95)..(95): n is a, c, g, or t
  misc_feature (149)..(149): n is a, c, g, or t
  misc_feature (164)..(164): n is a, c, g, or t
  misc_feature (183)..(183): n is a, c, g, or t
  misc_feature (189)..(189): n is a, c, g, or t
  misc_feature (220)..(220): n is a, c, g, or t
  misc_feature (222)..(222): n is a, c, g, or t
  misc_feature (239)..(239): n is a, c, g, or t
  misc_feature (244)..(244): n is a, c, g, or t
  misc_feature (248)..(251): n is a, c, g, or t
  misc_feature (268)..(268): n is a, c, g, or t
  misc_feature (275)..(275): n is a, c, g, or t
  misc_feature (279)..(279): n is a, c, g, or t
  misc_feature (286)..(286): n is a, c, g, or t
  misc_feature (290)..(290): n is a, c, g, or t
  misc_feature (295)..(295): n is a, c, g, or t
  misc_feature (321)..(321): n is a, c, g, or t
  misc_feature (329)..(329): n is a, c, g, or t
  misc_feature (337)..(337): n is a, c, g, or t
  misc_feature (399)..(400): n is a, c, g, or t
  misc_feature (402)..(403): n is a, c, g, or t
  misc_feature (406)..(406): n is a, c, g, or t
  misc_feature (409)..(409): n is a, c, g, or t
  misc_feature (413)..(413): n is a, c, g, or t
  misc_feature (419)..(420): n is a, c, g, or t
  misc_feature (424)..(424): n is a, c, g, or t
  misc_feature (428)..(428): n is a, c, g, or t
  misc_feature (430)..(430): n is a, c, g, or t
  misc_feature (469)..(469): n is a, c, g, or t
  misc_feature (474)..(474): n is a, c, g, or t
  misc_feature (487)..(487): n is a, c, g, or t
  misc_feature (497)..(497): n is a, c, g, or t
  misc_feature (522)..(522): n is a, c, g, or t
  misc_feature (629)..(629): n is a, c, g, or t
  misc_feature (691)..(691): n is a, c, g, or t
  misc_feature (696)..(696): n is a, c, g, or t
  misc_feature (720)..(720): n is a, c, g, or t
  misc_feature (732)..(732): n is a, c, g, or t
  misc_feature (770)..(770): n is a, c, g, or t
  misc_feature (837)..(837): n is a, c, g, or t
ctgccaccatgaggtatattncagccctcagttctgcttccctttctgagttccacaaaagccanaagtggacagccttgggttcncatcccagntggctgctccttctggggctgtctatggtggaggagaggagagagggggcagtnggtcccatgctgacncctgagcactgcaggggtnaggatnctcccgtggtccctgggtgtggctctggaananactggaagtacccggcnaaggnctcnnnnaggaataggaagttganggccctngctntgggtcntaanagaantcagccgcacccttaaaactttacancaaagggnaaggaagnagcattgggatggggcttccgtggagaagtgggggatgctgcagtggtacaaagaaagcctnncnnaangcnatcntccagnngaangtantncaaggccagcactgggcgtccaagggaaagaaggaactnagccnagagggtgtgggnaggagaggcntggagttaggcctccacccacagcnccctctgggtgccaagtggagaagggtgtaggggctggcttgggaaccttacccgctgcccttccaacacctggatctgtgggcagcggtcccacaaaatccccctnggggctccctgaggaggacttgtggctgccgcttccaccagggcagagggcacaggaggggncagcnctccaaagggctctagggtgggtntttcaaggacanctgcaaagccctggtgggggaggggcggcggggctgtnccacggaggggcctgggccagaggctctttggaatcttgcacttctgagtgggggactgtacatgcngcccacaa

SEQ ID NO: 482087 - DNA, 747 bp, Homo sapiens
gtttcttgatacactatttgtagttatgctgcagccacaattggcatggccaggaaataggctccagagtgatcattcatgcctcatgggatgctcatatcagcatggtcaagatttccactagaactatacacatgtagttatagtgacttgcgtttctgacctgagatgtatgctgcctgtgtattgcagtagcacttgagtgttcagattcttgttgccagttgcaaagtagccgttataaaccagcaatgtcatctgtgaggaagcgaatgctctaagtgtctgtcatttacgttgagttcttgttatctgttgtggtcttcacccttataccctggaagagtctgtgattaccttagccaggcaagatagatggtcatggcaggcgaacagcaccagacttactggctcaccaagatgatggaaaaacggcagatgattttgtaaaaagccgtaatgactcctttagaccagccatttagcgtggtaatatgaaaggcctagctccattgcagacttccaaagggtcagctctgagactgccctccaggtgggcagttgattatttccaccagtgtttaccagagccttaaactgtcctaagttgacaactacctcagttggcaggacagagacatatagtagaacagtgcacacaatgagcacgtatctcgggcagatgctcatgggttacacgttgaagggtccaacaggaaattttactttgggaaaacctttataccc

SEQ ID NO: 482088 - DNA, 810 bp, Homo sapiens
  misc_feature (534)..(534): n is a, c, g, or t
gaccacgctcatgctgctgtcactgcgttccgaccgagggcatggtgcctcagtattacgggagcagctctcttccttcggtttgacgaatgagagtgatggggaagaagaggaggagtctcatggtatgaggatgtggaagaagaggatgactcacgagatctcagggatagagcgtggatgaatgtccttcgtatacgattgacgaatggaaggacaccttgctgcctgccggtgggcggagactcatcttgtgaaccaccgagttgtggcccttccgttccagtacagtggataaggtgtcgtttgacacgaaggtagttataggacctgctcggaggtgccactcagcctgaactcgtgcgcgaagagcatagcccagtgaaggcgtcgtggcgtcatgctctacgcatgtgcagcgtgcactaaggcgctggtcaataggcatgcccactcaggatacccaaaacacgtgcgtgccttgtgcagggcctgcgcacatggtccctgaggtccgctgcacagtccatacangtgcacaggcatggtgaacccagggaagcggggacacggaccaggatgggtgattgggccagtcgctggacggcgccctgaccaggggttgactccggtcagctagacgggacccgtcatcacttgaaggccccactggggcgccctctgctgagcatcgtgatgagcagtcgctcaaacgcgtggtgactggcagagggaaggacaggccgtgtccacggatacttgacgaaggaggcagggaagacggaaagatgatggatcaggctggaatac

SEQ ID NO: 482089 - DNA, 178 bp, Homo sapiens
  misc_feature (162)..(162): n is a, c, g, or t
  misc_feature (169)..(169): n is a, c, g, or t
agttatcgaggcagctgatgagcgcccgtggctgtgggctagtctactattctaactgtagcccttcctgtgtccctggattatcctcttctgctgttctggaaaggaaacagaccagtggtactggagctataagcaaaactagatgcacctcaagccggnatgtganaggaacgag

SEQ ID NO: 482090 - DNA, 188 bp, Homo sapiens
tgaggatcccctaacgacgttggtcagttcatcaacatcatatcagctgccagagattagagcgctgacaagtaaaggacggttgtcagcgtcataagaggtgtacctccaatgaagaaataacatcacgggaacgctgcatgaagtaatcacgttcttggtcacgtatgcaagattatgcataagca

SEQ ID NO: 482091 - DNA, 421 bp, Homo sapiens
  misc_feature (385)..(385): n is a, c, g, or t
tcccctgtctccacaaaatatatgtttaaaaattagctgggtgtggactgaagcaggaggatcacttgagcccaggagattgaggctgcagtgaactatgatggtgtcactgcactccagcttgggtgacagagtgagaccctgtctcaaaaaaacgcaaagcacaaaaaaccacaacattttggaccagactacatcagaggtgatgttttttcatggcagaggacacatgctatctggatgtcccattattagtaactctagcatggaccactggcatggttgaagggggtctgatcccaccattgtaaagtcatgttttcctcctgcagtcggagaatatccagtcccccatcaactccatttgctagtttttgacaattgntaatccttgcctgagtcaataatttagtaattgcca

SEQ ID NO: 482092 - DNA, 158 bp, Homo sapiens
gctcgcctgtgttcaggcttagtagctggactacaggtgccgccctatgccagctactttttgtattttttagtagagacggggtttcaccgtgttgtgcgggctggtctcaaactcctgtactccaggtgatcccactcactcagactcccaaagtg

SEQ ID NO: 482093 - DNA, 536 bp, Homo sapiens
ccagatgtctcagcagatgcctgcgtcagcacattcagtccatccatacgatgggatgttactcagccataaaaagtaatgaaattttgacctatgaacagcatggatggacctcgaggacattctgctgagggaaagaagccaggcacaaggacaaatcctgtacgatgtgaccgatagaagccatcgagagtagggagattcatagagacagaaagtagactggagattccctggggctgggggatggtattttgcctcatgattgtagagctttgttttgggtaatgaaaaagttttggaaatagtggtgattgtgaatgtgtttaatgccacaaaactgtataaaatgttttaaatggcaagtttggttatatattaccataacaacatttaaattcttagtctttcatattaatacacatttttccaacaacaaagtgatcacactcctcatagtaattcaactcctgcctcatgtcacattaaactttcactgttttctcattaaatattattctttgaaacacctaaaa

SEQ ID NO: 482094 - DNA, 385 bp, Homo sapiens
tacaggcgctcatccaatctcacactcatcctacaccaggcacgcacatccaatcacacatcatccaacaccaggcacgctcatccaccaggcatcacaatcacaaatcatccaacaccaatcatcaactttatccaacaccagacacactcatccaccaggcatccaatctcaacttacatccaacaccagacacactcatccaccaggcatccaatctcaacttcatcacaacaccagacacactcatccaccagcacaagaacctgctcatcctctatgacgccaattggcaccctggaccgactctgtaggccaccacctcaaacagccggaatacatccagaagctgatgcccccactgatccagaagtgcgcctgggtg

SEQ ID NO: 482095 - DNA, 486 bp, Homo sapiens
atatacctaccgtggctacctctggtccagcctcgaggcatgcatttggggatgctggcacttctacacacagtcagttgtgagcctgggtcaggaaggtttctgtccacctctaatgtcccaaccatgccagcctagggtccccaacttggtcaaggtgctggatgatatgaattcaagcgctgtgtccccctacctccatctatggacttcgctctcccctcgttcactctgctcccgccacactgggctgtctgctgttcccacaacagtttgctatcgctgtggcttcttcagcctacagcgctcttcccccaaatatctgtgtgactcacttccttcaggtcttggctcagatggcaccatccgcatgaggccttccctgacccctccattaaaattgctgcccatgagcacaggacatggtaaagaaaacaaacaaaaaaatgaaaaataaaagaaagaagaaaaatttctgctcacatc

SEQ ID NO: 482096 - DNA, 205 bp, Homo sapiens
attgcatccatacgccgctgactgcatcctacgccgctggatggaacgagaggacagctccagagataagtctggaggtacacagatgatgatggtagttgtcaccatggtgatggatgatgtcacctggtggtggtaacctcatctgataaaaggacgctgttattcaccctgaatggagccagcggggggcgttggatgcagt

SEQ ID NO: 482097 - DNA, 270 bp, Homo sapiens
cccggggggcaccaccgttgctcatggcggcacaatggttgcactcgcctctttcaggttgtttaagatgtctctgcgcttcggttgcctctcatcatcgctgttgcttccttgtcagtctgcgggtcctcttcgccgccctctccattaaacccattaacatgcagcatcctcttctgcttcacaatggtgcttttaccagattctccagcacccagcagcatcaggcggtgcgtggcccggtagacctgccgagtccgctgcattgga

SEQ ID NO: 482098 - DNA, 251 bp, Homo sapiens
  misc_feature (127)..(127): n is a, c, g, or t
  misc_feature (234)..(234): n is a, c, g, or t
gccttctatagctctagtagatacacatgcagcatccgttcagtgagtcacctctaatcacacgatcataaggacagcatcatgcactgcagcatgcagctcaaaacgcttagcctagccacacccncacgggaaacagcagtgattaacctttagcaataaacgaaagtttaactaagctatactaaccccaggtttggtcaatttcgtgccatgccacgcggtcacacgatnaacccaagtcaatagaa

SEQ ID NO: 482099 - DNA, 190 bp, Homo sapiens
gctggccagcagcatccccaggcttccctcaggcgtccgtgttcacattttcctccagcctgagaccgagccttccgcctggaaggccctgtgccagcaccaggcagagggcaagaccgagagggcagagaagaacctgcacctgtatctcacctggagtcttaatctagacatggtattccccgaggtg

SEQ ID NO: 482100 - DNA, 257 bp, Homo sapiens
acaggatctcggcactgcttcggatgcggcatgagatatacatctggatgtgggtttgaatctagcgctgaccttaagccaaccacttctcaactgtaagatctgaataatacctactactgtgcagagttgtcaacaggagtccacttacgagagggacaaatgtgcttcagtgtgtgggcctcgacacagctctgtgttccaggtaagcaagtggcttcctactctgcccctaccatccggaagcatgttgcctg

SEQ ID NO: 482101 - DNA, 387 bp, Homo sapiens
tagagttatccccgccatgctgcttcagcgatggatagatttggatcacaatgtctatgtccaggtattcatggccacgaacagagtcagacaccctggatccggccctgctatcggccaggacggctggatcgtataattgaatttccacttcctgaccgccggccgaagagattgattttctccactatcactagcaagatgaacctctctgaggaggttgacttggaagactatgtggcccggccagactagattacaggagctgatatttactccatctgtcaggacagtgcaatgtaggctgtccgtcaagaccgctacacttatcctggccacggacttccagaaagcttaccatactgccatccttcaagaacagcatgg

SEQ ID NO: 482102 - DNA, 381 bp, Homo sapiens
acattcaataacgtcatttaagttgtgaagggcaatttgaccattatgtcaggattttcacagttttctcattgattgggaatgacatgaaattggcaccaggattttcacccactcatattgggaggctcaaagatagctgccccataaatggtaatactaactttgctcatttgattgagatgaagtttggcagcttttacctttgtaatttcgcctcctctattcctaagaaacatttcatgaaagagtagaagctctgaaattcaataaaatcccactcttcatacctcttttcctcactctaagttttactagttattgtcagttaccagttacattttaagtcaaaacggccgcgaatttagtagtagtaggcgg

SEQ ID NO: 482103 - DNA, 191 bp, Homo sapiens
tctacaagaggcaagtatttccaaacagcagtaatagctccttgtgccccagccccacttcatatatctatacagtctgtctatacatttgtgctgaaccctttacttaccagtgtagccttggaaactataaacagaattgagcttttggttttctcatttccacaaaagggggttataatacttattcc

SEQ ID NO: 482104 - DNA, 840 bp, Homo sapiens
atgataggactgcgaggcagccaagaggtgagcctctcagtgcctctgtgtgccccttcctctgggaccaccactttccatcatacacacaggacacgaggtgaatgtctgggtggcctggctataggagccagagagagccagggtcaggggccaaagaggaagctgctggggtctctggacctgcaggaagaggaacgaggaggcgacgcacgggccccaggtgcccctgagccagcctccagaggatgagctggataggctgacgaagaagctggtccacgacatgaaccacccgaccagcggggagtactttggccagtgtggtggctgcgagagacagatgtggtatggggactggggctgggcgttgtggcccattgcatcagcagtcatttcacagtgggctgcttagtgtgttctacatgccgaggccagcttcgcggccagcatatctacgccgtggacgacggacggcatattgcgaagggctgctacgtggccacctggagaaatgtgccacgtgctcccagaccatcctggaccggattctgcgggctatggggaaggcctaccatccgttggatgcttcaacatgcgatggtgtgtcacccgcggactcgagggggaattccgcttcaccagggggattgctacgaagcccagatccactgcattgacggcactgtgcaccagggacaagcctcggaccccaagaatgcctcagctgtagccggacagcggccccaaacaatgagctggaacccagagtcaagaagggaaacacggcgcagaagtcgggtgcgccctgcgcacacgaaagatcgacacaatcggacg

SEQ ID NO: 482105 - DNA, 92 bp, Homo sapiens
gtaaagggttgggggttggtgggctgtcccggagcgactgtcgagatcccctagtatgttttgtgaacccaaataaaattgatttactgtct

SEQ ID NO: 482106 - DNA, 1309 bp, Homo sapiens
aaagaggaactgcacttccggtcacgccatcgttgcatgccttcttcgctcaaggcccccaggctccgctcttgccagcagggacagtcgagccatggctcataaatatgagactgtgagtgcgggtccatcctcggcttccagggtgacgcctaccgtcagaagacagcgcacttgcttatcgcagaccttgcatggaggcctcatcctagatctccacgaggcttcctaggctacataacctacgacacccgcacgctgctttgtccccgagagcttcacgagtccccaagttgtcaatgagatcggttgacgattcaggtttcaccagtctgccgataagccgtagagtcgagtccctttaaagtccaggaagtgccactccacggaacaggcctcaacactgggtgtcttagtgacttctcctgctaaggtcgtcgataatgccaaggaactgtgcaccataatgacgccagcctcaaggagcagtgccttttaagctgcccataacactgtcatacaccctagaagggttcgcaagaatggctggtcctatgaatttcttatccccaaggacaggcaaactcagcttggatgtacgcttagccctgactacatcacacggtactgagcattgtgcctttcaacggctccccacgtaactgcccacgtactaaaagctgtggtcccacatattgccagcactacgaaatttcatctcaagtactctcagatgccacattgacctgggcgcaacagatacggccataaagaactccccttttcaaagggcttgcgacatgattaccagcataatgtgtccccagatagggctgattaacccaggatccaggaatgtactactcaggcgctgttaaattgtgccacttttccccaggggttcgaccactaggaagaaccggacccaagggctatctcttgaacccttgatccgtgtgcatacttgcagcgtgaccatccaagccaggactggtctcccaaggacttcagcaattcttggaagtcccggggacaaataaggttctgctgggccaaggaagcggaaccccgcgcacagaaattaactaaaccttggaaattggttggacggccaagaagctagcacgtggaagtgtatcaacgatggtgtgtcacccccacctgtgagctggccaagggaaccatgacacaggctctcatgcgcagccacacttaaccacggtgattcacactccgcaaacgctcggtgtgtgtcaccccctcatcactgatgctctacgtcccaacacgccccatcggccatacgaca

SEQ ID NO: 482107 - DNA, 1436 bp, Homo sapiens
  misc_feature (115)..(115): n is a, c, g, or t
cgcaccccgtcgaactctcgcgagaggttgatctgcgtgtcgggacgtgcggaggctctcactttccgtcatggcgctgaaggtagcgaccgtcgccggcagcgccgagagggtnctgctcgggccagcccttctctgccgtccctgggaggttctaggcgcccacgaggtcccctcgaggaacatcttttcagaacaaacaattcctccgtccgctaagtatggcgggcggcacacggtgaccatgatcccaggggatggcatcgggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccagagctcatgctgcatgtcaagtccgtcttcaggcacgcatgtgtaccagtggactttgaagaggtgcacgtgagttccaatgctgatgaagaggacattcgcaatgccatcatggccatccgccggaaccgcgtggccctgaagggcaacatcgaaaccaaccataacctgccaccgtcgcacaaatctcgaaacaacatccttcgcaccagcctggacctctatgccaacgtcatccactgtaagagccttccaggcgtggtgacccggcacaaggacatagacatcctcattgtccgggagaacacagagggcgagtacagcagcctggagcatgagagtgtggcgggagtggtggagagcctgaagatcatcaccagatggccaagtccctgcgcagttgccagagtatgccttcaagctggcgcagtgagagctgggcgctagagaaatgtgacggccgtgcacaaggccaacatcatgtatgtcccctgacctctctgcgagcagtccagaagcagctgcagtggcctgcttgggcctgctctgagggatttggtggtccaaaagcccagctagccacgcgaggtgcgcaccgctaggcgagtgcgcctgttgccctcgtaggccttgccgagaacccacacttaggggaggtggggtgggattctgtccattttgctggtgagggacaggttagaattcagacacccgagactccatggggcccatctgtcacgcccctgtcccgtccggctgactgttatcgatgggcaagctggtgtcctattcctaagcccccaacaggaagctgggcgatgggcttctactccagtgctgcaaggaaggtggcggggccgctagcctcagatacaccttcgagaacatgactgtggatagcaacaccatgcaggtattacgcctgtccagtgctgtacccctgacctgagtgccctgggcttctctcaaccatgcttccgaatctgctcctcagcaagacccctccttgtccgcagctggtgtccg

SEQ ID NO: 482108 - DNA, 316 bp, Homo sapiens
cactctattgctcatcgacatctcaatgtcttcttcctgagggatcctctttgctgctgataagctgtcctagggaccagtggagagggcaagggaagggggaaagctccccgccattgggcggtcaccccagcaggaactgtccggtgcaccagctccatcagtatgtggagggctttctgttgcatgggctcttgccagctcatgtcattcggttgctgcttaagcctcatgttcaggcccagcaggacttgcagctgttgctggagctgctggagaagatgggactctgttactggctcaataaacccaaggg

SEQ ID NO: 482109 - DNA, 772 bp, Homo sapiens
  misc_feature (281)..(281): n is a, c, g, or t
  misc_feature (493)..(493): n is a, c, g, or t
  misc_feature (604)..(604): n is a, c, g, or t
  misc_feature (653)..(653): n is a, c, g, or t
  misc_feature (665)..(665): n is a, c, g, or t
  misc_feature (682)..(682): n is a, c, g, or t
  misc_feature (772)..(772): n is a, c, g, or t
agaagcaccacgagaagcggaaacatcagccagtaagatgggaagggcgtgcggccgtgtggttttcagcctgatgtctcaggattggctgtcctgaggaagacacggggcatcactgcctcgtctgtatgtcctccctaccactgtgggcacaggagcagctggcgaagctagctagcatcaacgatgtgaggcacggtggctttgacttcgcagggcctgctgaatgtagtgtctgccttaatccgtacagtgacactgtcgagtataggaatcgtctncacctcagcagtgctcaagaggttagggagcttggccttggtcctatagccaggaagcaacagagccaggagttgggcccttgggcttgtccactttttactggttccattatttcatgctaccaagttgaggtagctagcaccaagccagagagttccgtggagaaaagatgataccttttttggaagaaaagacaggtcctctagactangaggtgagattggtagaaacccacatcagaggtcagtacttgagtctctctctcttctagataccgtgatacttctcttaagcccattttcagactctgtaaaacatagtnatacttaacaagactggttgcaaagcacatgagacaggggatgcagaanagccttattaantaaatgctcgtccgganaaaagattggaaccttggtctgtgcgacaatattcaagttacttaatgggggatttgatatgggagggcccttacaattaattgttacan

SEQ ID NO: 482110 - DNA, 174 bp, Homo sapiens
ttgctggtttccaacataaccctgggcgaaaatgtgagctccgtgtacccgtgtgcgaggtctgcacgtgtgtgtgtatgtacgtgcacctgtgtgtagctgtgcgtgtatgagtgtctgtgcatgtgttgaatgtgtggggggtgttatgtgtgcatgtgtgatgtatgtagc

SEQ ID NO: 482111 - DNA, 1555 bp, Homo sapiens
  misc_feature (743)..(743): n is a, c, g, or t
ctgcattgatgtgctcgtatttggttgcgtgaccttggtacctactttttgttgaatgctggcatgcttgatgtgactgacttcctgtgctgactactggccattgtggcctgaccgaaacatgcccaagtggaacgtgatcgtcaatgaacttgatgacatcaatcctgactcattactttacactctttgacactgtgttgtgctggtggtgccatgtgacttgtgttccttcgttggcttgccatggttgtacagctggaacttacacgaatgtgccattaccagcacagcgtctgagcgtacagatccttacaccttggacacagtgccctgtaattatgtgtttgacacatccgtggaccagtgtcgggcactctttgtgtcagagtttggaactggtgcaacggacttcaactgcaagttttcctcccggagctcttctttggaccctgttgttgtccaaagctccaataatttccaaaatcttggacagaagcgaggtgaagccatacagcgctcttttggctaagcaatggcgatcggtggaacgacagcttgggcgcactggtgaacttggaaggctgcaattaaagcaaaaggtttcttggaatttggtttgggtaatcccccaacaggctgaatggaccgagctgaaactggacggtggcaacggtcggctttgggataccgtataacctctttggtactacgagccacatcgtcggtctggaacagcagcnccttgttggagcgatatcctcccagtttcttctaaagcgtttaccacgagcgtggtaagctacctcgattacggtttggagctagtaccgtatcgtgttagagcaatagctagtaaagccttctaagtatagcgaacacttgtaagaccacttttctccgttcgtaaagagtgtttttcatggccaacaacaaatgacgctagatggggcgtcagaagctctctagtgtgggggggaattgttccttctagacctcgctataccagcacgtttcacacctttggagaagctggataaagccagtatcaagcacagcgggtgatctagctttaagagtggctagtagtcattagcaggtttcagcataaaggtattttccagtttatatctacgcaagagatttgttcgtccagcgcccgcccgccgttatttaccagctcacaacaggtttccgctccggttgttagtagcgtttgggctcaaccgcagctttacacaacgtggtaaaaaccgctggtgggattcagctatacttgtgcgttgggctcaaccataacgtggcccaaggtattagatttagtggtgccagcatttgatcgttctccagtgtcagctgagctaatcttaatcacataatctaccgcactcagtgatcagtgacgagccggctacccaacaacgtagtttgcgtacataactggtgatttcatagcatgaactcgatttgggctaaacccaatctttcagcaaagatctgtgtgggtgctacagatacaacgctcgtctgtacaatattgtgctagctggacgac

SEQ ID NO: 482112 - DNA, 321 bp, Homo sapiens
ataaagatagatcaaataaaagccatattctagttcatgtaaacaggccaagagaatcaacagaagtcattatcattctgataaaactagacatatgatgccaatatagcactcacaaaaatggttaaaagatcatgactaagctcgcctaccacaaacttgactggttttaaagtaagaaggtggtcaaacagaactgcatttggatctttcaatgctcgtacaatacacctgtgggcatcaactcgagcctgggaagcattgtcctctgtgtaacttccgagcaattccaccatgacttttgaagcagcaccaccagga

SEQ ID NO: 482113 - DNA, 373 bp, Homo sapiens
ccaaaatggtgggattacaggtgtgttggcccaccgtgcctggctgattaagcattttttaatcagggaaggcccaggtggcacttcccaccctccagccttttgggccctcccaattggattaatggggagagcctggcacttttgacaagagtttctcataaaataaacaatattcttataggcttagacttagattacaattaaccacaaaataaactgcttttaatcaaactcaggtttttttaaaaacctaatagatttttctccccccacttttgtcctactcctcccctaatagctttaaaaaaaaaccccccccaggagagaacattgggagagacagcaccttaggggggagaaaaggcccctt

SEQ ID NO: 482114 - DNA, 130 bp, Homo sapiens
ttactctatgagatccccgtttgctacgatcatgctaggcacttataatgctggattacaggcatgagctatcacaccctgtcctgactagcatccattcctaaacccgccttttcacctcattctttag

SEQ ID NO: 482115 - DNA, 630 bp, Homo sapiens
cgacttgggaagaatctgtccagggtgcataggagtgaggtgtggtgtgtgtggatggatagtgcacagtgtgcatagctttttttctttgttgccgtgaggcaccaggtgaatattggggccatttttctaccagaagccagtccagccttttcttccgccgctagtatgacgaggagacttgggcctcgttaaagcctctaaggcccactcacacagttatacttccacgcctggaggaggaagcctcagcccaacacagctggtggtggcctgagagggtggccactggtgggaaaatgggcacatgaggaaatataatacctcccccaattcaatctgaggcgccagcacggagaggatggtagggttgccacgggctcagaagtgcaagctgagttactcaccccaccctgcctcgccgcacctttgcctttgtttccttggggtgaatggcaggaggcaagcagtggctcgcccttcccacacctggacaatggtgtgtgtagaaaaccaccgcctggatgtttgtggtggggcctcatggtgcctaggaggagattaagatgaggaggtttttccttattcgtataaatgaatatttgtatgattcaattacacacaccccca

SEQ ID NO: 482116 - DNA, 527 bp, Homo sapiens
  misc_feature (85)..(85): n is a, c, g, or t
agacaggatagcagaagatgcgatcctaccgatgataaatcgaatgctgctgctatgtgatcatattcatcgtcagtcactcagnaagagcacgaccaggggctctccaggacgcatgacattgaatcttgttcccatcgagcagctttcagtccacatgtgcatattcgctttccggtacccagtcaaggccagagctcttttgcttccaccgaggttggaagcggacgtcgtgttctcatctcgtacatcttcctgctgtgctaaatataacgggctatcgtttttgctaatgtttccccattccgttctagagccttttgaaggtcttcatgctttctgttcacaattgcaaagtcttataagtatttcttttccaggttttggggtttttattgtgtctttttccagcctgagcctggcaatttcatcttgcatcaagcggttttcatgcagcaggtcttctttttcatcagtttcagaaacctgattggaattatttcctcctgtcttcaatcccacctctg

SEQ ID NO: 482117 - DNA, 1254 bp, Homo sapiens
gcacgcatttttcagggggcctctccaagtgtgagtagttagtaaggaaatgttgtttaacccgtgcacgtatccgtggtatatgctccataatgggggactcactgctggctccgacatcaagccgtgcctccttggaagagatgtctcattagtggctacatagctcggtgacatcattggctatcttgcgattcttggggtgatctctcgaagggttttttaagtagtagtctcttttatctaatttaagctcatgagtttattaaaagcgctttatgggggcctataacctgtggtatggcacatgataatggccttctgcgggtatactactgatattgaagaaatgggtttctcccccgttcaggggatttgtcacaggaggtgtcgccactgtggagagcttttgtgtgctccccccacttgtttgggaagaaacccctttgtgatgtaatatgggtgatacctccccctttggggtgttccatgccgcccatctgtgctccttgcgcaattactatgcaacacacacaagcgttggggggacgacctctctaatatgatattcttgtggatcaccttgttggggaaagtgtgtctcttctcccgtgaggaagtttctctctatatcgtaatctcgctccctgggtaagacccttctgttttccctatacacccaccagtgttttttctcccgagggaggatgaaatcttggaaacacacctctctcgctgggagagttttgtccctaatgtccgcggaaacctcggagagttttcttgtgagagtttgttgttcaaattccacgcccacccacgagattgagatgtctgaatatctcggagagcttgtgatcacaaatatttgaacctctacattgccgggtttctcacaaccacttattgtggggcaaatggcggtgaatggagacacctaacacccaacacatttggtccctgcccaccaacggagcaccacggccacatgggcacctaactttgtgatgaccaacacgcgtgtttccacctcgtgtcacatgaagaatcacgattcgaggttccaaaggcaagcctatgtgtccttgtgtttgaccacaacgtccacggaactgggcgcaacccctgcttgtgtccccggccggcttattctggcagcacaccacacacattcacctcgccgtgtcagcgtccccacccccagacttctgagttcatggatgtttaattgagaacctgggtccatccacaaga

SEQ ID NO: 482118 - DNA, 307 bp, Homo sapiens
ctctcaactctgacatttgacatcaggtgatagagactcttgagatgcatagctatatgggataaatcgccaggggtacacgcaatctggaagatctcccaagtatgggggaaggtttcagccatgatgaatcccatatcctctaatctgggacacgggggaggcgagtactgtctcttctgcagaccatgtccccagggacggcctggtgtcctcctggaaatgcataccagggacgtgacctgagctcaaacgtgtagagacataccagggcaattgggagcacaccaagagtagcatcttaaac

SEQ ID NO: 482119 - DNA, 963 bp, Homo sapiens
gtgcttactttattcacatattgatcaaataatctgattgctgtttacatcttgctaatgcatacgaggtcttttgaacaaatcttgcactcgtaactttaaactgcagagacagccacagcaattttatcttctcactgggaaactattttctccatatgtgctctcgatgatgacaggcctttttccatcttgcggctgttcttccttgggggaatagacaatgtaacggaataatttctgactttgatatttgctgtcctactcacgtaccactgcagtttaccaacactacctacaaacttgccaaacaatttactttctaaaacctacacttggcggaaaacaagaggcacccagcgaacgcacgaaggacgactcttaccaatactacattcgagaactactctgtgacgatatccgcacggctgtgattcactaattctcctgggtgcataacattgcataaagctacatatatgcgggcttggttaaggcccatttctaagctacaatttcatacacttctgcagcataggaagtaccatcggtaagcaacacatgtatcttctatatctcacatacattcacacgttgtcatacgtcatcactattctcgaacaccatgatgggtgtactgttcactagtttaccactgacccagtccataagaacagtagctattaacaccacttcagcaattcccagggggcttaatcgggcttggacacctataactcgtgcacgaatggtcaaacccctaacacgggctttgcccgtcaatcccgggactttttcggcaccctcacgacctaagctagcatcccccctgccctgtcaggccttataactccccaactttacttaaccgggaagcccacgcgcaacggccacaaacggctccttggtccacaggaccataaatattctacctcgcccggcacctggccctcaccgatcaca

SEQ ID NO: 482120 - DNA, 1008 bp, Homo sapiens
  misc_feature (863)..(863): n is a, c, g, or t
ggcagcggaccgggcggactgacgggcgcctccaccttgctaccctccctggctgccggcttccttttgtctttctgggcggcgatgagcgcagggccggcgcagaagctgcggcgcaccggagcgcccggcgctgcttaagtcactcctcccggccctcggcgcgctttgtcccggggcagcggccccgggccccggctagacagcccgccgccggccccccaaaactttggccctccggggaaagccggggcggaaacagacgtcctttgacccggaaccacagggccattggccccatagtgggccccaagtcacacggacgcccggaaaaccacctcccccggacaggttccgaacccaacttcccagtcatcagcccatccaggccggtggcccccgggagtggatatcgcttcgcaccgcccggaccaagccgcgcccaagtgggcgccacacacaggccacaagccacgcgcgggcgcgccccgagaagggggcctgcacgcgcaccctgccgacgcagaaccacgcggacgctctcagccgaccccagcgaagcctgcccggccgcctgcccaccacgcggcgctccactaaagcgaacctgcccccaaagcggcccacccttgaccggtgcacgcaacttcccagcaaagactctctcccgccgcacatcttcctccccccctaggcggcgcaccgcctccccagcttccgccgacgcacagtctttcccggacacctttcgacagaccacacggacgacgcgcacccaccgaccttcgcggcgaacttacatcatcgcccctgatcagtgaccttcgcggcgcaacgtgactacagcagctaacgcgtgcgcnctccagcatcttacgacctggcggcggcgtgctcatcatcaacgcgcagccagctgccgagcaccgtcgcagccatcccacgacggggcgtccctcgcgcagacgaccgggacagcacccctgagagcgcacgccattccagaga

SEQ ID NO: 482121 - DNA, 125 bp, Homo sapiens
  misc_feature (13)..(13): n is a, c, g, or t
cctgccctgtatngtggtactgtcaggaacgctattgtgttcgttgagcctggtcgtgaggaatctaccaccgtctacagcaggcagtgagccgtcgtaggaagtgaagcggtcgtaggcagtga

SEQ ID NO: 482122 - DNA, 395 bp, Homo sapiens
ggtgggtagatcacgaggtcaggagttcaagatcaacctggacaagcttgaacccgggaggcagagattgcagtgagccgagatcatgccactacactccagcctgggcgacagagtaagactccgtctcgggggcggggcaagcaaatgaaacaagatggacaaaaaaaaaaaaaccggattgatcaaaattaatgggctctaactggattcattttgccatggtttcccccaggccctcaacagtcactttagagacttcaggattgcaccacacagaactgattaaacaatataccacacagaaattgacttgtttaataccaccccttccctttgcccttctgcctccagcatactcccttaaaatagtacaggcagggtagatctaacta

SEQ ID NO: 482123 - DNA, 558 bp, Homo sapiens
  misc_feature (50)..(50): n is a, c, g, or t
  misc_feature (63)..(63): n is a, c, g, or t
  misc_feature (93)..(93): n is a, c, g, or t
  misc_feature (104)..(104): n is a, c, g, or t
ccccatttccggcattttccaaaacggggatcccaggtatagcccagatntgcattgcatatntgcccattattagccctgttttgaattccntaaagatagtncaatgcagctttaaaaaaaagaaactctacccagatctacattttgcgacagaaaaggcagacacaggtttctttgaaatgaagcttgttgtctggaatctttctttgtagaaactggtttagagaaagtcccacatctttttcttttttttttttgagatggagtctcgctctgtcacccaggctggagtgcagtggtgcgatcttggctcactgcaagctccttctcccaggttcaagccattctcctgccctcagcctcccgagtagctgggactacaggcacccgccaccacgcccggctaattttttgtatttttagtagagatggggtttcaccgtgttagccaggatggtcttgatctcctgacctgatgatctgcctgccttggcctcccaaagtgctaggattacaggcctgagccattgtgcctggccaaaagtcccacatctt

SEQ ID NO: 482124 - DNA, 823 bp, Homo sapiens
cagatctcaagggctgatacctgaggcaaggagagctaaggggagagaaattggggctgagtggaagcagatgcctgcacaaggccaatgtgtgtctctattggatctgtacaagctgatagaaggaccatctgcgtgaaatccaggggctcctgagttggtgcggtttgcgttgtcgaaagcttcgtagggacaagggcgcaagtcaggatggaacgggagagggtccaggggcttccatatagtgccgccgcgatcacctgtcgaactcgctgcagtttcaagatgacaggtggaagctgctctttagcctcgaaaagcacaaagcagaattgcgcagatttcacatgtctcaatgagctcgcaagatcctttggtctgcgtgtccttttggcaccccggtaaagctggactcgggaacaaatgttgttacagtagttttccgataggctatcaggacataggtgccatcctcagcaggcctagcatcatgtcatgtgatcaggtgctttgctggtggggatacaatgacccatgtggtctgcgtcttctgccattggcttgaactgggcaccccctgaagtctccatctcagctgtatattctagtccaaattttcctggctcccctggtccctcccaggtcctgcacactgtctttttgccaacacctcagccctgttggctatttcatgtctgcatggtacgagacacccccttcacagcatacactggccatggtatgtacatatgcatccacgtgtgtgtatgtgtagcatgtagctcattctgctcagcctctggggccgtttcacatttgtcca

SEQ ID NO: 482125 - DNA, 153 bp, Homo sapiens
cctgaatgtgtggtgtatggctcagtaaactctgtccttgttaattttataataaaaggttacaaagctctgtcaacggaccgtagctgatataatccagtggctgaatatatttccttcctttgttcgttctcaattcttgattcaatccac

SEQ ID NO: 482126 - DNA, 407 bp, Homo sapiens
taccacacggaccagatgtggtctggacacactagaggaagttaaaatcctttgccaacctaagcagtaatccattcctcagtgcagcagaagcaggaagaattcccataccccagctccacctagtctactatggtcacctttcccctacaactgcctaagcccaagttgcatctaaaggattggcccagggcccaccgcctctaggcttcttacctatgtagctctgcagttgtctctgtaggcggggaaagaaggaagatgatggtccgctccctggcctgaagcatcctgacggtaggacacgtgaatggcacccttgccaagcagagtagggttgacacgcagatgctgttgctgctcaagtcaagcttccggagccgtggttagtgagggagaacaccacc

SEQ ID NO: 482127 - DNA, 132 bp, Homo sapiens
ctatctgtctgagatgggggtggtgggcagtatctcatctttgggttccacaatgctcacgtggtcaggcagggtgtgctgggcattcaaggtgaggatcatgctgccctgggacccaactggtaagattgg

SEQ ID NO: 482128 - DNA, 713 bp, Homo sapiens
aatgctaatgcccatctgacatcagagacagggagtgctccccagacctctcacagcaagctggatggacaggcagggccagaagagtcctccagccaagcctcctccttggttcttgtacccaaaggtagagacaacgtgcaggtcttcttgggtctgagcctggggcagggcgttctggcgtggactgaatagaggggcagggaagcagcagtgagcctagatgaccacagtgctgagctggagcccacatggttcctaacggggcagacacaggctctgaggaccgatgtgaacagttggaaggctgacagtgaggtctcagcagtgtggtgcacccctccccagcacatccgagtccctggggttcccagtgctaccataggtagctgcaatgatttcccaaggagacatgcaccagttaagcctgtggcctgaccctgtacaaccggcaaaccatcaccgagccccggccagtgcttgtgagaaggacatgcgtggatcaagaccttgtcgcttgacccatctgcttctcagatggtgctcccatatcaccagaggaagttgctgtcagcccactttccagactgccccacactggggctctaagtttcaggtctgagattttatgctctgtgatcccccacttggggttcccaactcaagctcctggtcctggttcgggggcggaacaacagcggaatcggaaaggg

SEQ ID NO: 482129 - DNA, 355 bp, Homo sapiens
ccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcaaaaaaaaaa

SEQ ID NO: 482130 - DNA, 185 bp, Homo sapiens
accaaaaccccttttaaaaggtaccacctggttttcccacccctgggaaattggccaaaaaaggcccccattattttttcctcccttattaaaaaagttaggttttggtttaaacccgccctttaggggccaccaaaaggtaggtttttttttttttttttggaaccttaggttcccttttctta

SEQ ID NO: 482131 - DNA, 830 bp, Homo sapiens
  misc_feature (707)..(707): n is a, c, g, or t
ggagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgcggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggccacaacatcattccaagacttctacaatccgctggtggcctccggggcagaagcgggagatgggtggcctcgctctacgtcnggtggggccgcctccggcctgctgctccttggcggggggctgcgttgctgcaactgtcaccccgcacagacaactactccccagtattctctgccgctctgctgctgcagaatacgttaagtg

SEQ ID NO: 482132 - DNA, 277 bp, Homo sapiens
tacaaagtcatgatgggtggtgcttccaagttcacacacttacttggatatatttaatcatattcaaccactcacatggggctaggttaagtcatagctcacctggttcccttacggctcggcagcagatcaccggccggtctctttccaagtctaaagcagacaaacaaaaaacaaccaaacaacaaaaccggtcctaaactattcctcaaacggcctcagtcagtccttaaacggtgtctcacgcgatgctatagaaccaatcaacatagggtac

SEQ ID NO: 482133 - DNA, 1163 bp, Homo sapiens
  misc_feature (67)..(67): n is a, c, g, or t
  misc_feature (604)..(604): n is a, c, g, or t
  misc_feature (628)..(628): n is a, c, g, or t
agcccagtcgccgccgcccgcccacaaagccacaggcaggtgcaggcgcagccgcggcgagagcgtntggagccgagccgttagcgcgcgccgtcggtgagtcagtccgtccgtccgtccgtccgtcggggcgccgcagctcccgccaggcccagcggccccggcccctcgtctccccgcacccggagccacccggtggagcgggccttgccgcggcagccatgtccatgggcctggagatcacgggcaccgcgctggccgtgctgggctggctgggcaccatcgtgtgctgcgcgttgcccatgtggcgcgtgtcggccttcatcggcagcaacatcatcacgtcgcagaacatctgggagggcctgtggatgaactgcgtggtgcagagcaccggccagatgcagtgcaaggtgtacgactcgctgctggcactgccacaggaccttcaggcggcccgcgccctcatcgtggtggccatcctgctggccgccttcgggctgctagtggcgctggtgggcgcccagtgcaccaactgcgtgcaggacgacacggccaaggccaagatcaccatcgtggcaggcgtgctgttccttctcgccgncctgctcaccctcgtgcggtgtcntggtcggcaacaccattatccgggacttctacaaccccgtggtgcccgaggcgcaaaagccgcgagaattgggcgcggcctggtacgtgggctggagccggccgcgcgctgcagctgactgtggtgcgccactgtctgctgatcctgttccccacgcgagacgaagtaacgggcaccagggtcgcatacttcgcgacaggctcacccggccgggaaccacttgcaacagggatcagaacggcagggaactcgttcagaggtccagacccctggagacaccccccaccaccacgacaatccagagcccaattcacacaacccggaaatgctgcgacccgggcacaacacgtgaacaagtcagagcagacagccacgccgagtcacagccgcagcgacagtgaaatcacgacagacaagtgaccgacagaagttctgaggccgccagggctgagcaactcgcctgcgagtgcaacacgatccgatcgccagtcggcgtccgcatctcaagacatgagagtgataataacagcatcta

SEQ ID NO: 482134 - DNA, 338 bp, Homo sapiens
gaaatgaatcattatgctttgtttaaatgttacatgttcctaaagaactgtggtagtggagatatacttttgaagattgttaaagtggaacatgaagaaatgcctgaagccataaaatgtgatagctgtcctcgaagaattgatgcaagaagctctcgaccagaagttttgatatacgttttgagataatcgtatgatacaagttgtatatttaagtcttagtgtttgaaacttgcagttataattgttaatacagattgacattgtaagatgatttgaaactcaatggagattttctttttgtattttacaaatttaacttaaataaaaaaatatgg

SEQ ID NO: 482135 - DNA, 608 bp, Homo sapiens
  misc_feature (67)..(67): n is a, c, g, or t
agcccagtcgccgccgcccgcccacaaagccacaggcaggtgcaggcgcagccgcggcgagagcgtntggagccgagccgttagcgcgcgccgtcggtgagtcagtccgtccgtccgtccgtccgtcggggcgccgcagctcccgccaggcccagcggccccggcccctcgtctccccgcacccggagccacccggtggagcgggccttgccgcggcagccatgtccatgggcctggagatcacgggcaccgcgctggccgtgctgggctggctgggcaccatcgtgtgctgcgcgttgcccatgtggcgcgtgtcggccttcatcggcagcaacatcatcacgtcgcagaacatctgggagggcctgtggatgaactgcgtggtgcagagcaccggccagatgcagtgcaaggtgtacgactcgctgctggcactgccacaggaccttcaggcggcccgcgccctcatcgtggtggccatcctgctggccgccttcgggctgctagtggcgctggtgggcgcccagtgcaccaactgcgtgcaggacgacacggccaaggccaagatcaccatcgtggcagaagcgcgagatgggcgcgggcctgta

SEQ ID NO: 482136 - DNA, 387 bp, Homo sapiens
gagtcacgatttccgtggttcgggaaaatagctatgttgcataaaaatgtacttatagtaacacaaaacgggttaatcctggtattttaggtaaattaagacatatatttcaacgtgttctaaattttaattttctttttttttagacagggtctcactcggtcactcaggcgacagaatgcagtggcacaatctgggctcacggctgcctcgacctccctagactcaggtgattctcccacatcagccccccaagtagctgggactacaggtgcacaccaccacgccgggctaattttggtatttttggtagaaacagggtttggccacatggcccaggtgggtctcaaattcctcagctcaagcaatccaccgggactagagggg

SEQ ID NO: 482137 - DNA, 164 bp, Homo sapiens
agcttcataccacacgtcacacatcatggcatccccagccattaaccagctgcaaccagcagcacatgtgcatttttcacacattacttcagcgggcatgcatcaacagtttgtgtcagcacacctgcacaccacttcacacacattcatttcacacacacctg

SEQ ID NO: 482138 - DNA, 649 bp, Homo sapiens
  misc_feature (176)..(178): n is a, c, g, or t
  misc_feature (183)..(183): n is a, c, g, or t
  misc_feature (185)..(188): n is a, c, g, or t
  misc_feature (190)..(190): n is a, c, g, or t
  misc_feature (192)..(192): n is a, c, g, or t
  misc_feature (196)..(196): n is a, c, g, or t
  misc_feature (198)..(198): n is a, c, g, or t
  misc_feature (205)..(206): n is a, c, g, or t
  misc_feature (236)..(236): n is a, c, g, or t
  misc_feature (257)..(257): n is a, c, g, or t
  misc_feature (271)..(271): n is a, c, g, or t
  misc_feature (283)..(285): n is a, c, g, or t
  misc_feature (312)..(313): n is a, c, g, or t
  misc_feature (342)..(342): n is a, c, g, or t
  misc_feature (359)..(359): n is a, c, g, or t
  misc_feature (361)..(361): n is a, c, g, or t
  misc_feature (406)..(406): n is a, c, g, or t
  misc_feature (415)..(415): n is a, c, g, or t
  misc_feature (428)..(428): n is a, c, g, or t
  misc_feature (476)..(476): n is a, c, g, or t
  misc_feature (481)..(481): n is a, c, g, or t
  misc_feature (485)..(486): n is a, c, g, or t
  misc_feature (490)..(490): n is a, c, g, or t
  misc_feature (494)..(494): n is a, c, g, or t
  misc_feature (513)..(513): n is a, c, g, or t
  misc_feature (516)..(516): n is a, c, g, or t
  misc_feature (529)..(529): n is a, c, g, or t
  misc_feature (537)..(537): n is a, c, g, or t
  misc_feature (544)..(544): n is a, c, g, or t
  misc_feature (548)..(548): n is a, c, g, or t
  misc_feature (552)..(553): n is a, c, g, or t
  misc_feature (558)..(558): n is a, c, g, or t
  misc_feature (591)..(591): n is a, c, g, or t
ggagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttnnntttgntnnnnangntgtncntgattcnncccttggaaggccttttggcgactttccanttgcagtgtgtttggttgganttacttgtttggtngcctggtttgcnnngtaatgggccttttgtgtttcgttggnngccgttactgccgccaattgcggagtgcncggccggtttctttggncnatatcaatccgactgttttttgctctgcgttggcatccatgcaantgccttttncgtcgcgtgatgnttgcgatggtgctcggagtgcttgttgggtgtgggggtcgccgccgcngcganccgnnttgntggnctttgtaagctgctaggtnttnttttatatgccantacggccnactgggnatcntccnncctgnggccttggcctcagcaaccgtattgtttgtttnattaggatacttggttggaaccctttcaccaatggtttttggtttcgaatggcgccac

SEQ ID NO: 482139 - DNA, 240 bp, Homo sapiens
  misc_feature (3)..(3): n is a, c, g, or t
  misc_feature (9)..(9): n is a, c, g, or t
  misc_feature (34)..(34): n is a, c, g, or t
  misc_feature (57)..(57): n is a, c, g, or t
  misc_feature (108)..(108): n is a, c, g, or t
  misc_feature (112)..(112): n is a, c, g, or t
  misc_feature (136)..(136): n is a, c, g, or t
  misc_feature (153)..(153): n is a, c, g, or t
  misc_feature (156)..(156): n is a, c, g, or t
  misc_feature (160)..(160): n is a, c, g, or t
  misc_feature (165)..(165): n is a, c, g, or t
  misc_feature (188)..(188): n is a, c, g, or t
  misc_feature (191)..(191): n is a, c, g, or t
  misc_feature (196)..(196): n is a, c, g, or t
  misc_feature (220)..(220): n is a, c, g, or t
  misc_feature (233)..(233): n is a, c, g, or t
ttngttagntgttagagccaaaagaaagggcttntatgttagtattggagcactttnaagatagatattttcagaaaagatgtaggatttaaaagttaaattttaaantttngaaaaagatatgatggcaattggnaatagtcacaatgaagntcntcanccagnaggtgtttaacagtgttattttnccnctggnaatgtgtaaactgtgagtgatttncaataaatgattntgaattc

SEQ ID NO: 482140 - DNA, 1063 bp, Homo sapiens
gtggttgcgtctcgtgtgttctgtgggtgtcgtgtgagtctttcgtgtgcgttgctttcttctaggtgctgtcgctacgctacgtgttgttgctcgccttgtgtctgtattgtggtcctcccattccctggggccctttttttgtgtcagctggctttttgcccgtgtggcacgaccgttcttgcgggtgtttgtctcctgggctcgtgcgtgctgatccccttgtgtcggtgtgagtctgctctgggcggtggttctttgtcgtgtgctctcggttctttcctcgtctttgggtgccccttccatgggtggtgcttgttgttccgttggggctcggtgtgttgctctggatcgggagttctcgttggatattccacctttggcgcatgtttaccgttcatgttcgatgccactgattgcccaagcgggaattcttgaagtgcctattgttcctggtatttcatatggtcctcgatcgcgggagtcacaattgacagtcctacgcccataaccattggggacagatcaagtatatctgacacaagaagtctgagatagctatctggagcgtccagggtcaggcaataaacccctgactgccatgttcttggccatgctagctgtagtgtcctgtgcgtctataggatcgggtgaacgcagccaatccggctaattgaaagctgcacagcctgaaagttacctttattcaattgaatgcattaaacaaaaggggagatgttggaggtccgaaggaatgagggtcgtgaccaagctcagtataccactggagggctctgtgagcaaacagcaagactgttgctcatgaaagcaggatgttggcgaactgacaaactgctgtctgccgccagaaggaatgctgggggcagtcatgtcccaggtcccgtgtctccttgaggttatccacaggaacatccagaacctgttgaacaaagaaaggaatcatgtgggcctgtgttaaatcaaatagctgaccgacagttatcccttcctccgcgtagttcactgtagcggtaatgaatatgaagggctgtgaaagctcagg

SEQ ID NO: 482141 - DNA, 713 bp, Homo sapiens
  misc_feature (669)..(669): n is a, c, g, or t
ctgaggatcccgtcgacaaacagcctcttgcactactgagtatttgctttatcagtgcttgctccataagctcatccaaagaaataaaacaagccgaaaaacttctccaatcttttgactgtcaaaatatagagcgcgatcaggcagaccacagcagtatgaccagttatcatgaacaagtgcttgccagcagcaaacaaaaagcccaatcctatgtagaaagctatcaacatggcgatcaaatttttgacctgcccctgcccgaagtgattgaaacacagctacaaagttatacggccgcatgccaatcactaggtggggttttacccaatccccagcaaagtccttaaaatacgattagcaataaaaaagacagctcgaaagctgtcttttttatttcatatgattcgaatttaagacacagttgagtcgttgtgatagcgagtatcgacactgaaatcttgaggaaatttagcagaaatttgcgcataaaatgccataatttcagccatatctttttcataatcaccagtaggataaataattttacccactccagtttttttcttcgcatagtccatataggccaacgcaattggaacacctgcactaactgcaacatggtaaaaacctgttttccactgttcctgcttggcacgtgtccttcangggtgaccaacatcaccaacttagggtgttctttaaaagatcat

SEQ ID NO: 482142 - DNA, 1396 bp, Homo sapiens
aggtgtcaggcccgatcggagctgcctgcagcacatgcgggctcgaccataccgtgacagtggctgacaaggtgactagctgagtcagcaccttgtgcccaggagctctgctgccaggcagagctgagtggccctgtggagtccagcatcatacatacctacagttttgcacctgcactgccctcccggcaccttcctcctccccgatcacgatctcatgtcactcgaattttatcttgtggagttcctgctccgtggactgcagatcggcatgccaggaccctgacagccccgctcccacctagtgccccagactgagactctccaggacaggtgggaacggctgactgtggacatgtcattattcattattattaacatcatcatggagaccccatccatcacacccgtgcatggagcacatccatatcttccacatatctccacagaactggaaagcctgaactgaggcctatgttgtgatcaggcccatcatgcctgcactacccatggccattgcaccgtcagtgtgcatgacagacatgttaacaagaaccgacatacacagggaagcggcatgcaccggcgcatgcacacggcatgcgtcacctcatgccactcatgcattgctgacacagcgggcaggagcgttgcacctccgcacacttatacctcaaggtgacaggacccagcatctcggcatttcgggcgttggaaaccaccgtggtgcataacaggacaaccccaggccataagggggtccttgcggccacagatggagcatcgcgtgaaaatgcgactccgcacggccaactgcgggccaatgatccaattaccaatacttggtcacacattaccccaagtacgacccaagctcctcggccaaccatagttgacgtgttgcacatggtagaaatcccttgaggcaagcacacggctgcaagctctccaaggggatggggccacggctacaacatgagcacaacagaggaccggacaaacaccacaacaccaccacaagagcaacatgacacgcaagggggcaccaccggagatcggcagaagtcgccaacaatccgagggggcgacaccgagcggggtgcacacaaaacacacccacgaactaggggcccacgagcaggctcggacgatggggcccacacgagtgaaaccgaccgaaccacaccctggggagcccgcacaccgtggcaccgaccatgccacacaacctccagcacgcaaacagctgagctctctcggccaccacccacacgcgagaaacgcaaaagaccaccacttcaagagtcgagacagctgcacacaccacatcagagcggcgaagaactacagaagaacaacacagccacgacaacagaacacagatgagcagacgaca

SEQ ID NO: 482143 - DNA, 186 bp, Homo sapiens
cactggctaatgtctgtaatcccaacactttgggaggcaaggaaggaggatcacttaagcccaggagatcaaggttgcatgaggtaatatcatgccactgaatccagcatgggctacagagtaagaacatgtcaaaaagaagaagaaaagaggaagaaagagaaggtaggtattatggaggacggg

SEQ ID NO: 482144 - DNA, 221 bp, Homo sapiens
cagcacacttgttggcatctgtcccaggccctgaggctgagctctagcatggacctacgtgtgagaagggtgacaaacattccccctcactgtgctgctgaacaccccatttcatgactcgtagggtagagagcggcaagcaagaaaagctgagggcaaaggagagctagccttaataaatcaatgtgcgcattattaaaggtttctaaagacttgaaaaa

SEQ ID NO: 482145 - DNA, 953 bp, Homo sapiens
  misc_feature (199)..(199): n is a, c, g, or t
  misc_feature (234)..(234): n is a, c, g, or t
  misc_feature (237)..(237): n is a, c, g, or t
  misc_feature (274)..(274): n is a, c, g, or t
  misc_feature (299)..(299): n is a, c, g, or t
  misc_feature (303)..(303): n is a, c, g, or t
  misc_feature (308)..(309): n is a, c, g, or t
  misc_feature (314)..(314): n is a, c, g, or t
  misc_feature (317)..(317): n is a, c, g, or t
  misc_feature (325)..(325): n is a, c, g, or t
  misc_feature (337)..(339): n is a, c, g, or t
  misc_feature (350)..(350): n is a, c, g, or t
  misc_feature (358)..(358): n is a, c, g, or t
  misc_feature (370)..(370): n is a, c, g, or t
  misc_feature (375)..(375): n is a, c, g, or t
  misc_feature (381)..(381): n is a, c, g, or t
  misc_feature (383)..(383): n is a, c, g, or t
  misc_feature (385)..(385): n is a, c, g, or t
  misc_feature (416)..(416): n is a, c, g, or t
  misc_feature (418)..(418): n is a, c, g, or t
  misc_feature (420)..(420): n is a, c, g, or t
  misc_feature (427)..(428): n is a, c, g, or t
  misc_feature (442)..(442): n is a, c, g, or t
  misc_feature (466)..(466): n is a, c, g, or t
  misc_feature (469)..(469): n is a, c, g, or t
  misc_feature (478)..(478): n is a, c, g, or t
  misc_feature (484)..(485): n is a, c, g, or t
  misc_feature (491)..(491): n is a, c, g, or t
  misc_feature (493)..(493): n is a, c, g, or t
  misc_feature (512)..(512): n is a, c, g, or t
  misc_feature (519)..(519): n is a, c, g, or t
  misc_feature (528)..(528): n is a, c, g, or t
  misc_feature (530)..(530): n is a, c, g, or t
  misc_feature (540)..(540): n is a, c, g, or t
  misc_feature (546)..(547): n is a, c, g, or t
  misc_feature (571)..(571): n is a, c, g, or t
agaaacaactagaagccattaaacaactacaggaagatgctgtcaaccaggaaggcatccttcggaagaggctccaagaaaccagccaacggactggaggatgtggaggagcaggtagggtggctcatggctacattagattcaggggacatctcctcagatgccctgcaaaccatgaaataaaaatggaggaggaacnaacaacaacaaacaaaaaaaaaagcaaagaggaantgnaagttcagtccctagcgactaacagtgagcagaggangtaaagggggagtggtaagagaggnggtntcaannagccntgntgatgaangaggcgatctgnnnaaagaggcaanttgacatntcaggacttaanccgcngtaganantngctcaggcatacaagcccatgcaaacacagnantngcagacnntcaggagaggctantcacttccctgagaagaaaaacanatntgcagtttngcctgnnatcatnangagtgagcactccatggcnttacttncctggccanangtgctacaantccagnnactaagctatccatgtccagggtnaggatcgagatcgagaagcccaaactgcccgtgaaacaagctaaagatcttgtcacgtgcataaagtaagagggaagccaagttcgggaaccaaggagaagcctttcaaaacgtatatcagatacgtggacatacatcggaaccacatgtgccaaggcaccacatacaagacgaagagagcagcaggggcagacacctggaaagaaaggctcaggagaacatgaaggacgtcagccaacgacaaagagagtaccccaggaacaatggcgcagagtgagaactcaacgaagcaccgcagaaaggacaaaagtggagggccgagctagcacgcaaacacgaacagggggcaacagaaacaggaacgagaccatgcagaaacgac

SEQ ID NO: 482146 - DNA, 368 bp, Homo sapiens
tcggtaccccccgtcctgatggccatggtctgtgtagatctgagttgctcgctcatacagataactggacatcgtggtaggtcggattactagaatgctgtgccagcgatccaggaagcaagtggctgcatcgtgcttgctcgtggtagctgcaggtgcagcgtgtgcagcctggcagaacgcgttatccggcagcacctccagtgtttggccattttgaacatgtttgctgctctggcgtagatttcgcatgcttcctctattttggatgagcctccaaagaggccagagaagaaggactgcgagttcttcactttgcgctccgcctcggccaacagcgccatcgcctccgcttccttcccggaatt

SEQ ID NO: 482147 - DNA, 277 bp, Homo sapiens
ttctgggtcagcccagtacaggccccacttgtaggcagaagttaggtaagggttatgtgcaccctcctcctagccctcaattcatttgtgtcatagaggcgagacacgttgcaaggctcagctctggtttctggcacaagtgagggagctgtagcacggttacgccttggtccagcttaggcagaatgaggcccacagatgggacaataaggcacaaccctggctctggaggtcagggagtcaaaggcaaacagctggggccaaattctcagaataa

SEQ ID NO: 482148 - DNA, 210 bp, Homo sapiens
ggtggctgttctagaggatcccgagaggtggaaggcaaagcaggagcaggcgtttacagtggaggaacaggaccacgagagagaaggggaaggtgccacacacttttaaacaaccagatctcacactaactcactcactatcacaagaagagcaccgagggaatgctgctaacccattcatgaggactctgcccccgtggtcccacctct

SEQ ID NO: 482149 - DNA, 404 bp, Homo sapiens
  misc_feature (172)..(172): n is a, c, g, or t
  misc_feature (174)..(174): n is a, c, g, or t
  misc_feature (176)..(176): n is a, c, g, or t
  misc_feature (191)..(192): n is a, c, g, or t
cttcaccccccagccttccgaaacctgcctcactgaggataaagaaatttattttctcccacccccggccctcttgtttttaatataaactattaaaaaggaaaaaataaagtcactcttgctaatcccaggttttagttagaggtggaacattccttggatcaggtgtggnanancaggacccaaacccnnagcagcgaaggcggggggggttttttttttgccctggctcagttcccgcgccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaaccaaa

SEQ ID NO: 482150 - DNA, 873 bp, Homo sapiens
  misc_feature (280)..(280): n is a, c, g, or t
  misc_feature (637)..(637): n is a, c, g, or t
ggtgtttgataacgtcgtccattgcctactatggtgacccatgagtgagctgcctgggaattactccataggcagcacaccaggtggtgtagtgggtgagctaagatgattcctgatagatatagcccgccagacacagctgagcctgaggctgtatcacgccattctcttgggcactacatgcgactcgagcaatgaaagtcaagcaatgccctcgcaggggctggatcgagcaagggacgggagatacacaaggctggactgacaccctggatcggtnggatgggagaggaccgtagttggatagatatgtagaagcagcgccgactggactgggctggatgtcgctcgagaggactcagtgggacctcctttcggctcacctgtcccaagacctaccttatgctgtcggattgaatttaaggcgcaacgtattccaagtgagaggatcgccaacgacgtctgttgtgctacttaggaaattttgttctggggatgctacctatatgaataaggcgactgagcctagaggtctccctgctgaggtacatccggaaggtaatctgactgtacccggtgaagaaaacctcactcaagaaccgttcattgaagctgcaatcatcaatcacatgtgacntgtttccatgcgaacgttggacagagctgagcgaaagaaatgcgcttcgctcacgtgtcatcccttatttggaacccaaccaagtatcaagcattccatttgctaggcaggtctgggagtcgttcccgagagccaggaggcttggcgtttcgcgcatgaagtccagaattggcaggtggactacagacatcatactacatggcggaaagctggaatctgggagctagggagagccg

SEQ ID NO: 482151 - DNA, 888 bp, Homo sapiens
gggtgcgcggagcggttcaccagtctatcggagcggttcggcccagcctttcgcccaggcgcccaggcccgctgtgcgcgtgcgtgagcgcgcctgcgcctgccagggcctgctgcaaggggaggagagcggccgcctcaggaggatcccttttcccccagaaattactcaatgctgagaacctctcaaagtggtacttacggatgacgctgaaaaagcacccatggacgggtttaatgatcagcaagtcccttattatggtcccacggggaaaatctcgcactctgcaggaaatgcagacgggcggacctgttgaattgacacgaacagacgggaaagatcatctgggcaacacaggatcatgggcgtcaccgagtatccctgcaagaggcatatattcaagcgaatcctcaagatacaaacgtatcaacggaggtgctttggggtttacggcctggaaaggcaagcaaatggaattccctagaattggcgtagaaaacagggcatacggtcgcccaggaaattttacaaggtccttgattaagcccctatgcaggcctaatcaataggcccccaaacgcattccgagaactcagaagaattctaaagtaacaggccggaacggaccttgacgacacagaggcgaccccccgatacccatacatgaacacacacgatggatacggggctacgatttgggaataagaacccccgagttgggaagacccaagtaggcgcgttccatagattgagtgggcaattagaaccctaaaattgagcgtggcgataacaaaacaggtttgtcgccttcacttagccagaaaaccttaaatttggtgtggaccccttacattcgagattaagaggcaaagtgctccatttacccct

SEQ ID NO: 482152 - DNA, 180 bp, Homo sapiens
  misc_feature (114)..(114): n is a, c, g, or t
tcaagcttctaacgaggtacggggacatggtttgataaatttgtttgtattcaacaaacttgaaatgcaaggaccgccattaaagtgtctcgtttatatttttggagaatattntgtattaccttacaaattaaattaataaaagtgggtttaaaaaacctttccaggaaaaaaaaaaaa

SEQ ID NO: 482153 - DNA, 273 bp, Homo sapiens
ctgaatctagtgatcttttaagttttcattaatggccatgctgactggtgtgagacagtatcttgtggttcgagtttacattaatagtgatgatgagcattttgtcagatatttgtgggctgcacgtgtgttatatgagaagtgtctgttcatgtcctttgccacgtttttaatggggttgtattatgatagtggaattaaatgccttatagagtctggatattagacctttgttggatgcatagttagtattttctctcattctatggtagt

SEQ ID NO: 482154 - DNA, 101 bp, Homo sapiens
taatatctatgtacaccaaggaaaatcctgatatggaatggtttgactaacagcaaagaataaggcacctgctatgaagtttagcacaaccataaaacaga

SEQ ID NO: 482155 - DNA, 746 bp, Homo sapiens
aggtgtccgtggaaatctgacggagggtgctgctgtgggctggcgtgacagtcacagagatggggaagagaaaacagtgtacggtgacacacacagtagagaaggaagagcagacatgaggcacagcaggatgacccccccaagcccgaggaggacagcctggggatgcagatgcacatgccggccccagtggagggaaccgatttccccggagccgtgaggcaatgcctgggtgctctccctgccctgttcctgccggtatgccgcccccagccgtcatccccatccgatcttgtcccgcatgacgtactcgcaccagtgtgggatgccaatgttgcctggatctcgcggagcgatggggccaggcataccgaggtgtgtgggggtcttggtgtgtccgtggctgagtgaggcctcccaatgataggaatgcatcgcggagtgaactcgaaacagcttcagcatctaaccagactgcacctagctggagcgggcgttcgaggcctctcactacccggatgtgtcagccgtgaggagctggctgccgaggtgcccctacctgatgtgctgcgtcgggttgtggttccgagaacctgccgggccatggtggcgccggcgtggatcggctggagtcaggctcgggggtgccgtgcggagtcggagactcgcagtgcgcgagtctgtcggtggccgggccggcatagtgttgcctgggcctggtgggccgggtcgcgggttaggttccc

SEQ ID NO: 482156 - DNA, 291 bp, Homo sapiens
cgagcgatcgcgcgcggatataaggtgtcttctcctatcattcaccaccttaatctttgagacaaagtctcatcctgaaccagatgctcacctctttctctgggaaggcaagccaggatctctcaggatctgcctgactctgccccttccttcagtctttgttctccattccttccactgcctccttcctcttttttactcctaactcttttctttctctgcgtttgctccttttcttcttacactttatctcctacgctcttctgcttttcctttgtcttccgtcgacgc

SEQ ID NO: 482157 - DNA, 421 bp, Homo sapiens
  misc_feature (260)..(260): n is a, c, g, or t
  misc_feature (279)..(279): n is a, c, g, or t
  misc_feature (289)..(289): n is a, c, g, or t
  misc_feature (312)..(312): n is a, c, g, or t
  misc_feature (344)..(344): n is a, c, g, or t
  misc_feature (394)..(394): n is a, c, g, or t
aggaggaatctctgtctccagtgcaatcctgactcaaactaacaatgatgaatttgttattgttggtggctatcagcttgaaaatcaagaatgatctgcaacatcatctctttagaggacaacaagatagaaattcgtgagatggagaccccagattggaccccagacattaagcacagcaagatatggtttggaagcaacatgggaaatggaactgtttttcttggcataccaggagacatcaagttgtttcagaaggntctattctatatgttgaangtgctgaagngatactatgaagagcagacaacnttcaccaacagtcaactcacgaagtccagggntccactcccttgagactcgagaatttgtttcgtgcgagcaatagtttgangtgagagaattgacacctataatggtg

SEQ ID NO: 482158 - DNA, 584 bp, Homo sapiens
accaaaaagaatttgttttgaagattatctttgaaagatattacaatgtagcatacatacaatcttttatagttcgagaccgagttcggacaaaaatggaacgtgatatcttggtagaggttaatcatccttttattgtcaagttgcattatggtaagtatgagccgtctcccacatcatcccttgacctcatccctcaaaatccctgaggacattcagataaactaatataaataaatatatatttgtatgtggttagcagatctatatagtaataagtcatgaaaattaagccattatttcttagacaaactttagaagcttttattgtttagtttatgttttttttaaatattataaagttagtttctgagtggtagccataggaacaggtaatgataattattgcttttttattataataataatgagtaataatatgctagccttttgtagcctatatgtgttagccaaccctaaaggccaaagagatccctaatgtcaacatcctaaaaccattgtcactgctgttcttttccccgaagccatatgctttttctcagtgggtaaaggtgtggtgattc

SEQ ID NO: 482159 - DNA, 422 bp, Homo sapiens
gttaaagcgagatgggaaacaggtacatgcacaggttgggaaggtgtctagaggaaaagctacagaaatgagggcagaaagatgagatgacaggacacattgcagagagcagaagaatgggaatcaaagagaaagcaaagtacagaaaagccagagacaaaagcaggtattgcaggcagcagacctctggagctgccctgactccatcagaattatcttagcttcttgagacacaggtggatcccattcttggacttcaacacaagtcttgcaatggggactgggatcctggtgggatctggcagcaattcaaagcggagcagggtcaggccacagccaccttcagctcgttcatagcaaactgtttcccaatgcagttccttgatcctcctgagaatggcagataagcatggctatggtga

SEQ ID NO: 482160 - DNA, 201 bp, Homo sapiens
taactcagctctgtctctgatatgagaagtcatactactgtagcttagaggctcaccatgaatgctcacagacgtcaagctcagatttttttcattctgttcatctaatatgtcctgctgatctgttcatcggatgttctttgagtctgctacaccttggtctgcagtgccacacagctaattctgtcatcctgcggccgg

SEQ ID NO: 482161 - DNA, 418 bp, Homo sapiens
  misc_feature (156)..(156): n is a, c, g, or t
  misc_feature (371)..(371): n is a, c, g, or t
  misc_feature (379)..(379): n is a, c, g, or t
ggccaggcactgtaacgcacgcatgtcatgcctgtcagacctagtactactacaaggcctcctggtattagtctagtcactctggtgggccattagtttgcacctggcactgtccggggaagtttgtcctggttgcagcattgggtgttcgggcgncccaaccatgtccagttggacaggtaggtatcaaagcggttgcgctcatagcgtaatggcggttgggcagttggtgttgtagtgttgggcagcggcctggtctggccagtgatattgcgctgtaccctctacccatggtagggtaggaaatcgcataagtgcgcggtatcctgggcagcgtttaagagtacaagaaagcactgcggtacaatggnaacattgnacacggcggtcaggcccccgatcaccgggggcttgtcgt

SEQ ID NO: 482162 - DNA, 107 bp, Homo sapiens
taattgagctgtaccgctctttaattgcagttgcattaacattgctcagctgtgtgctaccctacgccggcaggcgcgggtacccgttgagccatgttcatgccact

SEQ ID NO: 482163 - DNA, 990 bp, Homo sapiens
cgcaaagccctcggctcaagccctggtctcccgagggtgccatgtgtgcacgtgaatggcctgcgtggatgccggaatggcctgatgccctgtgtcatgcacctgatggcctccatgtctcgtgccagaaatgacctggaagcctgctggtggtgcctgagatgaatggcccctgcccatgatgtgcctgcatgctgccccctgcctgtgtggccgctgtgactctgcgacaacttcaccaatgtgctggcctgtctgtggtgatgtgctgatgctgcccctgcctgcctgcctgctgcgatgtgactgcggtggtggcactcatgtgctgtgtgctgctgcagtggcctgcgtctcgagttggcctgtgagccccatttgtctcctgcagggacggtgcttgcttgtgtgtgtgctctgtggccttcatggcttccatgtggctggtgctgcctgcgcctgcttgccccatggcctgccctcggctggcctgaggattgctgtgggcctcgcatggttgtcgcttggcgctgcctgccggaagggacctggctgctcctggtgggccactttggtgccccattgacacctcgaagcctgcctgctgcccggccctgccttttcccctgaaagttctgtgtgttgcggtgcccggtgcctccagcggctgtgcggccgtctgttggcgcccccgggagccggctgaggcccgtgctgagaactgtttaagcgttggtgacgagggaaggggggcattacggttgggggaggtgtattcgggggccgtccatttgggccgttgggccgcttgcttggggcatttgcccattccggaaggcctttttggaggccggcggatcgagggggcccgtgccgccaagtgtgcggcccgtgtctggcgtcctgtctcccgtacgtggccggccgcccgtggcggtgcgtgccgggccccagggttgggccccacgttctgcggcgtttcgcgcggtg

SEQ ID NO: 482164 - DNA, 192 bp, Homo sapiens
acctggggaacctgttgccccccccccccccaacccagtttttcctgttcccccgggggggccccgggggccttttcccctggttccccccttgaggggcaaacccatgttttaccttttttttttttccccccggggcccggccctttttttttttcccaaaatggggaaaaaaaaaaagaatttttttta

SEQ ID NO: 482165 - DNA, 200 bp, Homo sapiens
cgtctgacttctggcatacctgacttctggcatacctggaccttctggcatacctggacttctggcatacctggaccttctggcatacctggaccttctggcatacctggaccttctggcatacctggaccttctggcatacctggaccttctgcgtaatgaattaactagaaataagtttgcaaggagagccaggtatg

SEQ ID NO: 482166 - DNA, 217 bp, Homo sapiens
cccactcaagaaggctccagtgaatgctggcacgttcagcctgggtgacagagcaagactctgtctcaaaaaaagaagcgggggagtgggggattgaggccacgtgcagtggctcactactgtaattccagcactttgggaggccgaggcaggaagattgcttgaactcaggagttcaagaccagtctgggcaacatggtgagaccctctgtctcta

SEQ ID NO: 482167 - DNA, 213 bp, Homo sapiens
ttttcacttagaggtctcaatacaggaggtggccaaggaacaacacttctcagtgccaccagttcatatatccctcaaaaggctctacgttctccaccaaaccattggggtgccaactgtgatggaaaagcaagcagatgttggccacaactccaggacctcccgtggctgaggctcatgtgcatacagtcagtgtaccaggctaatgtcaaa

SEQ ID NO: 482168 - DNA, 347 bp, Homo sapiens
  misc_feature (262)..(262): n is a, c, g, or t
acgggatgtggaggaggccgaggaggaggctgaggagcatggctggactgttcctggcagctggtagaggaaggtgtaaaactctcctgtgtagccgtccatgaaggtgctgaagctgggcagggcagtgggtggcagctggtgggctgcctcggtggctggccagtgtccatgtgtgggcttgatagaactcagtgggtcagtgggtgtcgcttgccagtgtggtcactggggtcccttgactctggtgcttggtgtcccnatatttgggctatggatacatgggcatctcctggcctggctccctgctgccccgtgccctggacttggcgcccctgagtctcagt

SEQ ID NO: 482169 - DNA, 1006 bp, Homo sapiens
gcgaaaacaagtaggctaggtacgagagctggggtgatcattcacaggttgcctctctagcctgcacaaatgattgacaagagatcacccaaaggattatttctgaaggtgtaatcgttctttatttcttcttcttttattctttgtgctttttcttttttttggcacatgacagtgttggtatggaggaccttccaaggaagagggatgctgtagcagtggtgcctgggtgcctggcctccagtgtcccacctccttcaccaccccactgggctccttggccatctggatgctgaggttcccggttgggctgagactcaggtggttggtggtaaaagaaaggaaagggctctctgagggctgtgccacaagcttacctggtgggtttcagctcctgagaggccaccacgcagttcccatcagcacttgtctccaggcagcagttgcgtgggtcccaatgtccagctgcctcttgggctccaggggttccggcttccgggccccaccccgcaatgtgcaatcctcaagattggtcctgattctatttcctgggacacctccctgcctgtcctgggggatcctacttcttccggtgtggggagcccatagctgttggtctaacaggtacggaaatgacacttgcaactatgggatggccccagaaatccataaaatggtgcgacagttgtttctgtgtcctgtgaacccccattccaggtaacatacttactaatgtctggttgagccctctatatgcagcagtgtccccggtggcaaacttgccgggttttagcccttgttgtcccagccggttctgggcaccggagtgtcttcccccctggtgtgggtcgcgctgctctggggggcctgcagcatgtcacatgcgggggcccctttccacacggcccctgtttggcgctaatcccaatggtggccattttttgccgtgtgtttcccgtgggaaggcactcctgcgggagacgtcaagcgtctttcttctagtccg

SEQ ID NO: 482170 - DNA, 342 bp, Homo sapiens
  misc_feature (1)..(1): n is a, c, g, or t
ntagatggactggaaaataaaatcagaagtacgctgaacgagatctactttggaaaaacaaaggatatcgtcaatgggctgaggtctgtgcagacttttgcagacaaatcaaaacaatgaagctctgaagcaatgaccgtggtgtagtgctttgaatgagaaagcagcaagtgctaaaccttctgtttcattgctaaccatgacactgccgtggactccgttagattccgtttcgttagaaaactcgttttctggctcccattcccttcgtccctttcctctcccctgacgaggtcacattaacatgctgcatcaattgaccggcaccttaggcgcctatta

SEQ ID NO: 482171 - DNA, 170 bp, Homo sapiens
aatacatagcattttagacatcttttgaactgtgtagttggacgtataagcaggagtttattctaaaacgattccatcaattcttctgatcctttttatgtggtcatgctgcgacaccatgcaatccacagtcacaataaaattatccaaccaggggtgatcctcttaga

SEQ ID NO: 482172 - DNA, 1398 bp, Homo sapiens
gcactgaagatcctggtgtcgccatgggccgacgccccgaccgttgttaccggtatagtaagaacaagccgtacccaacagtctcgccttctgcctgagagtgtcccatgatgccaaagattcgcattatttagacctggggcggaaaaaggcaaaagtggatgagctttccgctatagctggaccacatggatgtcagatgaatatgagcagactagtactcatagaagccactgagagagactagcccagacattatgtagccaagtaaagtaccatgcgtaacacaagtaagtagcgcaaatgatcggcttcccatatccaggagtgcagagctccaaccccatataccaacgctcaatacacgcactccaaacaaagcatgatcgatccctggtcgctagcggagcctgcaacagcgactcccaaaaccacggccatagccaaaggctgccataacaggaaccacaccccccaaggggcccactgctgagcacaaggggatatcacacaataggacgaccaaaagttcacatccacttgctccccaaatccctgaccacccaacacgccataggcccgcaaaccacacgagaagccgcctacgacgacaccgacagcgaccccaatagccagccaacgacaacccacaaggaacacccacagataccacccccacggccccagacacagacaacgaatacccacaaaatctccgcacacacgaaaacgacatgcgcgggcctatccaccccaaacgcttacaacatgcactcaaccggacaataccggaccaacaccattaggctccgacccgcacacacagccgcgacctccacaccacccacccaactgccccccgccagcggcgcaccaacgataacatattccaccccagcctccgatcgcgcccccctctcctagcacccacacataatccacgaagacccctttgaaaactacaaactaaaagcactcttcaccacactgatgacatagacaaaaacattcattaaaattaacattccacccaatatacaaaaatacctaccattacccactgtccacacccacacccaccatacacaacaacacatctaacacaaatacactcattactctacaatcatcctacataacaaacaggcaacaacaacaactacgcacaccgcgacaaacacacgaccacaacccagcaaccccaccaccatctctcccaacaccagcgacaaacacatccagccccacccccaccaccaggagacccacaaaacaccgaccaccatcactgaaacacaacaccgaaataaacccacccacaccaacacaacacacacgcagacccacaacgcacacaaccacaacccccacacaaccacacacccaccccaccaccca

SEQ ID NO: 482173 - DNA, 104 bp, Homo sapiens
tatttcggtccacggatggcccagtaatgggggaaactggcaagtccttcctttggtatttatcgagggatccccaggtttagagattactttcttttttttat

SEQ ID NO: 482174 - DNA, 714 bp, Homo sapiens
gactcactcagggaccggagcagccctcaactcactcttcagactgccctgctgtgtgcagcccagccgctccatcatgtccttcagtgctgaccagatgctgaattcaaggaggcatttctcctgtgtgacagaacaggtgattccaagtatcaccttaagccaggtcggtgatgtccttcgagctctgggacatcaaagtcccatccaatgcacgaggtcgaggaacagttctgggaaaccccagcaagtgaagagctgaatgccaagaaaatgagtttgaacaatttctgcctatgatgcaagccagtttccaacaaacaaggaccaggccacctatgaagactttgtggagggtctgcgtgtctttgacaaggaaggacaatggcacagtcgtgggtgctgaactccgcatgtgctagccaccctgggtgaacagatgaaacgaggaagaagtggaagccctgcatggcatggtcaagaagactccaagtggctgcatcaactacgaagctttgtcaagcacatcatgtctatctgaattggagctctcaagaacaagcatgttaggaagactggctggaaaagttactctaatcacacccatgacagactctgcagatctgttaccatcattcaggaaaacacagcaatctggacggtcacagactgggcccagtccctgatgttatacatccttccttgctccgatcg

SEQ ID NO: 482175 - DNA, 468 bp, Homo sapiens
  misc_feature (40)..(40): n is a, c, g, or t
  misc_feature (42)..(42): n is a, c, g, or t
gatcagagatgggtttaagtgctgtggccagaagcggagncncacttttttcccccttttcatccccttcttttctcgtcccactccttcccctttccccgactattctttcgccctcgtccaatacacatctcatctccccaacctctgtctttaacctgcaatcctcaccttccctcttcccacctctctgctcaatttttttctcctagtcccagccccccttttcctccttttgcaattcttctccttccaaatgtctccccccactcttctcttactcctcccattctcctctcccttctcgcccctccacttctccctctccctaccccctctccgcacatttactcttcgccactgcacttctcgccgccttaccacttcttcctccgcccctcccaccctccttcgccctacccccgctcccactctcctattttcttccttacccctcctgtactggcg

SEQ ID NO: 482176 - DNA, 406 bp, Homo sapiens
  misc_feature (14)..(14): n is a, c, g, or t
gtgcataaagcaanagaagaataggctacagattagaaaggagaaataaattgtgcttatttgcgttcacatgtagtatcttgtgtggaaataccccagagagtctacaaaaatctcctagaacaggctgggcacggtggctcacgcctgtaatcccggcactttgggagggcaaggcaggtggatcacagggtcaggagttcgagcacagcctgaccaacatggtgaaactctgtctctacaaaaaatacaaaaaattagccgggcatggtggcaggtgcctataatcccagctactcgagaggctgaggcaggagaatcacttgaacccaggagacggaggatgcactgagccaagactgcgccactgcactccagcctgggcaatagggcaagactccgtctc

SEQ ID NO: 482177 - DNA, 468 bp, Homo sapiens
aggagtacaaccagaccctgctcaatgacagcctcagcctgtgccctgcctaattttgttttattttcaatataaaataaatttgtggaacaggtggtgcttggttacatgggtaggctctttagtggtaatttttgagattttggtgcaactgtcacctgagcagtgtacactgtactgaatgtgtagtcttttatttcatcaccccactccccccttccgcgtgagtccccaaagtcctttatatcattcttatacctttgtgtcctcatagcctagctctcacaagtgagaacatatgatatttggttttccatttctgagttacgtcacttagaataatggtccccaactccatccaggttgctgtgaatgccactatttcttctctcctctcctctcctgttctcctcttctcttctcttctgttctcctcttctcttctcttctgttctcctcttctcctct

SEQ ID NO: 482178 - DNA, 470 bp, Homo sapiens
ttttttatttttttgccaaggcttgttttgcatttttttttgttcacttaatttttttttacaatataaaaaacccctgcttttgtggggggagggcggttaatatctgggagggctgcaatactcttaccggggggggcccttttggaaaatgcgcttttttccttatggctttccgccaccgggggattgcctagaaattaaaacccccctttttttccccaaatggaacacttatccccttgtcagtccttttgtgagggctccaaaccttatgtccggggtcccccatggggtggcccgggtccaacatgggggtggcgaacccttttgggggcttagccctttaaataggggtgcggctttttccatagggtaaagaatttgtggggaaaagtttttggaacaccgaagtttttggtttcttttgtcggggaaaaaatttacatgaccttgcgggcgtatggctc

SEQ ID NO: 482179 - DNA, 244 bp, Homo sapiens
tttttcccccgggggggggggtttttttggccccaattcccccggggccaacagggtgggcccctcttttaaaaaaaaaaaaaaaaaattttgggcccccccccctttttaaaagcccccggggggggttgggttttttaaaaaattttttttttttgggggggttggcccccccccggcccctcccggggtccggtttcccccattaaaggggttttccccctgggggggggttttcccccca

SEQ ID NO: 482180 - DNA, 989 bp, Homo sapiens
  misc_feature (408)..(408): n is a, c, g, or t
tggtccgactttttgaagaggctggggggtctggcggctattctccgagtcttcgaaatgccgcctaaggacaacaaaaaaaaaaaggaccctggaaattcggccaaaaaagacaaagcacccagtgaacaatatccgggggcagggccaaaaagaagaatgtggtgtccaagggcaaatgttcgggacaagtctcaataattttagttctttgtttgcgacaaagtctcaccttatgataactcttcttgtagggaatgtccccaatttataaatctttataaccccgagctgtgtgtgggctcctctgtgggagaagaacttgaaagactgttcggagggcctcccgtggcccgaggggcaaagcccctttagaggaagctcccctttagtataaagagggcactnttattcacacactgtggtctttttcacagaagcgcacgagaaagcttcaagagtataaatttctaccacgcgagaaaattccccagagggtgtggaagaaagttgcctcccaggctgtgtcgtggtgtagaagacattgcctgtgacattaggcgctcccacacaccaggctgtgttccccattttggggcaaaacaacatatacacaacctttttattttacactctccaaaaaaaaagagacataaagaagaaacaacctctcgcggaggggaccacctcaatatgtggcagggggggcgaggcgggcaaaaacagagcggggtcgatacatagtgacaatcagtggtgcggacccaccgttgtgtgtcctcactaaagtcgtgtgtctttctcccgtctagaacccccacagagcctttttttctgttgtgtattaacccaaacggggtggtgtgaaaaaacacatcgtcgccgggggggttcccccccacaaatataagagaggaggagcccgactaattaaactttgctcgaaaaaacacccgccgggtggttaaacccgcggcggcctttatgac

SEQ ID NO: 482181 - DNA, 431 bp, Homo sapiens
ccccggggcctggccccccgggggattggttccccccggttaagaggggaaaggggggggggcaaggggccctccaagaacccaggatttcccttccgcccctcccaacccttagggcgccctgggggacccccaactgggggggtgggcgcccccctccccccccccggggtttgggggtttggggggggggcccccccccctggggggggactccccccccccccggggtttttttccttgggcttaagggggccccccctcccccccccccccccccggggggtttttggccgggcccctttgtttggggggcaatccggggcccccccggggccctttggaccccggtggggtggccccctgggggttggggtttttcggggccttttttggccggaaaaaaaaaagggaaactttggtttttttta

SEQ ID NO: 482182 - DNA, 171 bp, Homo sapiens
tacagacgcgacgcatagcaaggatacagaacaacataagatagagaaatacacacacaaagagatatatacagagacatacagaagagaacacatagaaatagttatagagagacagatatacaaaagaaacccaaagacttatagagccccaaaaacaaataggggaag

SEQ ID NO: 482183 - DNA, 403 bp, Homo sapiens
  misc_feature (335)..(335): n is a, c, g, or t
gtcaaggagtggcttactacatgtgggagcttttggtatgtgacatgcgggctgggcagctgttaaagtccaacgtggggcagcacaaagagggggccacctccccaaagggaggaaaaagaggcaaacgtgggctgggcaatggcctcacataagaaacagggtcttcctggaaatttggtgatggagatgtcaagcaggtggcctctggacgtcaccgttgccctgcatggtggccccagagcaacctctatgaacaacctcgttttcaaaccaacacccacagccggagaatccaagaagacttgcgcactcagaacaagagggtaggaatncttatacaagcttgcaaacccgccagtcgcccataaacaactgctttgaaccggccttcttgcaaacg

SEQ ID NO: 482184 - DNA, 458 bp, Homo sapiens
ctctgttatatcccagcagagagacattgtacgtgtttgctcatgaagatgcagcatatggattgtctgtgagctcagtgaatgacaacatttgctccagatcctcagatgatggccgaagatatcatttgggacattcgagaatcctactatggagagtccttatgcctggcaaactatccatcaggctttcatagcgtcatgtttaaccctgtggagcccaggatgttggccacagcccattcaaaggatggagtggcactctggtacattcgcctcagagatgtctgctgcgctatggtggaaacctgtccgttcgtgccatgagtgtactattgaacagcgaccagacccagcttctgggcctgaggcgacacctgtccgctgtgctctatgacattcagtccgctctgcctgtgtgacagcttgacaatcagtgatacttccttatgcagctg

SEQ ID NO: 482185 - DNA, 120 bp, Homo sapiens
actcttagaggatccccgtgtgggctgtcgtgcaagactctgagaattgagagaggttcaatgtgagtcaacgctcagcacgagactccacagttacacagttcccagatctctctgcta

SEQ ID NO: 482186 - DNA, 934 bp, Homo sapiens
atggcacatgcagcgcaagtaggtctacaagacagctacttccccatatcatagacagagcttaatcacctttatcattgatccacgcccttcataattacatttaacctatattcctgctatccgtagatccgtgtaattgcgccgtgttgtcattaaccacgtccacacacacaaagcgtgagcgtaagtacctaaacgattcgttcaggcacgtcatacagcggacacaatgaggaaaaaacacagactacctggacaacttaaatacccgtagggccgccgacccaaagttccaattacccgttaagcgtgcacttacaaataacagactccactacccgacgaattaccaccctttaagccgccccaggtgtcaccagtgatgtgagccgagatgaagcagccacgggaagacggaacaggggcaatacccaacacgcgggaaagattcaccgccgagtcccaccgcggctgcttaaccccacaatttccgacataggattacgacaacccatctagcgccgacgcccgaatgccgccaaagacctagggggagacttacaccccattgggggcacagaaagccaccccatataagacgggtagtaaactgggagtttgacaccacagcacaccggggtaagcacggtttatagaccgcgagtgaacccgcggggtgacaacaccgcctttacagccagagttccccctatgtcgcccgaagcggacgcgagcattccacgccaggtatgaagacgccaatacgactaccacccctatagtctggcaagtcggagcgacaccaccgaaactgtgtcagcacaactcagagcgcacccaccacttacgcgggcgtaagataagtggacgcatacaggataggggaccaccggcgaaaaaccgcccccgcgtggggagctcagggccaaag

SEQ ID NO: 482187 - DNA, 249 bp, Homo sapiens
cttaatgaaggagaaggtacatgtggatttaaacagctacgtccagtctcctggcataccattcacctcaagaagacccctttctcttcacctaggcttctcatcctcatcagcaatattcacggccaagcaagagcagcaaaggggattttgggggaagaaaggacatactggggttgggatcactggcaacaatgatatgcttctggaacctggggtcctttggagatggacccaattcccatcact

SEQ ID NO: 482188 - DNA, 821 bp, Homo sapiens
cacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttttaatttaaatttaaatttttttccattttttggaaaggtttttggtttggttggtggtggtgtggttgtggttttggaaacagtcttgctctgtcacccaggctgggagtgcagtgggcatgatctctgcaacctctacctcccaggttcaagcaattcttgtgcctcagcctcccaagtaacggggactacaggtgcacgctaccacacctggctgatttttttggtttaagtagagacagggtttcaaccatgttgcccaggtgggtctcaaactcctgagctcaggcaatccacccgcctttggcctcccaaagtgtctaggattcacgggtgtgagccaccaaacccagctatttttcttcacgttttaaatttaacagtggggggggggtctcaattggttcacccgggtggggtctcgaactcccggattaagcgatcctctggttccaaagacccattaccagtctcaaggtttctttactaaaagatccataccttttctctcttatctgctgcatgtgagatgtggttttcaccttccgccaatgatgtgaaggcttccaagccagtagaactggagttcaataaacctcctttggtaaaaaaacataga

SEQ ID NO: 482189 - DNA, 651 bp, Homo sapiens
ggcggaaatcggaagcgggggcggtccgcggtgccggctggtggcggagcagtgggtgcggaggtgcgtccctgtaggtgtgtgagcccgttgatggaagcctgggcctcgtcagccagtgcagcgggggtgtcggttgccgacgtggctgccgctggggctgttggctgtcggtcggtgctggctgtggctgcgctccgccgtttggcagcaggtccggcatagggtcttgccacggacctccgtgtcggagcagcagttgctggaggtggaggacttgtcccgtgtccctcctgcagggtggagggctggggcctctgtcgatggccccggacctgccggatctggatcctgagtgccgggagctcctgctggacttcgccaacagcagcgcagaggctgacagggtgtctggtgcgcagacgcccggaccgtgcgcctctgtcagacctggtacaccccttcttccaacaggtcgacagcacgatggacaagatcagccgagaccgggggaatacttcagagagtcagagttgtgccagaagtctcttactggcagatagaatgcaatagtgtgattctctcagaattttgaataacaatggaagaggcaatgtgcaaatgtttaaaaagaaaagtgaagacttatca

SEQ ID NO: 482190 - DNA, 844 bp, Homo sapiens
agcggagtgtggacctggactcgaatcccgttgccgactcgcgctctcggcttctgctccggggcttcttccctgcgctgcccggggccctgacctgtggcttcttccccggcctgatctgcgcagcccggcgggctgccctatgaaggagccatgcgtgctgcgtgggtgcgctgctgggcggcgggaggcgtggcctggagctgcgtgcggcaatgcgggctgtggacctgctcggccgccgtcctgccctggcgatgcatgctcacgctggtgatgcctggccatgtgaaggtccaggaccctgctagtctggtcccacgacggaaacgcgacaatgtgcctctagggcttcacgcccagggtgcccaccctggggctgctgccctgatcgtgcccgtccctgatggacgacactcatgctacagcgtactgcgtacgtgggaatcatgacgaggcccgttcttccgctaccgcgacctacctggactgtcctggagcagcccttccccggggcagtgcccagccctgcggccctgctgcgccgctgcctggccggccccgctcttcggcatgcttgttcctgctctcctctcacctcttcccgctggaggcccgtgcgcgaggactcctttctacgcccggcccggttgctccgcccggcctctttctacatgattcccccgatcttcttcgcctgtccgacttgcgccttctacggtggccttggatttgcccgccgaagtgccgagctgcattgtccgaccgagctttgagtgcctaacaccgtgggccgccaaatgcccggggccggaaggccggccccggcgtccactgccctccc

SEQ ID NO: 482191 - DNA, 1060 bp, Homo sapiens
  misc_feature (367)..(367): n is a, c, g, or t
  misc_feature (458)..(458): n is a, c, g, or t
  misc_feature (480)..(480): n is a, c, g, or t
  misc_feature (549)..(550): n is a, c, g, or t
  misc_feature (589)..(589): n is a, c, g, or t
  misc_feature (604)..(604): n is a, c, g, or t
  misc_feature (610)..(610): n is a, c, g, or t
  misc_feature (872)..(872): n is a, c, g, or t
agcggcctcaagtgctgatgatgcgtcttgggttaatgcctcatattcccacactctgtgaaagctacttctccagtgaaatctactactctctatcagctgatggctacagaagctcgtgacgggacacacaactgctgatgctatgttccataacatgctccgtagttacgctcgctctgtagaaagaccgcgggcgtactcgggaatacccagatttgctgaaagtgcaagctcttagtccctcaggagcagattgccactccagaggggacgcaagttgataggtaggaaggagaagtgtgttggttcgtcggcgacagttcgtcaacattgcgtaacatatgtagcacagcatcgtgacggnagctaacccagcggagagacaccagggacactttaacagtcgcttttctcccctaggggcacagccggctgtcttggggcagcaggccggntctggctgccatgacgcacaancaattaggccagaaaatgcagataggtcctcgagggcagtatgaagaccatacaactcctctaacgagnnaagctctgcgcacgactttgaagtgtaccgtacacaaantgactagaataaggnacacanatacccacaggacacaagacttatgatttcacaagacatggaaccaccatatttcctatgcaatcgttagcataaccactagtgttaagacaagcgacaacaagccatcacatggcatgcgtatatcctcgtcgcaatacatatgaaaccttgattgcaccttgtgcgtctccggtggcgacccagaatgtatcgcatctagatggcggcaacatactactcgttgatgctgcgaaggaacacatagggcgggatatagttncacaagagagctagagacataggttaagataatccgaacatccatggatagacttccaacctgtgttcagaagcaccttcccccttcccacaacaaaccagcgaaggtggttttcacacataaacttccaggtccacttccaaggtaaccaagaaagaggtgaacccgaaagaaaccaggaataccca

SEQ ID NO: 482192 - DNA, 1031 bp, Homo sapiens
gctggattgcaagtttctgcaaagtagcatctaacccctgatagtctacaagttcagtcgttgacacgctgcccggtcgatcagaagaaactgtgtaccttaatagctagagagtccactcaatacccacactgtcgctcattccaatggagtgagctatatgcgatcggtggtcgatgcctgtgactgcagaggtagcgttctctattcatgatagaaggaactcagaacgaaacgatggatgcatgcttactgaatcaattggcattggatttgccttggtctgcttgggagtatgaaatcgatctagtgggataatatcatcagatccacgatgactgagtgaatcctgctatgcctcgcagtccaggacagccttgtatccgtcaccatgctatagtgtgattaagccaaaaatgggacacagcatcgcatttaagactgtacctgcaagaatccgactgttagggtcccatttagcatgaacgatgggtgagatgtacgactctatgcaaggcaagtaggtgcatgcattatcggcatggcgttttaactggaggcgaggaatccgagaaactgtatgatacgtagatgcaggtactgttcgcgaagtacgctgctgagtcgattaattgggggaatcgcgaatgacttcgtgatcggcaggcattcacatggtgggctgagtatctaagaaacctggagtcttagataggacctacaaatcctggtggtcaatctactgcaagaatgccagatgggctgacatcagcagaatgttcggcttgacttgtcccatattacagttcagcgaaagggcctgtcctggtttgggcatgccgcccgtcaaaggagtcttaagtaacctttgtagtcacgccgtaacagtggctatctaattatagagcgagacaaatgcagtgggtaagtgcatacgccgcacaacaagggaagttacagccctattgtggcagaaaaatgcaccaaacgggaaaaggagacaggacaaacaaaaaaaatggcacacaaga

SEQ ID NO: 482193 - DNA, 126 bp, Homo sapiens
gtcacgtaccttatatcagtatcatggagggacttactagttatccacgtgagttttcttactgttggggtacttttcttggcaggatgaagtgaagtaagataccaggctcctggctcctgaatt

SEQ ID NO: 482194 - DNA, 184 bp, Homo sapiens
ggaaataagatgtgtccattcatatgagtgggttttggtcatatatatacacatatattttaattacaagtgtgggtcccctttcagaactaaccaataaatagattccatgttttcttgtttatcacacatacaagtatctttccctatatatttgtaccacttttgagagccagttttcgat

SEQ ID NO: 482195 - DNA, 132 bp, Homo sapiens
ccctcaaaaggaaatcagtttaaaatggcacacaagttatgcatggtctctcctctccagcttctctgacttctcctgatcatctcaaccttgttccagtttgctccagccacagctgcgtttcacttccga

SEQ ID NO: 482196 - DNA, 1076 bp, Homo sapiens
ctcaatgttgcgctgcatccgctcgaatctcgtgaagatccgctctcgccgtgagtgatggcagttggagactgagaccgaaatataatggaattttacattgcttgactaccatttggaaacttgatggactgcggggactttatcaaggagtaaccccaaatatatggggtgcaggtttatcctggggactctactttttcttgtgagtagatttgggagatttaacagtattaaattacaaaaggaattattagtattcggtgattttacatgtaaatgtaaaatgataagttgaggtcatttaatcagtttctctgaattggaaggcatcaggcacagcaccaacaatggctgcattcagataatttgcattcagttcgcattcgaaaatgcgcttcatccagtgtgcattcatccagatgccatattaaatagctaatggcttcattagctattcatcagcaggccattaataataggtcctgggaagcacacatttcttaaatccagggcacacaccaggcaaacagcagcatgcagcgtagggcacatgcatacctttctaggacgcaagcccaatattcgtagtgcagcgtggcacattcaaggcgcaaagaatgcacacatcgtccactacactggcatctagccttcacttgctaacacgccttaaaagttacattaagtcaaaccatgcaaggaagccctactcagacaagtctctgcaacgcatataacaaccgaccccagctatatggaacaaacacaccaaggccaaaaaccttcccgaagggaagtacaaggtttgcaagcacaacggaaacacgtcgagcaagcggggaccccccaagtccgggcagcacacccacataacgcggtggccaataacagagctccagataagttcacaagttcacacagaaccatgaatggaacgccaatatcaacactacacgataccagaacgcatcacaaacaacaagactaccgtccacacacctaacgacacgaaacagcgccagccaacaccaacggcaccgcaccccgcacgacaaccccagcccacactagca

SEQ ID NO: 482197 - DNA, 396 bp, Homo sapiens
gtgatcgtcaccagcttctcggcggcctgggccgtggatccacagccaagcaacagggccagcagtgcggaacgtgcgacagtcatgatgggggcctcagtcatacgccaggttcacattgaggctggcgcggaaggggcccgggcgcagcgcggccgcagtgcgctcggggcggatgtagtaggtcagccgactatcgccaggcgatacgaaccaggccggggcagcactgcccaagcgcacgtcattgccctggatatcgagcaggcgaaggccgaagcattcggcgccgaccaccttgatcagcccgggcgtgtctgcatccgctaccgccttgaaagccacggcggccacgggttcgatagcgctccagaccaaggagccttgttgctcatc

SEQ ID NO: 482198 - DNA, 644 bp, Homo sapiens
ggcacgtgacaccatgcctgactaattaaaaaaaaaaaatttctttttctaagatttttgtcacgttgacgaagatttccttgtattgcccaggctggtctcaaactacctgggctcaagccagtcctcctgctttgacctcccaaagtgttgggatttacagggcatgatgctacctactgccccagcactacgatttatactttgtacgtaaatgcatttctaacagttcgacttattgtgctactagtggtgtgagatactgcctagttccttctgcattgtagatatcctgtttacccagcaccatttatcaaagcaactattctttccaaattgtttgtttctgccatttggttgaaaatcaatttaatataaatctgtggatttatttctgagttctctattctgttccattggttatgtgtctgtttttatcccaatactgtactgtttgtttactgtagctttgtggtatatttcgaaattgtctagtatgatccctccagctttattctttttgcttaagattgattgggcttttgggactcttctgtggtaccacatacattatccatttaggattgatttgatttctatgaaaagcgtcattggaatcgtatagggattgcattgtctctata

SEQ ID NO: 482199 - DNA, 399 bp, Homo sapiens
ctagaggatcccccttttctcacccaccccaccaatgtacaataaaatttaattaactccaaaaaggacccctagatcaagagagagagagagagagagagagagagcgcgagcgcgcagccccgttcagcctgagtggaatgcccacactgccgtgggttggggggcactgactcattgcgccatgggaagacctatgcagaccctgtggacccgtcaggaggtgtctgggcccaggctcaggccagaagagagacagaggcagggagggtgacgggagagccagacaaggacagagaggtatagcaggggacagagggcgactggaagaggaacgggcgcgtgggaagttggcgaaagacacagcacgctgtgaagccgtgcatggtggcgtgcggg

SEQ ID NO: 482200 - DNA, 619 bp, Homo sapiens
  misc_feature (1)..(1): n is a, c, g, or t
ntctctttccatcccttgaaccaaggcatgatagcacttggctacagcatgttgtcaacttaatgtaagtgctgactaccttcacaatttcctcatatctcttctggctgtagggtggctcagtgaaatccatttggttcacaccgacaattggttgtttcacacccagtgtgtaagccaagagggcatgctctcgggtctgcccattcttggagataccagcttcaaattcaccaactccagcagcaacactcaggtcagcacagtcagcttaaaatgtcccggtaatcatgtctttgataaagtctctgtgtcctggggcaccaatgatagccacatagtactttctggtctcaaatttccacaaggagataccaatggtaatcccacgttcacgctcagcttcctgtttatccaagacccagcgcatgcttgaaggagccctttcccatctcaccagcctccttcgcaaattttgcaatggttctttggtcaatgccaccgcatttttagaccagatggccagtagtggtggacttgcccgaatacacgtgtccaatggcgacaatgttgatatgagtcttttcctcccccattgtggctcataggggtagttctc

SEQ ID NO: 482201 - DNA, 1221 bp, Homo sapiens
gagcagctgaggcgccatggcggcggtagcggtgtcatgagtcttgtgcctgatctggagctggctgaccgcgagcggggcgggagctgctgctgatcggtgcccgggctggagtgagcgatgtgcgtggcaggccgtggctgggcagtctgccgacgctggcttttcacccgttgcctgctgcttgcactacttggaagttgagcggtttgcggcgagcttgctgctgcagcgcggggctctgcgcctgtcagcaatggcctgcctcagtgttgctcagcctcgttgctgcggactcagactgctctgtgtgtgcccgtaccttatgcccctagcttcgtgccgacttcttgcccttcgggatgctcgaacctgtcggggcaaacgccgcttggacggcgctgtcgtccgggccaaggcccttgggccctcgggtcggatgcctgcaaggggtcgcattctcggcagtcgtgctagaagctcgttcaactcgtcgagtcgggcaaacccgtgcttgccgcgaagctttgcgcaagtccgacccttggtaggcgacttgtcgggcctcacggggtccttgcgaggaggcactcgagagcttcgacactgggcagaattttgcccattagaacgttctcattttactccgcccgaaagcctcatttttcgggcccccccggtgggccggtcgtagcgcaccctttgctttccgagttgaaaccttgtcgggggttgccgttgaacgagatcgttgacccgttcgcggaaggagacctctcaaggcgcctcgcggaacaattcagtggcgcagacacatttggcgcgccttccgtccctccgaagggaaacgttgtgggagagccccttcatccggaagattcagacctccgaggctttgaaggcgaagaagtctcccttgccatggaaggccttttgcgggtggaacgtttgcccccccaagaggtcttcgaagagtggcaagcacttccacaagttgtaacccgcgatgggggagaacaccaaaggtctcttggcagttggtgaaccaaaggccgtcctcgttgcgacgcaacctagatttggggtcccaaggcggaggcctttggcccaaggaaagcgccaagtaagtcccgagtcccgttggggaagggttactcatttgcacgagcggtttagaggaagagaggccccgttttggtgtttgggccgtcgggaaactct

SEQ ID NO: 482202 - DNA, 371 bp, Homo sapiens
ggatattcagccggaggttcggggcgacgggactctccattccagaaccatggaccaatgtgtccgtgaaccttgtggagaatgaccccgggcgctggtgaacgctgtttgggagttactcgaagcgctcgatcggatcacgatttcggtgaattatcgctcgaaggtagacctggttcctcctcatcccttgctgagtatccctatagactattcaggaggcctgcaaaaaagataagtcaatagtggctcagactggtagcttcatacgagctcaaaagtttagggaagtctgtgcgtgacatggttttggtggaccagctggaggtgtttgatgtggttgtgatgatcgggatgaagattagtatggg

SEQ ID NO: 482203 - DNA, 251 bp, Homo sapiens
cctaatagagtatcttagagaactagaaaagcaagagcaaaccaaatctacagttatagaagaaaaaaatcataaagattagggcagaaaaaaaattgaacaaaaaatacaagaagatcaatgaaaaaattggcttttctgaaacagttaaacaacttgacaacaccttcaacaacactaaacaaaaagttttaaactccaacacgctaaaactaactctctaacaacacacaagtaacactactgactac

SEQ ID NO: 482204 - DNA, 244 bp, Homo sapiens
aggacagtatagagttgggccttctccatcctgatcagagataaactattaaaactgtaaaaaatactcaaagatatatgtaagtaagagggtatgagcctttagacttgctcataatgtacaacataacaacatttatttcaaatcactgaattcatggagatgtggacacgctaggttggctcttattttagttattgtgtgatagtggttctgtcatcatcattcagtgtatggaaggccg

SEQ ID NO: 482205 - DNA, 1038 bp, Homo sapiens
  misc_feature (161)..(161): n is a, c, g, or t
  misc_feature (193)..(193): n is a, c, g, or t
  misc_feature (195)..(195): n is a, c, g, or t
  misc_feature (198)..(198): n is a, c, g, or t
  misc_feature (223)..(223): n is a, c, g, or t
  misc_feature (225)..(225): n is a, c, g, or t
  misc_feature (228)..(228): n is a, c, g, or t
  misc_feature (239)..(239): n is a, c, g, or t
  misc_feature (253)..(253): n is a, c, g, or t
  misc_feature (312)..(312): n is a, c, g, or t
  misc_feature (337)..(337): n is a, c, g, or t
  misc_feature (344)..(344): n is a, c, g, or t
  misc_feature (347)..(347): n is a, c, g, or t
  misc_feature (373)..(373): n is a, c, g, or t
  misc_feature (380)..(380): n is a, c, g, or t
  misc_feature (390)..(390): n is a, c, g, or t
  misc_feature (410)..(411): n is a, c, g, or t
  misc_feature (414)..(414): n is a, c, g, or t
  misc_feature (456)..(456): n is a, c, g, or t
  misc_feature (458)..(459): n is a, c, g, or t
  misc_feature (462)..(464): n is a, c, g, or t
  misc_feature (482)..(482): n is a, c, g, or t
  misc_feature (513)..(514): n is a, c, g, or t
gcatgcatcagagagtttcctatctttgtatgttaagagattaagaaaaaaaaattctattttgtgtaatgtcctcgcggctctggggacgctaaaagaaccgggcctgccccgccctgcgcggggataacgaaagctgagtgtttttccctttttttgtncgtttttagtttattttttttaaagtcgtttncntgngttgacgaggatgatctggggtttnanttngtttcgtcgtncgttctgtttcggngggagggctgaaggaaacgttcacattttagagtttaaaaaaaacacctcgacttttanaaaatcaaccaacacaagatcaaanaggaaanggncgagagaaaaattatttttaagatanttaaccntaaaacccgnggtgcttcttacattataanngtncgttttaaagaacccacaaactattatacataagtttatgantnnacnnnaaatatcctgcactggtnaggaatacgcatatcccttcttggtggagtnnaacggaacgggacagcggcgtgcccccggcggcgttggacttgctccggccgagggtctccccggggcgccccctccctggggccaagaaaccctccatcgacacgaatacaccgaacggggtacggaggcgcgcacggggtgcacggacaacctccacacgaaacggacaatgcacacggacaagacgtccacgacgacgtctggtataccacggacgcccagcacactcagaggcaccggaaccgcaggagacagacgcagaggacacagaggaagagtgctacaagcgagcagcgccgagacagacaagacgatgtcaacagacgctccaacgacgacacgcggacaccgagcgactgcaacgcacgagagaacggacagccaggacgcaccaagccacggacgggcgagacgaggagagcgagagcggcaccaagcccagtagagacacgaagaaccaatccgagtcatccagcgagcgtggaaagcgagaagcggccagggccgacaggcgaccccgac

SEQ ID NO: 482206 - DNA, 292 bp, Homo sapiens
atatacatgtacagatggcaaagagggggctgaccgggggtctgtgtagctggcctcagagtagtagaagtggtagtccatgaccggtccagatctttgtagagcgattcctccaccacggtctagagatcctagatagatcagatcagacatacatatgtaaggcgatgagtgatgaccacatactgggacatatgtagaggagtagtactaaggtagactactaccatatgtggctctcataggcattacttgagcagctaccggcaggcatgtacgtccagtaggcata

SEQ ID NO: 482207 - DNA, 144 bp, Homo sapiens
tcgtagaaaggaggaaaatatttagtccaaaagatggcagaaacaagaaattcatcctgaaagtatagtttggtgctattctgatgagatggctcatccctgtcaacgtgctctccagctgaccaccccttctgtcgtcttctc

SEQ ID NO: 482208 - DNA, 454 bp, Homo sapiens
ttcttttctgacccgtcagaagtcaggaattagaacgacgatctgccatgatctagaggccaggtgagcggcggatggagggatgcgctgcagcacctgcaggcggaagaagaagaagatgcatctgaccatccaggcgcttgaggatgcggctggaggcggcggagagcgcccgggagaagctgtcaggtggaagaaggtgaccaccgaggcgaagctgaaaaatctggaggcggagccgatcatcctggaggacccgaactgcaagctggccaaggaaaagaaactgctggaagacagaatagctgatttcaccaccaacctcgcagaagaggaggcgaaatctaagagcctcgccaagctcaagaacaagcatgaggcactgatcactgacttggaagagcgcctccgcagggaggagaagcagcgacagggtcaggaagagcaccgcagt

SEQ ID NO: 482209 - DNA, 1164 bp, Homo sapiens
  misc_feature (1164)..(1164): n is a, c, g, or t
ataaaagatgccacaggctcagaatcaacctgttaaaattgggtatatatatgaatgggccagatatacttaatgttcagtacactgactaatatgcgtcatgaccactaagttagtttgggggatgtgacttaatagtgtttctttagggaaaacagcaacccgaagtgttttagccaaatttaagtgggtaccattgtaagctcaaaatacacaacgactgcagaatgtacggtctgtgagctgacaacaactcaaacactagtacattattgccctgaaatgaggtgggtttattgtttacgttattaactgctttcttcgtagtagtcacgagagagtctcactctgccacccaggctggaatgcagtggcaccatcatggcttcctgcagctcccaactagagctcctcctgcctcagcctcccgagtggctgggaccgcaggcgcgtgccagcacagacgggccagattacagtacggcacaaacaggaaaagatgggtctcactgtgatgcccaggctagtgatacgaaaaagagcttactgtgccttagtaaattttaaattaactactcaagagcctttccccatctcaaaacattataatggacagttacaagctcaatccacactagcaccaaacactaaacactgcttcacacagtaccataaatacaggaacgaacaaaggggaccctcctcaaaaccctttccgtggactcaacatttcaaacgggtgagataaatgcctcccacaaggcaaactaacatacacacacagaaacgggcggtgcacacgggcccggtactggcaccctaagtggacactggggcccgataaacttcttcataacattaaaatacacttggtccatcacaacagggggctacacatagaatcaggaaccaaaaagagcaattgtcacgagaaccacagcacaaggaacaaaacccccacagacaacaaacagcacgacacaagcccacaacaaaaaacaacgagaaatacggacaaaccaacaaagcaaaagggagaaccaagaaccatgacaagagacaaaacacaccacgcacagagaaaatacaacgaaacacaacacacaaacaccacacaaaaacacaagagagagacaaaagcaccacacgtcagaacagtaagtn

SEQ ID NO: 482210 - DNA, 6329 bp, Homo sapiens
  misc_feature (6318)..(6318): n is a, c, g, or t
  misc_feature (6320)..(6320): n is a, c, g, or t
cggggccaaagacctggtgtgttccaagatgtccagggccaaggatgccgtgtcctccggggtggccagcgtggtggacgtggctaagggagtggtccagggaggcctggacaccactcggtctgcacttacgggcaccaaggaggcggtgtccagcggggtcacaggggccatggacatggctaagggggccgtccaagggggtctggacacctcgaaggctgtcctcaccggcaccaaggacacggtgtccactgggctcacgggggcagtgaatgtggccaaagggaccgtacaggccggtgtggacaccaccaagactgtgctgaccggcaccaaagacacagtgactactggggtcatgggggcagtgaacttggccaaagggactgtccagactggcgtggaaacctccaaggctgtgctgaccggcaccaaagatgctgtgtccactgggctcacaggggcagtgaatgtggccagaggaagcattcagaccggtgtggacaccagtaagactgtcctaacaggtaccaaggacaccgtctgtagtggggtgaccagtgccatgaatgtggccaaaggaaccatccagaccggcgtggacaccagtaagactgtcctaacaggtaccaaggacaccgtctgtagtggggtgactggtgccatgaatgtggccaaaggaaccatccagaccggcgtggacaccagtaagactgtcctaacaggtaccaaggacaccgtctgtagtggggtgactggtgccatgaatgtggccaaaggaaccatccagaccggcgtggacaccaccaagactgtcctaactggcaccaagaacactgtctgcagtggggtgaccggtgccgtgaacttggccaaagaggccatccaggggggcctggataccaccaagtctatggtcatgggtacgaaagacacgatgtccactgggctcacgggggcagcgaatgtggccaagggggccatgcaaactgggctgaacacaacccaaaatatcgcaacaggtacaaaggacaccgtctgcagtggggtgactggtgccatgaatttggccagaggaaccatccagacaggcgtggacaccaccaagatcgttctaactggtaccaaggacactgtctgcagtggggtcaccggtgctgcgaatgtggccaaaggggccgtccaggggggcctggacactacaaagtctgtcctgactggcactaaagatgctgtgtccactgggctcacaggggctgtgaacgtggccaaagggaccgtccagaccggcgtagacaccaccaagactgtcctaaccggcaccaaggacaccgtctgcagtggggtgaccagtgctgtgaacgtggccaaaggggccgtccaggggggcctggacaccaccaagtctgtggtcataggtacaaaagacacgatgtccactgggctcacgggggcagcgaatgtggccaagggggctgtccagacaggtgtagacacagccaagaccgtgctgaccggcaccaaggacacagtgactactgggctcgtgggggcagtgaatgtcgccaaagggaccgtccagacaggcatggacaccaccaaaactgtcctaaccggtaccaaggacaccatctacagtggggtcaccagtgccgtgaacgtggccaagggggctgtgcaaactgggctgaaaacgacccaaaatatcgcgacaggtacaaagaacacctttggcagtggggtgaccggtgctgtgaatgtggccaaaggggccgtccagacaggtgtagacacagccaagaccgtgctgaccggcaccaaggacacagtcactactgggctcatgggggcagtgaatgtcgccaaagggactgtccagaccagtgtggacaccaccaagactgtcctaactggtaccaaggacaccgtctgcagtggggtgaccggtgctgcgaatgtggccaagggggccgtccagacgggtgtagacacggccaagaccgtgctgaccggtaccaaggacactgtctgcagtggggtcaccggtgctgtgaacgtggccaagggtgctgtgcaaactgggctgaaaacgacccaaaatatcgcaacaggtacaaagaacacccttggcagtggggtgaccggtgctgcgaatgtggccaaaggggccgtccaggggggcctggacactacaaagtctgtcctgactggcactaaagatgctgtgtccactgggctcacaggggctgtgaacttggccaaagggactgtccagaccggcatggacaccaccaagactgtgttaactggtaccaaggatgctgtgtgcagtggggtgaccggtgctgcgaatgtggccaagggggccgtccagacgggtgtagacacggccaagaccgtgctgaccggcaccaaggacacagtcactactgggctcatgggggcagtgaatgtcgccaaagggaccgtccagaccagtgtggacaccaccaagactgtcctaactggtaccaaggacaccgtctgcagtggggtgaccggtgctgcgaatgtggccaagggggccgtccaggggggcctggacactacaaagtctgtcctgactggcactaaagacaccgtatccactgggctcacaggggctgtgaacttggccaaagggactgtccagaccggcgtggacaccagcaagactgtcctgaccggtaccaaggacaccgtctgcagtggagtcactggtgccgtaaatgtggccaaaggcaccgtccagacaggtgtggacacagccaagacggtgctgagtggcgctaaggatgcagtgactactggagtcacgggggcagtgaatgtggccaaaggaaccgtgcagaccggcgtggacgcctccaaggctgtgcttatgggtaccaaggacactgtcttcagtggggttaccggtgccatgagcatggccaaaggggccgtccaggggggcctggacaccaccaagacagtgctgaccggaaccaaagacgcagtgtccgctgggctcatggggtcagggaacgtggcgacaggggccacccacactggcctcagcaccttccagaactggttacctagtacccccgccacctcctggggtggactcaccagttccaggaccacagacaatggtggggagcagactgccctgagcccccaagaggccccgttctctggcatctccacgcccccggatgtgctcagtgtaggcccggagcctgcctgggaagccgcagccactaccaagggccttgcgactgacgtggcgacgttcacccaaggggccgccccaggcagggaggacacggggcttttgaccaccacacacggccccgaagaagccccacgcttggcaatgctgcagaatgagttggaggggctgggggacatcttccaccccatgaatgcggaggagcaagctcagctggctgcctcccagcccgggccaaaggtgctgtcggcggaacaggggagctacttcgttcgtttaggtgacctgggtcccagcttccgccagcgggcatttgaacacgcggtgagccacctgcagcacggccagttccaagccagggacactctggcccagctccaggactgcttcaggctgattgaaaaggcccagcaggctccagaagggcagccacgtctggaccagggctcaggtgccagtgcggaggacgctgctgtccaggaggagcgggatgccggggttctgtccagggtctgcggccttctccggcagctgcacacggcctacagtggcctggtctccagcctccagggcctgcccgccgagctccagcagccagtggggcgggcgcggcacagcctctgtgagctctatggcatcgtggcctcagctggctctgtagaggagctgcccgcagagcggctggtgcagagccgcgagggtgtgcaccaggcttggcaggggttagagcagctgctggagggcctacagcacaatcccccgctcagctggctggtagggcccttcgccttgcccgctggcgggcagtagctgtaggagcctgcaggcccggcgcggggtcgccctgctctgtccagggaggagctgcctcagaactttctccccgcccccaaacctggatcggttccctaaagccctagacctttggggctgcagctggctgagcgccgaggggctgcggaggcagtgaccttcttaactgagccaccccacgccctgctccgggcctgcctgcatctcccacctcctccccagcgctgcctgcccctctcggagcctggggtcactcagaccaccagccaagagccttcccttgaagtccccaagcaagcactgcaattaggaaagagaaaaagcagcgtgcccagcctggaagggcatctgtttgccccgctagcaacccttttatatctagcagggctcttccagtcctgcagcacgggcccccagctatcagcggtgcaggcagtgctgtggcatcccaggctccgggcagctccgttctcatgctgaaagtgggtctccggccttagcacacacaccttgagggtcttaagaaccacattccctcatagtagaaagtactagaaaaagcgacactgccatcatcatcccaaggcaggctgctactgcctttgctgacccccggggtggcctcacggtggggacaaagctgccaggagccacagcagccacagctggggctttgcaccagcctggcttgagactgagcagtttgcagggggtggggggtgcaaaaaacaagcaaacaggctgctgctgcctccagctgcccaccacaggcctgccccaggcacctggggctctgaggcccctggggaggctgggcccagcagctgcccctggagaacacagacaaaggacttccccgcagggaactgtgccctatggagggatcagacagggctgggaacagccacagaggctgcgtgcctatggcacagcccttcctccgccgcacactccccctgggtcctcaggcccacccaagcgccgggctgcagaggaagcggggctggggaggctgcaggcatcagagacactggtggtggcggacccggccgccgggccccgtgctctcaggctagcccaggtcgtggaggctggcaggctcaggtcgggtgtgagacgtgccgtggctgcgctcagtccagcggggaggagccgttcagcccggcctccccaggaagccatatccccactcacccggtaagagaaccttgtcgtcccctttccatgctctcctaggacacgagcccaggaaccccagacccagggggaggaagggtggaggggccccaggggtcaccgtgtgcaccaggggccgtgaggggccggggcattcagctcagctctgaaccggggaagctggcacggcaaggactgcctcaggtgacgggccgtgagaggggacgggtcaggagccttcccaagccttctcctcagcccgacacccatggccatcggaggctaggatgccagacacagccatttgcagaaatcaggcacagtgactgcagctcacgtccagccaaccaagcatggggccgcagctcaggaagtcccttcccgccacaccacagcctaattcttactgggacggaggcaactcggctacgctgggcaggacgacaaacacgagacgccactgtggaatgagcaacttcggagcacggggtgacttgcttgggaccgtgcccacgtgacagccccttatgcagaggaggaaagagaagccccgagtgggaggggaacctgtccaaagtcacacggtgtgtgggtgacacagctggggtgagtcgaggctggcccctgaggcccatgctccctgaacgctggagaccactgtcggctagcagcggctctcagggaaggcctggtctccaccctcccagcctagcctcgcggaccctcgtcctccccacatcggacctgctcacctgcctggaccctgggctgccagatgcaggaagcatcaaaccccccagcctcgtgggtgcggggcagggcgcaggcagcacagcttagatgccctggtttgtccctcttgtctcctgggaagagcttgctcccgcccagctctcctgccactggcctttcagggttgggctgggcccagagtgccttttagtcgcttctcacggtggcctgatggctcaacccagtcccaaacgggcccagtgacactgccgactgcaccccagctcaggcccccactgcaccagcaatgctagaaaaccaagccaataaaagtgatttcttttttcattaaaaaaacnanttatagtca

SEQ ID NO: 482211 - DNA, 800 bp, Homo sapiens
ttcaagaaccttggaaaagaacaagaagaaagggaagatcttttaaactctctatgaccaccagttaacgtattagtgccaatatgccagcttggacatcagtgttcttgtcggatccgtttgaccaatttgcaccagttttatccataatgatggatttaacagcatgacaaaaattattttcatttttctggttcttggatgggagattaacgatgcctgtgaatggtctagggtggtatctggtcacttagaacagtacagacgcttctaagtacctttccctacatttccactttcttttattaaacacaggatatcttacagtttacatggcacagagaacattttactctggttggtacaatcatggtccctgggtgggttggactcggttcacaccggattatccccaaacataacaaagggatctcgggaaacgattccacatcggacggactaactgtgcccatacattatggatgccacatctggtgcctctctctatggatacagttcacaatacaaaggtctccattcagtggcacgccactatcgccaataatgtgttagctgtctggctcttaacacaggttggacccataattttgttgaccccttacaatgggttcagacaacttccctttgctcataaaaaataccccataatagtgccttacgggcacccccaaacactcttttacttaaccacctgacactggttgggagtcgctgggcggcttttcaactttatcttactcccacattagggcccctttaatccgaatcccattaggtgt

SEQ ID NO: 482212 - DNA, 166 bp, Homo sapiens
ctcacgtgcgatatacactaagatcagatgacaacaaagctttgtggaaatatgtggtggtagtatattctatggtggtctatatgtacggtttgttgtgctgtttatcactgtcagatgagagattttgtctttgtagcctgataccaggagaagcattaaaagc

SEQ ID NO: 482213 - DNA, 338 bp, Homo sapiens
ccaaaagagcaagggatgagcctgaggaggtggagtggatgtcaagctggacaagtacacgccattgtggatagaggagccacactgccctgatgacattctgggacacgccaccattatccaagagctctggtcccatatagcaattcggcattgccacagagagaacagtgccacaatcagagtgatatataagcaactcctacaggcgaaggccctgcagttcctccagattgacagttgcagactgggcagtgtcaatgagaacttctcagtattgctgatggccaaaaagtttgaaatacctgtatgcccccatgctggtggagttggcctct

SEQ ID NO: 482214 - DNA, 6323 bp, Homo sapiens
cggggccaaagacctggtgtgttccaagatgtccagggccaaggatgccgtgtcctccggggtggccagcgtggtggacgtggctaagggagtggtccagggaggcctggacaccactcggtctgcacttacgggcaccaaggaggcggtgtccagcggggtcacaggggccatggacatggctaagggggccgtccaagggggtctggacacctcgaaggctgtcctcaccggcaccaaggacacggtgtccactgggctcacgggggcagtgaatgtggccaaagggaccgtacaggccggtgtggacaccaccaagactgtgctgaccggcaccaaagacacagtgactactggggtcatgggggcagtgaacttggccaaagggactgtccagactggcgtggaaacctccaaggctgtgctgaccggcaccaaagatgctgtgtccactgggctcacaggggcagtgaatgtggccagaggaagcattcagaccggtgtggacaccagtaagactgtcctaacaggtaccaaggacaccgtctgtagtggggtgaccagtgccatgaatgtggccaaaggaaccatccagaccggcgtggacaccagtaagactgtcctaacaggtaccaaggacaccgtctgtagtggggtgactggtgccatgaatgtggccaaaggaaccatccagaccggcgtggacaccagtaagactgtcctaacaggtaccaaggacaccgtctgtagtggggtgactggtgccatgaatgtggccaaaggaaccatccagaccggcgtggacaccaccaagactgtcctaactggcaccaagaacactgtctgcagtggggtgaccggtgccgtgaacttggccaaagaggccatccaggggggcctggataccaccaagtctatggtcatgggtacgaaagacacgatgtccactgggctcacgggggcagcgaatgtggccaagggggccatgcaaactgggctgaacacaacccaaaatatcgcaacaggtacaaaggacaccgtctgcagtggggtgactggtgccatgaatttggccagaggaaccatccagacaggcgtggacaccaccaagatcgttctaactggtaccaaggacactgtctgcagtggggtcaccggtgctgcgaatgtggccaaaggggccgtccaggggggcctggacactacaaagtctgtcctgactggcactaaagatgctgtgtccactgggctcacaggggctgtgaacgtggccaaagggaccgtccagaccggcgtagacaccaccaagactgtcctaaccggcaccaaggacaccgtctgcagtggggtgaccagtgctgtgaacgtggccaaaggggccgtccaggggggcctggacaccaccaagtctgtggtcataggtacaaaagacacgatgtccactgggctcacgggggcagcgaatgtggccaagggggctgtccagacaggtgtagacacagccaagaccgtgctgaccggcaccaaggacacagtgactactgggctcgtgggggcagtgaatgtcgccaaagggaccgtccagacaggcatggacaccaccaaaactgtcctaaccggtaccaaggacaccatctacagtggggtcaccagtgccgtgaacgtggccaagggggctgtgcaaactgggctgaaaacgacccaaaatatcgcgacaggtacaaagaacacctttggcagtggggtgaccggtgctgtgaatgtggccaaaggggccgtccagacaggtgtagacacagccaagaccgtgctgaccggcaccaaggacacagtcactactgggctcatgggggcagtgaatgtcgccaaagggactgtccagaccagtgtggacaccaccaagactgtcctaactggtaccaaggacaccgtctgcagtggggtgaccggtgctgcgaatgtggccaagggggccgtccagacgggtgtagacacggccaagaccgtgctgaccggtaccaaggacactgtctgcagtggggtcaccggtgctgtgaacgtggccaagggtgctgtgcaaactgggctgaaaacgacccaaaatatcgcaacaggtacaaagaacacccttggcagtggggtgaccggtgctgcgaatgtggccaaaggggccgtccaggggggcctggacactacaaagtctgtcctgactggcactaaagatgctgtgtccactgggctcacaggggctgtgaacttggccaaagggactgtccagaccggcatggacaccaccaagactgtgttaactggtaccaaggatgctgtgtgcagtggggtgaccggtgctgcgaatgtggccaagggggccgtccagacgggtgtagacacggccaagaccgtgctgaccggcaccaaggacacagtcactactgggctcatgggggcagtgaatgtcgccaaagggaccgtccagaccagtgtggacaccaccaagactgtcctaactggtaccaaggacaccgtctgcagtggggtgaccggtgctgcgaatgtggccaagggggccgtccaggggggcctggacactacaaagtctgtcctgactggcactaaagacaccgtatccactgggctcacaggggctgtgaacttggccaaagggactgtccagaccggcgtggacaccagcaagactgtcctgaccggtaccaaggacaccgtctgcagtggagtcactggtgccgtaaatgtggccaaaggcaccgtccagacaggtgtggacacagccaagacggtgctgagtggcgctaaggatgcagtgactactggagtcacgggggcagtgaatgtggccaaaggaaccgtgcagaccggcgtggacgcctccaaggctgtgcttatgggtaccaaggacactgtcttcagtggggttaccggtgccatgagcatggccaaaggggccgtccaggggggcctggacaccaccaagacagtgctgaccggaaccaaagacgcagtgtccgctgggctcatggggtcagggaacgtggcgacaggggccacccacactggcctcagcaccttccagaactggttacctagtacccccgccacctcctggggtggactcaccagttccaggaccacagacaatggtggggagcagactgccctgagcccccaagaggccccgttctctggcatctccacgcccccggatgtgctcagtgtaggcccggagcctgcctgggaagccgcagccactaccaagggccttgcgactgacgtggcgacgttcacccaaggggccgccccaggcagggaggacacggggcttttgaccaccacacacggccccgaagaagccccacgcttggcaatgctgcagaatgagttggaggggctgggggacatcttccaccccatgaatgcggaggagcaagctcagctggctgcctcccagcccgggccaaaggtgctgtcggcggaacaggggagctacttcgttcgtttaggtgacctgggtcccagcttccgccagcgggcatttgaacacgcggtgagccacctgcagcacggccagttccaagccagggacactctggcccagctccaggactgcttcaggctgattgaaaaggcccagcaggctccagaagggcagccacgtctggaccagggctcaggtgccagtgcggaggacgctgctgtccaggaggagcgggatgccggggttctgtccagggtctgcggccttctccggcagctgcacacggcctacagtggcctggtctccagcctccagggcctgcccgccgagctccagcagccagtggggcgggcgcggcacagcctctgtgagctctatggcatcgtggcctcagctggctctgtagaggagctgcccgcagagcggctggtgcagagccgcgagggtgtgcaccaggcttggcaggggttagagcagctgctggagggcctacagcacaatcccccgctcagctggctggtagggcccttcgccttgcccgctggcgggcagtagctgtaggagcctgcaggcccggcgcggggtcgccctgctctgtccagggaggagctgcctcagaactttctccccgcccccaaacctggatcggttccctaaagccctagacctttggggctgcagctggctgagcgccgaggggctgcggaggcagtgaccttcttaactgagccaccccacgccctgctccgggcctgcctgcatctcccacctcctccccagcgctgcctgcccctctcggagcctggggtcactcagaccaccagccaagagccttcccttgaagtccccaagcaagcactgcaattaggaaagagaaaaagcagcgtgcccagcctggaagggcatctgtttgccccgctagcaacccttttatatctagcagggctcttccagtcctgcagcacgggcccccagctatcagcggtgcaggcagtgctgtggcatcccaggctccgggcagctccgttctcatgctgaaagtgggtctccggccttagcacacacaccttgagggtcttaagaaccacattccctcatagtagaaagtactagaaaaagcgacactgccatcatcatcccaaggcaggctgctactgcctttgctgacccccggggtggcctcacggtggggacaaagctgccaggagccacagcagccacagctggggctttgcaccagcctggcttgagactgagcagtttgcagggggtggggggtgcaaaaaacaagcaaacaggctgctgctgcctccagctgcccaccacaggcctgccccaggcacctggggctctgaggcccctggggaggctgggcccagcagctgcccctggagaacacagacaaaggacttccccgcagggaactgtgccctatggagggatcagacagggctgggaacagccacagaggctgcgtgcctatggcacagcccttcctccgccgcacactccccctgggtcctcaggcccacccaagcgccgggctgcagaggaagcggggctggggaggctgcaggcatcagagacactggtggtggcggacccggccgccgggccccgtgctctcaggctagcccaggtcgtggaggctggcaggctcaggtcgggtgtgagacgtgccgtggctgcgctcagtccagcggggaggagccgttcagcccggcctccccaggaagccatatccccactcacccggtaagagaaccttgtcgtcccctttccatgctctcctaggacacgagcccaggaaccccagacccagggggaggaagggtggaggggccccaggggtcaccgtgtgcaccaggggccgtgaggggccggggcattcagctcagctctgaaccggggaagctggcacggcaaggactgcctcaggtgacgggccgtgagaggggacgggtcaggagccttcccaagccttctcctcagcccgacacccatggccatcggaggctaggatgccagacacagccatttgcagaaatcaggcacagtgactgcagctcacgtccagccaaccaagcatggggccgcagctcaggaagtcccttcccgccacaccacagcctaattcttactgggacggaggcaactcggctacgctgggcaggacgacaaacacgagacgccactgtggaatgagcaacttcggagcacggggtgacttgcttgggaccgtgcccacgtgacagccccttatgcagaggaggaaagagaagccccgagtgggaggggaacctgtccaaagtcacacggtgtgtgggtgacacagctggggtgagtcgaggctggcccctgaggcccatgctccctgaacgctggagaccactgtcggctagcagcggctctcagggaaggcctggtctccaccctcccagcctagcctcgcggaccctcgtcctccccacatcggacctgctcacctgcctggaccctgggctgccagatgcaggaagcatcaaaccccccagcctcgtgggtgcggggcagggcgcaggcagcacagcttagatgccctggtttgtccctcttgtctcctgggaagagcttgctcccgcccagctctcctgccactggcctttcagggttgggctgggcccagagtgccttttagtcgcttctcacggtggcctgatggctcaacccagtcccaaacgggcccagtgacactgccgactgcaccccagctcaggcccccactgcaccagcaagatagccgacctaccaaatagattcttccggcgggggggggtggggggggggggtc

SEQ ID NO: 482215 - DNA, 270 bp, Homo sapiens
caagtgtcggatccgcagacgcagcgttcccgattgtttgtcccttacagccattgtatttcgggcttctaggcagagactttgggggattggaacccgcacagagcccgcggggcccttttgcagctgcgattttccgccctacggttttcaacggggggtacttttattggcaatttgctgggagaggattttgcaatttgttggcttcctgatactcgattgagtgaagggttttcattcatacgcggaatagccccaaatgttaca

SEQ ID NO: 482216 - DNA, 1759 bp, Homo sapiens
  misc_feature (458)..(458): n is a, c, g, or t
  misc_feature (512)..(512): n is a, c, g, or t
  misc_feature (1759)..(1759): n is a, c, g, or t
tttttttttttaccaaaacgtattaaaattccccatagtccaaaataaaatgtaaccataaaatggggagataactttagcttcaaagaccaagttaaattttacctttcttgtgcagaactctccaggcttgtagctcacgttaacaagctgtggcccacttgtttgctttaactttttgtgttacaagtgggacaaaaaaaacacaatataaagagcttataaatgtgtgtgtgctccagccattattgaacaactctcttctcttcaaaagacacagaatgaaaagtctcgatgtgaccattgtgtgtgtgggaacaagtgtgtcttattcacatttctcacacagtgaaaattctcttattctcagatgtgtggatctcgtgtgttgtgagatgtgtattgtgatctttacaaaccctatatattgtgcggctctctatagcccccaatataanatgtgtgcgtaaagtgtgcatctctcaacgctccatgtgtgtacaaagaagacncacactcttcttatatctcctctatgacaagcgctgtttacgacaacatttctctcatttatacgccacaatgtggcgcaacagcaggtgcaacgacggaaaacacggtgtgcggagtttactttacatccgactttcttcgacgctttctttagactctacacatcttgtgtgttggcccacaggcgggacaatatatacggcctgattacgacatgacacataaacacacttctacacacatcaccgacaacaaaacgacgacgttgtttacccccgaagaggtgctgacactaatgcatgatgatcgctgccacctgcttcctgttcgtaacaacatactgatcaacttcttctcctggccacgaaagttgctaccgttggaacagctctaatcttactttctcacacccacacgacgcatcaacaccatcattgaaacgcccctgctgtgcttgaagaagaggcagcaatactggggacgcccgcagccagtgggacatatatactcatccacccatctttcctcttataaacaaaccagaacgcgttgtgtcatcccccgctggcatcaaacgctgcggccctaaccagcgccaagctttttcaccaacgataacgatcggacgacgagcaccattctctccacacataaacggtttgtctatcgccgtatacacttctctagtttaccacgccacagaggcaaaaccaccaccaagacacgatcttcctgtctaccacagtacactcaccttaacaccgcccggcgcaacataacatacacgcgctgccacacacagagcaacaaacaacaagtgaacaagtatatctaccccataatggcgaggcgagctaccacacaggactacaacgcgttgatctcacaccaaagcggaaaaagctgacatttgtcgcccaagacgtctgaccaaccgaaacaagcaaatgggtgtgccgacatgtggggagctagacaaccccgacgcgcagtatcatacaacgccactaacaggcatatacactaagaacgtgtagaggagacaaaccaaaacacaacaactatgagcaactcggtcagcacaccatacattcgtaggaacagcaggcagatataccgtcgagcaggtctacagcgagacgcggcacatacgaggagcgtactgatcatggagggagccatctgacatacacataaaagctagccaccaagcagactgcagacagcagccccacacacacacgcn

SEQ ID NO: 482217 - DNA, 2998 bp, Homo sapiens
  misc_feature (2987)..(2987): n is a, c, g, or t
  misc_feature (2989)..(2989): n is a, c, g, or t
cggggccaaagacctggtgtgttccaagatgtccagggccaaggatgccgtgtcctccggggtggccagcgtggtggacgtggctaagggagtggtccagggaggcctggacaccactcggtctgcacttacgggcaccaaggaggcggtgtccagcggggtcacaggggccatggacatggctaagggggccgtccaagggggtctggacacctcgaaggctgtcctcaccggcaccaaggacacggtgtccactgggctcacgggggcagtgaatgtggccaaagggaccgtacaggccggtgtggacaccaccaagactgtgctgaccggcaccaaagacacagtgactactggggtcatgggggcagtgaacttggccaaagggactgtccagactggcgtggaaacctccaaggctgtgctgaccggcaccaaagatgctgtgtccactgggctcacaggggcagtgaatgtggccagaggaagcattcagaccggtgtggacaccagtaagactgtcctaacaggtaccaaggacaccgtctgtagtggggtgaccagtgccatgaatgtggccaaaggaaccatccagaccggcgtggacaccagtaagactgtcctaacaggtaccaaggacaccgtctgtagtggggtgactggtgccatgaatgtggccaaaggaaccatccagaccggcgtggacaccagtaagactgtcctaacaggtaccaaggacaccgtctgtagtggggtgactggtgccatgaatgtggccaaaggaaccatccagaccggcgtggacaccaccaagactgtcctaactggcaccaagaacactgtctgcagtggggtgaccggtgccgtgaacttggccaaagaggccatccaggggggcctggataccaccaagtctatggtcatgggtacgaaagacacgatgtccactgggctcacgggggcagcgaatgtggccaagggggccatgcaaactgggctgaacacaacccaaaatatcgcaacaggtacaaaggacaccgtctgcagtggggtgactggtgccatgaatttggccagaggaaccatccagacaggcgtggacaccaccaagatcgttctaactggtaccaaggacactgtctgcagtggggtcaccggtgctgcgaatgtggccaaaggggccgtccaggggggcctggacactacaaagtctgtcctgactggcactaaagatgctgtgtccactgggctcacaggggctgtgaacgtggccaaagggaccgtccagaccggcgtagacaccaccaagactgtcctaaccggcaccaaggacaccgtctgcagtggggtgaccagtgctgtgaacgtggccaaaggggccgtccaggggggcctggacaccaccaagtctgtggtcataggtacaaaagacacgatgtccactgggctcacgggggcagcgaatgtggccaagggggctgtccagacaggtgtagacacagccaagaccgtgctgaccggcaccaaggacacagtgactactgggctcgtgggggcagtgaatgtcgccaaagggaccgtccagacaggcatggacaccaccaaaactgtcctaaccggtaccaaggacaccatctacagtggggtcaccagtgccgtgaacgtggccaagggggctgtgcaaactgggctgaaaacgacccaaaatatcgcgacaggtacaaagaacacctttggcagtggggtgaccggtgctgtgaatgtggccaaaggggccgtccagacaggtgtagacacagccaagaccgtgctgaccggcaccaaggacacagtcactactgggctcatgggggcagtgaatgtcgccaaagggactgtccagaccagtgtggacaccaccaagactgtcctaactggtaccaaggacaccgtctgcagtggggtgaccggtgctgcgaatgtggccaagggggccgtccagacgggtgtagacacggccaagaccgtgctgaccggtaccaaggacactgtctgcagtggggtcaccggtgctgtgaacgtggccaagggtgctgtgcaaactgggctgaaaacgacccaaaatatcgcaacaggtacaaagaacacccttggcagtggggtgaccggtgctgcgaatgtggccaaaggggccgtccaggggggcctggacactacaaagtctgtcctgactggcactaaagatgctgtgtccactgggctcacaggggctgtgaacttggccaaagggactgtccagaccggcatggacaccaccaagactgtgttaactggtaccaaggatgctgtgtgcagtggggtgaccggtgctgcgaatgtggccaagggggccgtccagacgggtgtagacacggccaagaccgtgctgaccggcaccaaggacacagtcactactgggctcatgggggcagtgaatgtcgccaaagggaccgtccagaccagtgtggacaccaccaagactgtcctaactggtaccaaggacaccgtctgcagtggggtgaccggtgctgcgaatgtggccaagggggccgtccaggggggcctggacactacaaagtctgtcctgactggcactaaagacaccgtatccactgggctcacaggggctgtgaacttggccaaagggactgtccagaccggcgtggacaccagcaagactgtcctgaccggtaccaaggacaccgtctgcagtggagtcactggtgccgtaaatgtggccaaaggcaccgtccagacaggtgtggacacagccaagacggtgctgagtggcgctaaggatgcagtgactactggagtcacgggggcagtgaatgtggcctgatggctcaacccagtcccaaacgggcccagtgacactgccgactgcaccccagctcaggcccccactgcaccagcaatgctagaaaaccaagccaataaaagtgatttcttttttcattaaaaaaacnanttatagtca

SEQ ID NO: 482218 - DNA, 116 bp, Homo sapiens
caactcctgcccagctgagttgcccaacatcaaacgggagatctctgagaccgaggcaaaggcccttttgaaggaacggccagatagctgagcatatcatcattgcaacacgttct

SEQ ID NO: 482219 - DNA, 147 bp, Homo sapiens
cggatacgctacagcgcaggactacttatgcttactatgagtgtggactatgaacagaacgctaaaggttccaatcaaccggagaaacagggtaatgatggtggcacagaaattccaggatgctggtgacagaatctcaagcttagc

SEQ ID NO: 482220 - DNA, 88 bp, Homo sapiens
ggatttgctggtgcagtacaactaggcttaatagggacatgtgctgttttctcagctaagcagccttcttcgacccttgccaaaaaaa

SEQ ID NO: 482221 - DNA, 818 bp, Homo sapiens
tcttcttctcctgtctttttttttttattttatggttagccatgtcgtccttgatcagaagggtgatcagcaccggaaagcccagggcatggaccctacagtcaagctgtataagtcgacgaggaccatttacatttcaggacagataggcatggaccccttcaagtggacagtgtgtgtcaggaggggtagcagaagaagtaaacaagctcttaaaaaccatgggtgaaattctgaaagctgcaggtgtgacttacactaaacgtggtgaaaacaaggtgtcttctggtgacataaatgattcaaatactgtcaatgaaatctacaaacagtatttacacgagtaatttcctgttagagctgttacaagtgggtgtttacccaaaggcagcgaatggaacttgacgcagtagttatcagggaccatgacaaggttcactataaggtgggccagtgtgtgttagtctgaatgtgtaaacatttaacttttaacaattgatgtacatcttaattaacctttaatttcaacaattgtgccgtgtggatttgatgaaaattatctgaggctatatggaatacatgtaatagggcgagttggacctgatattagagaaggatcagtactttttaattaacctggtggcctgttatgattggacaggatacccttatagttttcgtacaagaacatcggtgaagcagtcatctgaaatcgacatatttcacgaggcaatggggggcggaagcagaaaaaggataacggaggacattattttggagcgaaaaaagcgggatggggaatgtgtgaacaagacagg

SEQ ID NO: 482222 - DNA, 501 bp, Homo sapiens
agagtggagcttgacagtacatagaagagtaaatcctcatagaagggccaggcgcagtggctcacgcctgtaatcccagctctttgggaggccgaggcaggtggatcattttaggccaggagctggaaaccaacatggtgaaaccctgtctctactaaaaataaaaaaaagtaccctttccacaaaaaatacaaaaattagctgggcatggtaacgcgcatgtccgtagttccagcttctcagggggctgagctgagaggatctcctgaacccaggagttcaagagcagctgggcaacataacgatatcccgtctctaccaaaaattaaaaattagctgacacaaaaaaattagccaggtgtagtggcatgcaccttatagtttcagctactccagagggtgaagtgtgaggatcactggagcctggaaggttgaggcagcagtgagttatggttgcttcactgcacttcagcctaggtgacagtgagaccctgtctcaaa

SEQ ID NO: 482223 - DNA, 296 bp, Homo sapiens
  misc_feature (86)..(86): n is a, c, g, or t
  misc_feature (162)..(162): n is a, c, g, or t
  misc_feature (233)..(233): n is a, c, g, or t
  misc_feature (283)..(283): n is a, c, g, or t
caaagtgctgggactacaggtgtgtagtccaccacactcggcctatttgttttttttgaggtggagtcttgctctgttgcccaggntggagtgcagtggtgcaatcttggctcactgcagcctctgcctcctgggctcaagcagtgctcctgccttagcctnctgagtagctgggactgcaggtgcttgcccccattcccagctagttttgtatttttagtagagagcgggtntcaccctgttggccaggctggtctcaaactcctgacctcaagtggtccanccattcttcagcc

SEQ ID NO: 482224 - DNA, 306 bp, Homo sapiens
tcgacaaagtaatacaattaaagatgcaaagaaaagcttagtagaataaaaccaaagaggccaggcacggtggctcacgcctgtaatcccagcactttggaaggctgacgtgggcggatcatttgaggtcaggagttcgagaccagactggacaacatggtgaaacctgtctctcctaaaaatacaaaaattagccaggtgtggtggtatgtgcctgtaatcccagctactgggaggctgaggtaggagaatcccttgaaccctgaggcagagtttgcagtgagctgagatcgtaccattgcactc

SEQ ID NO: 482225 - DNA, 212 bp, Homo sapiens
tctttctcctgctctctctcattttattcaggtcttttctcagctcatttcacattgaagaggcttccctgactaccctaactgaaataacacctctcactctctggctatttactttgcattgcctttcaaagataatacacccagcatatgcctaacatataataactgctcaataaatatttgttgaacaaattgatggaaaaaaaaaa

SEQ ID NO: 482226 - DNA, 509 bp, Homo sapiens
caatgtcatgctcagggagctaatatgaatcccaaaggaatattgactgttcaggctcaagttaaattacagcagatcgaaagtgaggagttgagtggcatcttcttttctcttactgtcgaccttgttaaatggggagtccacaccccttgcctactcctccctcctcaaccccgtgacagtgggcctccccccaactgtattgagcatgcactctaaaacagttactttttgagaagtcaagtctggtgacccattctcagcccctcatccctttgatctccttggcagcatcctaccctaaggccttctctatgcttctctggacttctctgctgacccttctcttcctttgaggacagtaacaaggtttttccaactctcgatctcccagtatcccaaagaaataccttctgatttcaaactgaacccatccagatgtcgtgggacctgaagcttgtataactcctgggggaacttcttaaaggaaagcaataaaaacttccaaa

SEQ ID NO: 482227 - DNA, 931 bp, Homo sapiens
gcgagtcggagaacgtgggactgaggcaggccaagtcggggagcctggcattcccagatggtgaggctgggccttcctgctcttcagacctctgacaatgctgtctcgagcttgctgaagtccaacgttctttgaggcacagtgaggatgacgctctagcagtgaggccgtgagagagacgaacgagagaaagaacagatgaggaaatgccaccgggcagggaaggcagggagtgggggtacgcgccatgtgagcgaggcagcagcaaatgacgagagacgcagtgaggcactgaaacacgatcgcaggcgtcgagagaggcaacgactgacatgacaggcaaagagaagatcgcacgatgaatgagtcggcaggaaactcgcggaaatggcacacacgacgagaggcttttggcgttgtgttgatctagaggtaacagagaagggacgagtggggatgggcggccctggattgagccggacgtgtgaaaaggacaaggtaaggaagtatagttaaaggcacaagaacggtccaggggaaaggaaattcatcgttgtgggttggtggggttacttcttgaagggggcttggggagagaaggctttttaagtaagaattggtaccacttaatccgattccactaagaagacaccgaaagcgacctggacgaagattagacgaccttacggggcaactgcggatgcgaacggataggtggcattgagtcggtggccacaatggtttccaacgcaattgggcaattgtgggggcgaatggtccaaaccccgcgggaggggcaccttcaaagcagctttcgttcgcaggaatgccccaattttcgtgggggaaacccatcgtgtcgtaattcataggacggaaacaagcaaaaggaaaatccattggtccgaaacccttgtgacggggaccaaca

SEQ ID NO: 482228 - DNA, 160 bp, Homo sapiens
ggtgggcgctgtgtctattgaggtgcttagcaataaagaaaaggcagtaagaaaaagaataaactatgaatatacaaaataacataggatgatatttaaaaaaacattatgttgagtgatagatattagactccctcaatttggattgcaggtggtcttc

SEQ ID NO: 482229 - DNA, 813 bp, Homo sapiens
tctcaggctctatggcccagtggatgggctgctggtgactggaatgaaggggagctggcctggggtcactgagtgcagattgtgtgctgctacctgttcctgtggactgtgccacatgatcccatcagatggcaccccagacacatgaaatgccatcaccaagtctgtgtgcctctcagcacctggccccccctcctgcccacccctgtggtgcccctgtgcagcgatgtcagatgctggcagatcctggagtacatgtgtgacttggacgctgagtcagcgacatatgtggtgctgcacatcttggttctgaagaccaactgtgtcccggggacttctgctacgtttggtggagcagtacttgtgtagccatggtatggctgaagtcagctgtctcgaaggaaagtgcgcagcctgcaagattgtggtgcacacgccctgcaatcgagcagctggagaagataacatttccgcatgtaagccgtcttccggtgaatcaggctccaggaatgtccagtgaggccaaacctttgtacgggaccaactggcgtacacagaacgacgccaagttgacggcacgtggtcggccacatggtgggcgacggggatttcccagcagaaagggttccaccctatccgacaggcgaaggggacgttttgtgggcgcatcccaggtgctccgttcggtgcaacgcgggggcgttccaaggccacggggtggcccgggttcagtggttgcgaggagggttcatgggagcctgctcgctgggtcctccgccgggtcatccggcgctggactcgtcccgtgcccag

SEQ ID NO: 482230 - DNA, 522 bp, Homo sapiens
ttggtgttgtgagtagatacggggtttgccgtgtggccaggctgatcttgaactccgtgaccctgaggtcacctgagtgatccatctgccttggcctcttaagtgctgggattataggcatgagccaccatgcctggccttggagttgattgtttttgaactgcatgggggcaggaggtgcttctgaccattttttgcttggcaaacatttattccttaactcactaccacaaccattgtcactcactagaaattggataaataattatcttgtttttattaatctttcttaaatgtatgtatagctcagatttattttagtgtttaatattgcaagtgtttgggtctttatttagaagtttcataatgttttggtgaccagaaatacgccagaggagcttaactcttgtttatatcaattagtctgtggcacaattggtttcctcatatgtttttacacttaaagtcagagtttccaagaacctgtcaatactgttaagtgaggacttactgatatgcata

SEQ ID NO: 482231 - DNA, 1088 bp, Homo sapiens
  misc_feature (563)..(563): n is a, c, g, or t
  misc_feature (569)..(570): n is a, c, g, or t
  misc_feature (573)..(573): n is a, c, g, or t
  misc_feature (583)..(583): n is a, c, g, or t
  misc_feature (657)..(657): n is a, c, g, or t
gcagagatgatctgacccggtgggggcagctggaaagcaacactggcccccagctgaagggcccagctgcagccagacagatggtgcttgagaaccgaggcccggtgatcctccagccacagtccagcccaaccactgccactttccatgggacttagaacttcggagttgctgccttgcaattggaggaaggacctggggccccataggcagcagccaattacagcccctttgtagccaggcgttcctatggtcaaagagtggaaatgcaggaacgcccggtgatcctccagccacagtccagcccaaccactgccactttccatgggacttagaacttcggagttgctgccttgcaattggaggaaggacctggggccccataggcagcagccaattacagcccctttgtagccaggcgttcctatggtcaaagagtggaaatgcaggaaccaacctccctttaaaaaaaaaaaatccagaaagcagataaaagtgggaatatggaaaagggcaagatgacccccaccagaggctcttgggcctgaaggtggagtctctgnctccgnnccngttctctatntctcctgtcacagactctgcctgacccctttcctcagtcccttctggtccccttcctcagctcctccggcactngtgcccttcccttccatctcctcctggtatctcagccttcccccggggctgtgggcccagcacacgagccctggcacccagcctggggtggggaggtcccgggccagtcccccaggaactctggaggagctatggggctactggcaaagcatctggccgactggccctgccccgtctgggcctcatcaggctggctgctggtaagggatgggctcactcccagcagctcccgggtcacccagcagggatggggagggtgtggcaccctggagctggaggactctggggaggcaggtctgtaattgggcagccagacaaaagccagttctggagtcacaccacagtaggggctcacagggctctgatccccagtggatggaaccctgttgccgagggtgggcagggtggtctggagtgaccctttgagcagg

SEQ ID NO: 482232 - DNA, 583 bp, Homo sapiens
gataccatagactgtgtcaaaagtcgtccgaattggagaacacccaaggttgccattggtgaagagtcagggcagatgaaccagccttcttggtggcactttataaatacatgaagaaaggtaacccgatagacgataccctatttaggttttaaacagattaacccttggactatgtttcaagctgctccaaaactgggaggatatgaaccatacagcccgccgtcagtggaaacatatttatgatgaattaggcggtaatcctgggagcaccagcgctgccacttgtacccgcagacattatgaaagattaatcctaccatatgaagatttatttaaggagaagaagataagcccctgcctcccatccaacctcgggaacagagaggaccgttcacagggaaatgaggaccaaccaaagtatctgggacccaacgcatcaacatgaatacctcaagccagaaggaaaagatatgcccccaagcccccggatgcagcagaggtttcatcagagcaagaaaaaggacaagagactttaataagccagaaagcatccctgagcctctcccagcagcagacatga

SEQ ID NO: 482233 - DNA, 420 bp, Homo sapiens
aggatccccagctcagaagtcatcaggagcatgaaaggatatgatattggctcaccttgtttccacagctgtccctgcatcctctcatcacagcctacctactggcatactctagttagcttctttcctcttagccagtgatctgccctttatgatccctgatagcacaaggtttcctttctgaggctgccatattgccactgtccaggtcgatgactgataaaggccttcctcagcagtgtctgttcccatcagctttggaagaaggaccagtcagctctgttccctgggaaccatcaaaaaatgctgtttatgttttctgtgtctgtctgtcacctgtggcattggcttctaacacctgtgcaattttcacttctctttcactccctgatatgccattcttgctggggtaccgagctc

SEQ ID NO: 482234 - DNA, 85 bp, Homo sapiens
ttttgaggagcggtgtcactcctcctcccccccagtgctttgtagtctctcctatgtcataataaagctacattttctctgaaaa

SEQ ID NO: 482235 - DNA, 497 bp, Homo sapiens
tacaaaggctttattcatgtgtgatagtgaggaatatgctgagtctataggtccaaaacctaaatggctgtggaaaatgaggatatatgcgttttttagcaaaatattcacgcgttaagtttttggcgcggcttaaaatccaaatgcacttattttattagcgaaagggggaagagggaaaagacaaactattattgttcagggagataggtaatgactgaaattgaaagcctgcctttggagccatgcctccatctaaactgatatttattcaacggtaaccactcacgaattgttggcgtgcctattctcactaacgctttttcaacactggggaaggaagaaagccggacatatcctccaaaagctgcaataaccttctagctgctctatcataaaagaggtggcttgagtcaatctgtctatgacataaaacttaaaatgtgccagccaattcaggagacttctgcatgtttgcacaaatctactctctatga

SEQ ID NO: 482236 - DNA, 189 bp, Homo sapiens
tggcaacatggcaaaaccccttccctacccccctccaaaaaagctgggcatggtggcatgccttgtggtcccagctactcgagaggctgagatgggaggatcacttgagtccaggaggcagaggttgcagtgagccaagatcacaccactgcactgcagcctgggtgacaatgagaccttcaaagaaag

SEQ ID NO: 482237 - DNA, 817 bp, Homo sapiens
aaggcaagcgcaggcctagtaacgagaaggagtagcagccccagcctcaccggcaccttcgccggcgccctcgcccagcccaggaccgtcaaggaaggagcagcgacggtggagaagtgtagagaagatggagttgagtgatcaggacagcagagaacagacatagaagcgaggcacacatacacccgagcgtcgcaacagcctgcgacagacgcaagaccgagagagaacacgactaacgcatcattacattaatagaacaatcacacgcgagggtgacaaggacgcacgccggagaacagaagcagatacgccccgcgagcgccatgatgagcctaggtaagagcacaaaagaaaggcaaaaagtaaacctagaaagaaagagatacaaaaacgttagagaacagacgaaaagagacacatcgatctagacaccaccaccaatgacaacgaaagagcaacaaacaagaacgcgggaaggacacatagacgaaaagaagtagacaatggaaaaaaatagaaacagcagagaagaaataaaacaaaagacaatcgaaaaacagggaacgaattcgaggacagcacgaagaggccagaagagacacaccgcacaagtgcaagaaaagaaccagcacagaaaaccccacatgataccgcgaaaaaatggcacagcgacaagtgcgaagggaaaaaaaacgcgaacagaaaagtgggaacacggtgagaacaaaacgagggacaagaaagacacaagaaaaagagacgagacgcaagaaactacaggtaacatacaggcaaacaaaagcgcataataaac

SEQ ID NO: 482238 - DNA, 130 bp, Homo sapiens
gacccttctttgataggaatgatcgactgtgtatgcgtcgtatttgagtttgctacggcatgaaatagtaactgaggtggacatgttaagcccgtggcgattatgagaatgactgcgccggtgaagcttc

SEQ ID NO: 482239 - DNA, 509 bp, Homo sapiens
tggtccaaaactctctttatttcaagatgatgtttctgtggtatgtgtggtatgtggttaaatctcaatctatggtcacacgaggggatttccttgttgtaagtgtagtctaaaccagtaggaaggaggtttaattgccaaaaccagcgagaactcgggcactgtggatactacagtgggcagctgaacgaggaccaaggagaatgtctaagaggcctccagccctgcgctcagtgacgacaggacaggaacaacagagcatacatcctggaagggtgtgtctgatatactcgctggaaagtctgacaggttttctccctgggaagtgcagcacatccccccaacacactggctctggccagtggtgcccactcccagaatggtggctggttcggtgttgcaacccacaccccaaaccccctgcctcccaaattgctcttcctgggtgaccaggtaggcccccccccaggaggaagttcctgaacaaaatccctcctttggggcaggac

SEQ ID NO: 482240 - DNA, 950 bp, Homo sapiens
gccgatatctgccggacacgcttctcttggagtgaatgtgggctgatgcggaaagggacagtgctactggctgacaacgtgatctgccagtgtgcgccagagttcctagcacacgtggcgctgggaggcaggcttggttctgaggtggagcacactaaccaatcgttcctgtggattcaggggaggttggtcgtgactggcctgagaggaatgagtcatctacaaagggcccaggcatggaaagcatgggccctgactagctgccccggcctctctcatcgtggctctcatctacgccaggctagtgtaacttgtaaggtagccgatgcagtgttgctcacgtgcttgtaaccttacttgggtggcatcccgtggcttgttgtcacttagaattgcaaagagcttaggatcttcagggcactggaggtccttcgctgacccttgtaaccattgccttaagctccgtcttagtagagtagggacatacaatggggattgggtagcatattctttttacacagagagcgttccaaaagttctggttggaccatttcctttggaatcgttagaagcaacgtgtgggcttagagcttgacgtattttgattcctgtagcatttaacgtaagataatcaatagttttgggaaacaaaagagttagtttagagagcccttagggaacacaacttttcggggacgaggtccctaacaaggttggttgtcatgcacattattagaactaaaacacgcaagatatatcattagcagtagacagccccgacagggattgaacccaaagtctggtgggcacatgggacaaatcagagggaggaccagtgagcaggaacctaggaaaaatcaagttgtggcacgaggatcgaagttcggaatgcccgagatacacccgagccacacatggcgccaagaagtcgccaccccacggaaggggaa

SEQ ID NO: 482241 - DNA, 147 bp, Homo sapiens
tggataccccaagagccccacaacgagccacacagaggagcctcaccaagagccacaccatgagccaccccaagcgccacacgaagagccacacaaagagccacaccaagagccccgcgacgagccgcgcgaagagccacacaaagg

SEQ ID NO: 482242 - DNA, 174 bp, Homo sapiens
ggtagaaaggagaaaggcgagttacaagatgccaactccaccattacccctcctatgagaaggctgagagaaagccacaaacattaagaagtgccggtcctgaattaaggagaggtggtgtattgagccttgaaggaggaggaaggctcaagaaaaggggggccacttcttctc

SEQ ID NO: 482243 - DNA, 267 bp, Homo sapiens
  misc_feature (24)..(24): n is a, c, g, or t
agagtgtggtatgcttttcactgntggtatgatcctttagtggcacatggaatgaacgtccccaatgtttgtgcagtagcccaccctttatctgcaggatacgttccaagaccccccagtgaatgcctgaaactgcagatagtactgaatcctatatatactgtgttttttatgatacatacatgcctatgatgaagtttaatttctaaattagacagtaaaagattaacaacaataataataaaatagaacaactttaacaataaa

SEQ ID NO: 482244 - DNA, 249 bp, Homo sapiens
accactgtaacacagttgttctgcttgttagcaagcagagcaataacgctgtgctggatgtcattgtcaatgttttctttcacaaagaagtgtcagtgtcagacaggcaagctggctcacgcctgtagtcccagtcactcgggaggctgacgcaggagaatcgcttgaaactcgaaggaggtggttgcagcaacccgagattgtgctaatgcactctagcccgggcaataacagcaaaactcccgttta

SEQ ID NO: 482245 - DNA, 252 bp, Homo sapiens
ggaggagtaggctgcccggaagagcatcctccgcaaggtggtggaccctgagacggggcgcaccaggcttattaagggagatggcgcggtcctagcggaaatcgtaagcaacgaacgacacaaagagatcaaccagcaagccacccgaggagcactgctggacttacagatgcgcgctgggttgcttccctgcagggcccccgctggccaaggcctgtgaaacgaagctggcggacccagactgggcaggtt

SEQ ID NO: 482246 - DNA, 194 bp, Homo sapiens
ttcaatttctacacgattagaggctattctaataacagttattatcatagcgaaaagtcagtagaaaagatttacacatatgaaaaggggaaaggatagaatgaaccctgttccactggattggaatagaatgtatcagtctgaacttgtggttcctaataaatatagagataggaatatgtgtagaaatagaa

SEQ ID NO: 482247 - DNA, 219 bp, Homo sapiens
agcctggacatcacttttgcgccgatggtcgacatctcccgcgatccgcgctggggccgtacctccgaaggctttggcgaagacacctacctggtctcgcgcatcgctaaggtcatggtcaaggcctaccagggccagagcccggccctgccggacagcatcatggccagcgtcaagcacttcgccctgtatggcgcggtggaaggcggtcgcgactac

SEQ ID NO: 482248 - DNA, 516 bp, Homo sapiens
catactatcgactccgcctggatagttcaccctaggggaacagtctgtaaatgtgaagagtgtggtctagggctacagtcagagtgccgtcttgcagccccatcagctagtccatcctggacaaaaccccatacgaatgtgacatatgtgataaggacttccgtctaccgtatcaggttgttacatatcatcagaacgctccatacgggtacaaggctttagaaatgagaagtgtgttaccaacttttgtctgaatgcacatcttcaagttttgggctagtccatgctggtggtaaaccctgtaaaactactgagagtggaagggggtattgttcacacttggaatctttctaacaaatccatcaagatgataacacagaaccatgaacaggacatagaactcgtatataggggagaactagggctggtggctctcttggtaagatctagtttatataaatgatcacctttcatttcgaatatatccctgaagattgttagcgtggggggtaccga

SEQ ID NO: 482249 - DNA, 228 bp, Homo sapiens
  misc_feature (37)..(37): n is a, c, g, or t
  misc_feature (76)..(76): n is a, c, g, or t
gggatgaggaacgtcactatgtttttgtggttgtgtngtttttgtgaaatggagtctcgctttctctcccaggctngagtgcagtggtgcgatctggctcactgcaacttccaccttccaggttcaagtggttctccttcctcaggagtattatgtttaaacttcttttgttttatcacaatatatatatatcttttttgagatggagtcttgctctggttgcccagg

SEQ ID NO: 482250 - DNA, 734 bp, Homo sapiens
cccacgcgtcgcggacgcgtgggaaaaagttttcagtgaaaaaaaaaaaaaaaaaaaaaaaaaaaaaaaaaaaaaaaaaaaaaaaaaaaaaaaaaaaaaaaaaaaaaaaaaaaaaaaagaaacaaaaaaaaaaaaaaaaaaaaaaaaaaaagaaaaaaaaaaaaaaaaaacaaaaaaaaaagtaagagaggggcggggcggggcgggggcacacatcgcgcggagggggagcacgggaacgaccacggcgcaaagaggaggagaagaaggagagagagcgcacagacgagaggatgagggagagacggacaatgaagaagcagaggcggggcgggagagggcagagaaagagaaagagagaagaagggagaggaaaaagtgggcgagagagggagcatgcagagagcgcgaggacgacaagggcagcgcggagaggggggaggagagcggagagaaaggcagggaggagaagaagagagagaggaacgcacagagggaagaacgagggaggagaaggacagagaaggacggggaggcagcgcgcgaggatctcgagggcggcgcgcgagccgaaaaggacggaggcggcggaagaagaggggggagccgagcgcgaagagaggcgaggcggcacggggacgggaggagcaggagacgcacgaagaggaagagaggacaaaaagaaagaaagagagcggacgagacaaagagagagagacgagaagagggcgggt

SEQ ID NO: 482251 - DNA, 380 bp, Homo sapiens
cttccttttgccccgttaaatgttcccccatctttttaactaaaaaccccggcttaaaaggcagatgcttcctgtccccccctttagtttgttccccaggtgttttttccgcttcccttgtcccgtggaaaaacaagattttctggtttgcccagcccaaaatgttttatttgattattaaaaccttaaggcggttttgaaaaaataactgaaccccaggctgaaggctgttttcctttcaggatttttttttccccccagggctatccttagtcccaaaaagcccctgtttttttttttggggcttttaaggcctgagcccatttccctataaatatttttatttttgcccccccctttaaaataaattttggtgggta

SEQ ID NO: 482252 - DNA, 177 bp, Homo sapiens
aggacactgaggaagacgacttcctcgtggaccaggtgacaccgtgaaggtgctactgatgaacgcgtttaggcatgtctaacatccagcactgtcagaagctgtccagctgggtgctgctgctgaaatacctgggcaatgccaccgcccatcattcttccatgcctgcatgacggg

SEQ ID NO: 482253 - DNA, 172 bp, Homo sapiens
tggtgactctagaggatttcgccgttgtcagtggaagtcccacagaagctacagctgccagcgtattactatagcctccagatctatgccctgattggccccatgtttcatgtggacaatgtgccatcctcttacagtggctgatcccacaagaactaatcaatgatggtct

SEQ ID NO: 482254 - DNA, 878 bp, Homo sapiens
tacaagaattgcaaaaagagaaaaaacttcgtgaaagctgaaaaaaaattcatggaaaatagggttaaaaaattaataaaactgaaaaggaaagtctgtggcaattcaaataagggtatttgtggttattaatcaaaagggaattcgaccccttttacctttagatgctctttcaaaaaaaggctatagtcgctctgcgcaagagctaaaaggagaatatatggagagcgctcgactactaagcttgtggatggggtacccctgaatagcttttgacagacctaggtcctgactgcttggaacatgcaggacttgtatatcgagtttcactttgggagaaagagacgttcaccttctattgagaaatgtaacaaccctcgtacttgtcccattatctgatacaagggacccatcataagcacacaactcactacagatcaaaagaatgcagtgacgggacgccttgagggctgtcacacaacatgctatggatgatggctgtgagtatcccaggtgctggtgacgtgaacagtggcgaaatggtagaacgccctgtattacgacattgcgccccaggtggtaaaggcggcgagggccacacggttggagtacccaaagccatttggtaagatgcattgcggccaccatataattccccaagggtactttgaccaagaaacctcagtggttttgaaccctgcaggacacacttaacgccaaaattacacggcgcaaccattccaacagtccggctccgcattatgggcttttgtggaccgtaaaacacagtgttaaaccacttgtttgtagcaaaaacatcgggtatgtgacaaacaataggcgtagacaaaagaagtgattcacctgccgcagtgaac

SEQ ID NO: 482255 - DNA, 136 bp, Homo sapiens
  misc_feature (75)..(75): n is a, c, g, or t
  misc_feature (96)..(96): n is a, c, g, or t
agaggatccggtatatgcgtctcatatacatacactcctaaagcagctcttctcccctccgtatggctgtggttngataagctgatgactctctcnacctcttcactatcactctcctaagtttcatgttcattac

SEQ ID NO: 482256 - DNA, 304 bp, Homo sapiens
ctgcctatccttcatcccatgtcgggtatgtaggagtatgctaagctagtcgcgtcgctaggtaggatacactctcacctcacaccagcttggaatgaatagatacaattgaaacgagtgaggacaaggcttacgtttcttgagggagagatttggtttatcattgagatgggggctagtgggtgtcgtgtgacgaagacgcaggccggatctcagacgtgtgtgccctggggtaacctctgggactcagaagtgaaagggggctattcctagttttattgctatagccattatgattattaat

SEQ ID NO: 482257 - DNA, 197 bp, Homo sapiens
gctgcctgtctcatatgttctgtggacctaccttgctctgacttccttggtagagagaaaaacaaaacaccgatggagttgtatgtcctataggctgaaaagtttggtgggcatagccttggctctggtgagggctttgtgctgcataacatggtgggagaaactcaacggggaagcagacaggtgcagcgtagaat

SEQ ID NO: 482258 - DNA, 1125 bp, Homo sapiens
gcggaatctccgggaactagaagaccttatcagtcgaggctgtctacactgacatcatccaggcaagctggaccagcgataaccagctgcgggaagtggcattctctgcatagggccggtgtactctccgagaagcaaggatatcgaatgaatattgctcgaagcacccgtgccatgaagtggtgtgatgcgctgtgcaagcagttctcactgggcatctgagcgagcagagttctgaggagcccagccagtacagatgagaactcgacaaagcacagaacttctaggactagacgaggtagagaagcgaagaggttaccaacaatcaggaagacactctaatagccgaccgtcagtccgtccatcgagctctacggatgatggagctaggcaagcatgcgctgtagacggggagatgtgccccctctacagcttgagccgagcaggcgaggcacaaccagagaaagatggtgccagtagatgagaacggggctagtatactccgctaggccgtccaactgagagggccggcggatggggagcaagctagggctagtcaaccccaggggccatgggggtcacgagtagggaggacggtggatcaggccgaaggggccccagtgtaccgtcgcaccattcttgcctaacttgcgaggggactgtctctcgagaaccttggcactcgggtttcccgtaaagcccacgattgttctcaccacaagccttgggtgtgggtgaacatagttgctcattggaagacgacctgggtcttgacatacgaaaggttcataaggaatacatacgaattcccttgaaccccccagggtgaggccgcacccgtttacaggaacgagccactgaggaggatccccagacgagactgtcgaggcggcgcagagaagcgaggggtgccaggaacagcgagggcgcaagggtgcagcgcacgcgagagacggttggccacgggacatagcggtgtaaaaagagggaattggtttgaaacccatcacagaggggggaaatcctctgaaggcctacccgggcgcataatattaaagctataacggctcgggggctaatagaacagaccgggtaggggcaggtggcaaaggcacagcccccagg

SEQ ID NO: 482259 - DNA, 564 bp, Homo sapiens
ctaaggatccgctgatccgcttagcactgtggagcacgttgaacactttcctggtgtgacccagtaacccaggatgggattccagcactaatgaagggctgtgggggtctccaaggcttaatcttaaaaaggttgacccagtagaagatgaagctctccagtacataggtgcacactgccctgaactggtgactttgaacttgcagacttgcttgcaaatcacagatgaaggtctcattactatatgcagagggtgccataagttacaatccctttgtgcctctggctgctccaacatcacagatgccatcctgaatgctctaggtcagaactgcccacggcttagaatattggaagtggcaagatgttctcaattaacagatgtgggctttaccactctagccaggaattgccatgaacttgaaaaagatggacctggaagagtgtgttcagataacagatagcacattaatccaactttctatacactgtcctcgacttcaagtattgagtctgtctcactgtgagctgatcacagatgatggaattcgtcacctgggaatg

SEQ ID NO: 482260 - DNA, 168 bp, Homo sapiens
agtcgtacatcacaggagatctgggtctatgctaaatgtcttcctgataggacgggccggaatttcctctaaactgcagtcaatactgtcaagataatccaacagctcaacctttcccaaaagatagatgttactcattcacaaatggaatccactcatgtgtcactg

SEQ ID NO: 482261 - DNA, 303 bp, Homo sapiens
cgtattcacaacgggtgctactttcccatgtaagaaagttctcttgctgctctggatagacacgtacttgtgcacgctatgcggatttgacggagctgcagagcatgacaggctgagaaacgcatcaatcctgggcctccccccgtcttactgcatggatcacgcattcaaagtgacttcgcaatatgagagcaccctctccaccagcatctgcttcagatcttgattgagcaccaacataaacggggccgccgagagcacaaggctctgataaagcaggacaacctaaatgccttcaacgaa

SEQ ID NO: 482262 - DNA, 147 bp, Homo sapiens
tttaaaaaaaaaaaaaaaaaaatccccggatgttgttttggggcccccccccctaaaaacccccttttttaggtggggtttgttttttgccaaaatttttcccccccttttttgttttgttttaacccataaaaggcctttgtttta

SEQ ID NO: 482263 - DNA, 323 bp, Homo sapiens
tgcctttatctggtcattagaactctttctcataaacgaacttctgaatatgcggaacattaactttgtgatagctgtggtgcgtaatgaacacacagttccaaagaggctctaacgtatgatgaggtcgtgcatctactacttaagccgtattcgcgaggatcctcttactagtcgacctgctgcgccatgccgcttgggcactgggccgctcgtggacaatcgctcgcgactgggagaaccccgggggctttgcaaacctcaagcccctcctcccatcttccaggcccacagcacagactctaactctgcctttggcacca

SEQ ID NO: 482264 - DNA, 394 bp, Homo sapiens
cgagccagttaggccttctaactaagcgaggggattctttggccttttaagggatgcaaatggggctgggaatcttgagggcagccctaggaggatttttttacatccgggattacaccttcttggtaacctgggaagctgccatctgaccagggcctgtggttgtgctggttgaagctgttgccttaattaatgagaaacgggggggtccatactgggccttgctgaggactttgttagcgctgccagttttttccacagccatggttgccttccgaatttccagttcgagggactggaacattcaagccccaattcagagtccagaggaggtcagagggttacacctatgtacctccttaatggacatgctgaaggcctggttaagaaccct

SEQ ID NO: 482265 - DNA, 176 bp, Homo sapiens
  misc_feature (17)..(17): n is a, c, g, or t
  misc_feature (149)..(149): n is a, c, g, or t
tcgagctgttccttatntggttctggtttagggccaaagggagtttgtgttttctgggtgattgatttaggtcccaaggatgctatctggtgtgtgtagtgtggccttttttaagggtggtccgagggtttgtgtttacgaggtggggntggagcttaatgtttcctaaaggtgaa

SEQ ID NO: 482266 - DNA, 547 bp, Homo sapiens
tgaatgctattttttgtagaagcactttcgcagtacaagttgaaagcagcgatccattatcagtgaagagtataaagcggctataacccttttaggaatcacagatgcacggaacatgctatgcaacatgcatgtataccccggctagatctcaggtaataatggccataccagtttaccaggaaggaacatcccaaaggataaaatccgaaccgaacctaattctaccctaaaacttactgcattcaaaaatatagaatgaaaagacaccagcgacacatacgtgtttgatctgtacatgctcatagaccatatgcactaggcaggacgaggagctgctagcgaaaagtacaacagaaacaatgatctcttaccatatgccttcaaataggactatgatccataccagtccaaagacgggctgacgtgctacctgggactcttggctctgctatgaccattgagcatattgtcaacatgcgcctactgtgtcacgacggttagaactcaacattcactcggggtggcctttccttgggctagagcg

SEQ ID NO: 482267 - DNA, 322 bp, Homo sapiens
gcacgagcggcttcctgatgatggtcgttggggtggttgtcatgtgatgggtcccctccaggttactaaagggtgcatgtcccctgcttgaacactgaagggcaggtggtggccatggccatggtccccagctgaggagcaggtgtccctgagacacccaaacttcccagagagtatgtgagaaccaaccaatgacaacagtcccatcgctcttacccggtaagtcaacagtcagacaactagcatgaaagcagtttaccactgcgaggcagctcagatccctcgacctgtcttgtcgccgcccacgactgacctgtgtgta

SEQ ID NO: 482268 - DNA, 202 bp, Homo sapiens
gtgaggtgccgccattttcatctgtcctcattctctgcgcctctcgcagagctttcagcagccggtattgttgggccagagcatccagaggttcacaaccatctgtggtccgtagggcccactatgaggagggccctggagatttgccattttcagtgaaacagtcgtcgttactagctaagatgtgtttgtacttggatct

SEQ ID NO: 482269 - DNA, 419 bp, Homo sapiens
tagtggtcttcttcctgccaacccaggaacagcagcattcagcagttctgtgcttgatccaaatgtggccaattttccccagagcacagtgtattgaaaatcataccaaggaagaaaatggaggggactagtaattgttcatgtttcagaaattacagaactgagagcttgactgcttccttcccttcctggggatttacatgggggaagcagaagtgattggggctgaggacattcacatttcctcacaactggaggcagtcattaaggatttgggcatgtcataggatttgggtgtttttctccccccttagtggcatctccacaggcagcgaaagctgtctaagcaaataggtgaggcagtgcgttagtccattttttgttgcttaaaacaacatacctgacactgagtaatttat

SEQ ID NO: 482270 - DNA, 172 bp, Homo sapiens
ctgtacataagagcaaagcacgaaagatcttgacccaagcttgcgttacacggagcgcccactccccctgggcagaagaaacacaaacaaagtagtcacaagtccactataggcgtggccagaaggagaagaggaggaattagaaggtgacgaggagggagaagacgaggat

SEQ ID NO: 482271 - DNA, 362 bp, Homo sapiens
  misc_feature (36)..(36): n is a, c, g, or t
  misc_feature (103)..(103): n is a, c, g, or t
agctctgaaaatctgaggaccattgtaggaaaggtntgttaagcatctcttaagtgccatgatgagcataacagccggccgtggtggctcacgcctgtaatcncagcactttggaggccaaggtgggaggatgacaaggtcaggggttcaagaccagcctggccaacatgctgaaacctcacctctactaaaaatacaaaaatttagctgggcatggtggcacatgcctgtaatcccagctacttgggaggctgaggcaggagaatcgcttgaacccgggaggcggaggttgcagtgagccaagacagtgccagtgcactccagcctcggtgacagcgcaaggctccgtctcaataattaaa

SEQ ID NO: 482272 - DNA, 1129 bp, Homo sapiens
cctgtttgtcacgccgtcgtgctgtgatttcaagtcgttggtctgttgctggtggggggcccacaaattgctgtcagcagtttgaggggggccccacacccaattggtgcctccgcgtggtcgagtgtctccccgcttttttttgggagaacacatcacactagtggggggcccacccatcccgtcgacacccccccactggctgttaatttccccttggtcgtgcaaggcggcggcggcggtttaccccactcctcctgtagggcctttttactctcccctcgttccactacgtgcacaccactcgtgtgccacgcagcgtggttgttttcgccgaaggaacgaaagacaaccacactctcacaaggggtgtcatttgcgaacctcgctcggtgtgcaacggcaaaacaactccccgcgccacaggttggtttcaagcggtccataaattgggcttctctacaaagtagtgggtgtctttttgaacactggagacccccaaaacatctgtggttttcacgcccccgcgatcacgcagatcacttatatgacacctccgtgacacggctttcatccttctgtatgatgtggggcccgcccttaacaattatagggagatgttgtggaaacacacccgcgggatagaactggatagagtgtcacgcatctttctcacgtgggtaagaccacactctttgtgctcactttccctgttcatataaacccgcgtggggactctcgggtgggcgtaactcctgcgggaggccacacacacatgtgttgaaaggcgctgggagaccaacaggggcaggaagagtgtctagctctgcccatattagaggccacgaacactgcctgccatgggcatcggagacttcttgtcccggaagacgctggaagactttcctttgggcgccatatacaacgagggttatgggttgaggactgcgatctggacctctgggatatttaatagggggaagaaagagcctcggcagggacctggcccgctttgttttataaaatggtaagtaatgtggttgggggaataccctagatttttttttgtatttttatttttatttcctcacatttttttccccaaatagaaaaaaaaatgatatttgta

SEQ ID NO: 482273 - DNA, 270 bp, Homo sapiens
gctgaagcctgctgttaagaatgactaacagcggatatactcggatgtgcccggatcttgacaggtattcacttgtactctcaccagtctaccaaggccgaattcttgtacacggggatgtcgagaatccagtgaggtaagtttctgggtaaacttagacgattgtaatactgaaatgcttactcccagagttgtatccccatgactctctaccctactcatcagtagagatacaaaagctaggtgatgctaggctgtagccccttgttc

SEQ ID NO: 482274 - DNA, 318 bp, Homo sapiens
  misc_feature (46)..(46): n is a, c, g, or t
  misc_feature (96)..(96): n is a, c, g, or t
gcagagggaagagaagtatagaggccgtactgctgtggagcatctncaggaaatcctgtgtggctggacgacagcacaaggcaaaaggggtacgantggtgggaggcatgaggttggaaaggaaatggctaggagatcacagggctttgtaggctattctggagtaaatggcagaaggcaggccacgttttctttgttaattagcttctagctaattcttcacgaaaaaaacacctatgtaccatcatgactatggagtcctcagacttttcaaggcaattttagttttcgtatgttaataaaatactatagtacaac

SEQ ID NO: 482275 - DNA, 190 bp, Homo sapiens
agctcagcttgaatcttttttcaaacacatgttttcattcaatcagcagttttcagtgcatttctggggcctgtcaaatcaggcatcctcatccattcaaccaacatcagtcaacacacttttacacttctcttttctcaattttcaacatctcacacttatcacacttttttttttttttttttttggg

SEQ ID NO: 482276 - DNA, 234 bp, Homo sapiens
  misc_feature (147)..(147): n is a, c, g, or t
  misc_feature (223)..(223): n is a, c, g, or t
gatgggcttcccctaaaggggcattcttattgattgagggagaagaaggttgtttctgataggccgaaggagggagtgggaaggctgagctggattagctggggagtttgattgacaggattagtgagtagttttattagccaagangcaggagggttgagtctggttgtctgagaagcaggagagagtctgattggctgagggttggaggggagttggtggngtctaattgtg

SEQ ID NO: 482277 - DNA, 1037 bp, Homo sapiens
  misc_feature (1)..(1): n is a, c, g, or t
ngtgggtggtgttgagatattgagctgacttgagtactatggatttgttctggttagttcggtgtgtcgggctctcatgtttggtccggcgttccatgtatgccgcagccctttttgcgctagtggtttacgttctactcctgcagactgtttggtgttgtcccgctcccggtttttgcaccgcgcttctagttgccgtgtgtgttcccggcactggaggaggggggtggtgcttctccgggcccgttatgtttcggagagagtttgtcttgctttgccgtgccgggtatccttggttcacaaggttctatgtcccagacgggtgatgtggtggtgctggggcagtcgctttggggggttatcggcttggatggcggagggtgggccgatttgttggtgggtacgtacgtgtttctagcttcattggtgatgtattgtaattgatttattgtgtggacgcaggtgtgcaccactctgtggtcccaacggggactccggtgttcataggttagaccctccttgcccttttgtgcgctctcgtgtgtatgctggggatgctacggtgtcgaatggcgcccgtggcccggaggttgtgttttgttttggtttgttgtttgtttttttgaaggagcgccgaggtgccacgttgtgggtgggcgcagggttttaggggcacgtggggccaatctactgggtcacattgcacaggttcgcctctcccggggttgatccgcccagtttccgtgcgctctgccgttcccaagcacgctggggccacacaggccggccctgcggcccaatggcccggccccatttttttttttttttgtgattttataaagaccgggttcaccaagctagcccggatggtttcgatttcccgacctttgatccacccgcctcagccttccaaaatgctgggattacagggcgtgagcccccgccaccggcccttttttttttttttttttttactaaccacggggtttaatataaatacaacccagcattagaaagaccccaaaactataccagga

SEQ ID NO: 482278 - DNA, 138 bp, Homo sapiens
ttgtgggtcattacgagctagccctccctgagaagcaagctggcattgcagccaccaacaacacacttaaaggtttgtctccactgtgtgtcagcatatgcctttgttacccactttgactgatctataggagtggtg

SEQ ID NO: 482279 - DNA, 560 bp, Homo sapiens
  misc_feature (19)..(19): n is a, c, g, or t
  misc_feature (56)..(56): n is a, c, g, or t
  misc_feature (99)..(99): n is a, c, g, or t
  misc_feature (128)..(128): n is a, c, g, or t
  misc_feature (315)..(315): n is a, c, g, or t
  misc_feature (374)..(374): n is a, c, g, or t
  misc_feature (437)..(437): n is a, c, g, or t
  misc_feature (439)..(439): n is a, c, g, or t
  misc_feature (447)..(447): n is a, c, g, or t
  misc_feature (484)..(487): n is a, c, g, or t
  misc_feature (497)..(497): n is a, c, g, or t
taaaactttccgctgtttntcaagttttcctgaaactctttcttcttcagttccanggggcttttttctgcaagcgcctgcggacccttgctttccagntccatgatccgtgtctggaggtccaacgntccgggagctcgcaatccagtagttgaagcccaagacgatgattgcaagccaccagggcggccagcaacgaggggcggcgaacttcaatgctgcgacgcccgtttcccaaagcccaatcatctcaaaatcagcgctgagaatctcttttcgaaggctccggccgccacttcggggattccggggccnccgcttacgtaggcaagccccgcgtctgcgatccggccggagacgccgggcaccccgcncgccgcgccatgtcggtgaacatggacgagctgcggcaccaggtcatgatcaaccagttcgtngnctggcggntgcgcggccgaccaggcgaagcagttgctgcaggcgnnnnactccttatncgagaccgcgctgagcacgttcttccaagaaaccaacattcccaacagccaccaccaccacca

SEQ ID NO: 482280 - DNA, 422 bp, Homo sapiens
ccaaatactgcatgtttactcttctaagtgtgagctaaacattgagtatgcatggacacaaagaagggaacaatagacacaaggggtagagtgtggaggatcaggatcaaaatactacttctcaggtactatgctcgttacctggattacttgataatctgtacaccaaacaccacaacacacaatttacccatgtaacaaatctgcacatgtgacccctgaacctaagatacaagttggataaaacaaagtgaagaaaaatattttatttttgttttgtaataatgtgctttgaatagtctaggtatttttctgctggcttatggatatatctatatctatctatccatctatgtatctatctatgtatctatctgtctgtctatatttttaaatcgagacagagtgagactccatctcaa

SEQ ID NO: 482281 - DNA, 226 bp, Homo sapiens
gagagcggttgagttcacgggcaatcagtgcttgggagaatccatgattgagcagagtttcaatgcagaacagagatcaaaaatttgatagttgttggtaagccattagagatggtacagcttgatgtttggtcatgatgtgccattcataatgtgcattggttgcttataagcataggtcatcatggcctttttggtctattaaattatgtgttgcacttagatt

SEQ ID NO: 482282 - DNA, 366 bp, Homo sapiens
aaaaatattgggtaggatatgtggtcaaacatgaataagctcataagtggctcacctaagtcaaatggctactcacataacagcaaaaggtgtactggtatcacatatatacattatgcaaactcattgacaaactcaatttcgatgatacgcaatagtagagcacactatcaatctaaaaagacagcgcggccagtcttcatcggaacatgttgtacatgcttcacacctgggcacgcaccttttgcagatgttcacgaagtctaggtggctcgcacctgacatacccgcattgtggcagctttacatgctcgtatcataccgtctctttatcaaaaccatgctcactcacacgcaagcattgtc

SEQ ID NO: 482283 - DNA, 250 bp, Homo sapiens
gtttctgaatgtgttcaggagtctcccaggtgaacaggggctcgtgtccaaaaggtaaggatcagcaccctttcgcagaattcaggagtgcaaagggacctagaggatgctatcgaagttacaggtgggataagcttttttctggtaggactcaatgaaggcataaggaggtgatggccctctaagggctaaattcttggaagcaaaggcccacttttgggaccaaattaagattgccctacaggacaat

SEQ ID NO: 482284 - DNA, 1307 bp, Homo sapiens
tggggttatttcatgggttttaggttatggtttatttcgaatactgaaaaagtccttggggctctggtggggtttccccagcgctcagcggctcttttctcccagcacctcacgtggccgcttcttcccacagccaacatcatatttcaaggaacacgtacttttataaaagtgcattaagtggttgagtttctcacactagcttcgtgcagaaactagaaggagcgtggttgtgcattcgtgctcgtggtgcggattggagatttcctgttaatcgtgacacccagggtctccaacccacacgtgcaaacaagggcctttatctacagcagctcaattcagaaaaccccttttcgcactatagggctaggtccacttttcctttccccgtacattacgctacgcccagattcagccaggtgtggcttacagaacaggatagtcaggaagtgttttataccaacttccaagtcccataatttcatactccttccaaataattttcacaacaacagaaaaaccatatacaaaacaaaaaacagcaaagaacaacacaagaaaaactcaaaatccaaccacaatcacacatatccacaacacaatgaaaaagaacagggacacaacaagaagaacaagaaacaaagaagaaacccacaacacaacggaaataacgagaagcaacgcacacaaaaagaagaacacatgaagaaagaccaggaaaagacacgaccacagcacaacaggcagtaacagcaacaaacaaaagcagcaagaagccagagaaacaaagcgacacagtaagaccagggacaagcgagacaacacagaaagaggccacacagcgacacagaacaaaaaggacacaagaaacggcagagcacccaccacggaccccacccacgaacagcacaaaggaggaaaaaccaagacagacgacacacccgccgcagagcgaaccacacacacgacgggagagcgggaacaaagcaacagaaacaccacaacaaacaggaaaaaacgcggagggaacacgaaaatggatcaacacgagcacaagaggaaaagcagaaagagagagcaacagcacaaaagaagcaaagaaacacgcaaagaaaggagaaccaacggaaaaacaacaagaagacaaagcgacagacggataagacgccaacgacaaagagaaggcgacagctagaaacgggagcagcaacacgcgaggacaaagacaagacaacaaccaaccagcaagcaggaggaccagaccataacaccacagaaagcaggatacagagacacgaggccacaca

SEQ ID NO: 482285 - DNA, 386 bp, Homo sapiens
gtcatcggaaaggttgtttcctgggcaaaaaggaccggcggaagtccctttgtccttgtttgcagatgtcccgagggtataaatagagaaccccatcatctcagcccaaaatctccttaagctgaagagcaactacagcaaagtctcaggatacaaaatcagtgtgcagaaatcacaagcattcctatacaccaataacagacaaacagagaaccaaatcatgagtgaactcccattcacaatagcttcaaagagaataaaattcctgggaatccagcttacaagggatgtgaaggacctcttcaagaactacaaaccactgctcaatgaaataagagaggacacaaatgggaaaatattccatgcccatggataggaagaataat

SEQ ID NO: 482286 - DNA, 567 bp, Homo sapiens
  misc_feature (82)..(82): n is a, c, g, or t
gcaagtttggtagctgaggaaagattgattcggtcttggtaaaagtggaagatggccctaaatcttaaagtctgggaaagcngccattgttgatatagttcctggcaagcccatgtgtgtgagagcctctcagactatccacctttgggtcgttttgctgttcgtaatataaaacaaacagtttcggtgggtgtcatcaaaacagtggacaaaaaggctttgtgagctggcaaggtccccaagtctgcccaaaaagctcaaaagggtaaatgaatattatccctaaaacctgcccccccccttttaatcagtggtggaagaacggtttcaaaactgtttgtttcaattggccctttaagtttaggagtaaaaggctggttaatgataacaatgcctcgttaaaccttcaaaaggaaaggaaaatgttttgtgggcccccttggtttttttttttggggggggcaggtttaaggtattaggttttaaaaacaggactttttaatggaaacaacttggccaaaaatttgtcccagaattttggggccccttaaaaaagtttaatgagga

SEQ ID NO: 482287 - DNA, 478 bp, Homo sapiens
cgagtggaccaacagttccatgcagaaggctgtgtcggtgtcggagcagattccgtctctgatgtacgcgacgtgtaatacttccactgctttggaacttctgcgggctctctggacggcgtgtttctgcattccgtgcgcgttgccctggtgggctcgcacttcttggcctgtcatcaaacgtgtgctgtgccactgcgttgcgcgaatgtgcgcagttcacggtctcgcgtggacgaggtcacgcttcctatggccggccgctataccactcatcttcaaggctctcgtctcctttgcaaaactttttgaaccaccattgcacttgcactgttcgttagcagttcctgggccaaatgcgtcgatgttgcaacgttgtctccactgctttatgacccattctgaactcgaataagaaaattactcacatctgtcttcgtctaacatcatttccatagtctaaaataaacataaacag

SEQ ID NO: 482288 - DNA, 168 bp, Homo sapiens
  misc_feature (150)..(150): n is a, c, g, or t
ctcagacatcccgtctgattctaacgctcacccttccaccgcgctggggaaaagatgtgggaagataaatgaaggggtctagatgtaaatgtcggtggaaaggagagctaccatcactaagggctgaaaacacagttaaatcactttcanaagttaaactagactatt

SEQ ID NO: 482289 - DNA, 91 bp, Homo sapiens
  misc_feature (47)..(47): n is a, c, g, or t
tcaagcttctaacgatgtacggggacatgcagtggctaagccagggntgaacactccagcctggcaacagagcgagactccttctcaaaaa

SEQ ID NO: 482290 - DNA, 470 bp, Homo sapiens
  misc_feature (16)..(16): n is a, c, g, or t
cttaagacaaggtctnactgtcacgcaggctggagttcagtggcgcaatctcggctcactgcaacctccgcctcctgggttccagcgattcttctgcctcagcctcccaagtagttgggattacaggtgcccgccaccacacccggctaatttttgtatttttaattaagatgggatttaaccatgttggccaggctagtctcgaactcctgacctcaagtgatccacccgcctctgcctcccaaagtgctgagattacaggcgtgagccaccgcgcccagcctcaaggtcattttaatttggcaggcagggtttaaaaagaaacaagaaggagaaaaaaagaaagaaactgcccatgagttcccttagtgccctttctagcaggcggttgttccttcctgccttctgctgcctgcgttgggcctcctgttgcctctctattccatttcaagtacaacctgccgtgggta

SEQ ID NO: 482291 - DNA, 603 bp, Homo sapiens
  misc_feature (570)..(570): n is a, c, g, or t
gtgatcacagcagccacctttgcatctgcatttccagccactaaaaggcagagatgctgattctctggacaatccctcttttcctactgggagcagctcaggggaaagaggtttgctatgacaaccttggatgcttttctgatgctgagccctgggcagggacagctatcaggcccctaaaacttctcccttggagccctgagaagatcaacactcgcttcctgctctacaccaatgagaacccaactgctttccagactcttcagctttctgacccatcgaccattgaggcctccaattttcaagttgccaggaagactcggttcatcatccatggcttcatagacaaaggagaggagaactgggtggttgacatgtgcaagaacatgttccaagtggaggaggtgaactgcatctgcgtggactggaagagaggctctcagactacctacacgcaggctgccaacaatgtgcgagtagtgggtgcccaggtggctcagatgattgacatccttgtgagaaacttcaactactctgcttccaaagtccacctcattggccacagcctangagcccacgtggcaggggaagcaggaagtcgga

SEQ ID NO: 482292 - DNA, 256 bp, Homo sapiens
ttcccttccaggggtccccttggggggcctggccgcttttccaccggggctttcccttttcaggaaactttttttttgggcctttttaaccgctttttcccggacccgttttttaaccccccttgaaattctgccttattatttcttactcaaacatgttttgggttggttggaaattttgcagcttgcaccccccttgttttttaccccaaatttcctttgggttttaaaaaagtggtggcaaaaggcctcctca

SEQ ID NO: 482293 - DNA, 185 bp, Homo sapiens
ggggctacgacctgtacagtgcctatcattacacaataccacctatggagacagctgttgttgaaacgggacattcagatagcgctcctttctgggtgttatggaggagtggctccacggtcaggcttggctgcaaaccactttattgatgtaggagctggtgtcatagatgaggattatagagg

SEQ ID NO: 482294 - DNA, 258 bp, Homo sapiens
ctgtccccttattggtgagttggaggtttgtgcagattttatccaagtggaggtttttccatctgtgtagccacgggcatgtctccaggcacaacgccacgtgctagttcccttactggttcctgcagcctgatttccccccaccccaggctgctttctattttacgtggggataaggctctgaccttgggccgggggctctccaggggctcttcccttgctgtctacctaaggcaagctaactcctttcgtcccccg

SEQ ID NO: 482295 - DNA, 1543 bp, Homo sapiens
  misc_feature (1543)..(1543): n is a, c, g, or t
agcagcgattcgttgatgcgggcgcgcggctgctatccaggtagcgtgcagcctgagttgcatacgtagtgtccatgagggagatcagtgttcgatgtagtacctcggtagcgcagtgggtctacatacttgacacagaacaggcgccggcgcgtggagcagaagctgtctgctcgaacgaacttcccgagcatggtggaggtgcatcgtagagtacgactcaaatgttgcggagtcctagtcagaccatcgtatgtccgacaggcaggaacccacgaaatggtcaaagttaacagccacccgtcacccatgcataggcactctagctaccatccaacaaacggattgcgaacttaacaacgcactgcatggacttattggacaaccctttaacccttagagtacccaccacaggccaacaggtgcccgcacacttcaactggccaattactaagctagcaccaacatgttacaaggaattgtccgcgttgactctattacgacacaaggactaataacctaaccatgttacgcccttacacgaagtctgggccctttacctccgcttgagtttactttatgaggggattgcaaacggccctaggctttggcgcatccttaacacgagggacgacgcgaatgcaacccacaccaagggtgccccaaatttggacgcccaccgttaacaccattttaacacgcgcatatatccatattaatatgtagacagccacggactttgtacaggccatacgtctcgcgaaaggcaaagtacccccggcagaactatttgtccgccgttacatcccaagatgacattggcctaggacagaggatgcgacgggagagagctacacagcccatagtgcggcagtgcacacaccgcagttataaggaacatacggtacacacatattcacacagattacatgccttttgtgcagctgtcacagagacacactagcggcatactccagcaaccgctcgttcgtcccgtcattatcccccccagccatcagtgccggacacatcagcgaagcgactcagtccgtcccacaggtcgcacttggtgtggtgtgcaacacgactaataaggccgcagggtatcaccgtacacaacgacggggcaaccgccaccgcacccccgttacagctctctcacacatgaaagtcacctatgcactgccgctgaacgacttatcgttgagcagcacaggcgaccaacgactccaaatagcggctgtcgtacagtcgaagccacacaccccagctacagcacaacgtccgcgcacaacaggggacgaggcgccagccccagcgaagtgcgcaaccaagtgaacaggcgagacaaaaccagagagcgcactccacggacacgaacgaatgggaccaccacgaacacagcaccaggaacatcgcgcccgcacgacaaaagacaagatcggcggcataccccctgtggcacacatctggcaaacactacgacgcgaaaccagacagaaaagcaccaaaaagagtgagacacatcagagctcaacgacan

SEQ ID NO: 482296 - DNA, 95 bp, Homo sapiens
gggttccggggttgggagttgaaaccattccccacctcagggttatatttccccttctccccttccctccccgcccaaagctttgccaggggcgg

SEQ ID NO: 482297 - DNA, 544 bp, Homo sapiens
gctaaaccatggcactggctgtatcggggaagtcgggcctattaaatcatgcaccaaggacacggtattgtgtccttgacaagagaatacatctctcctgtggccggcagcagatgctatataccacaccataaagctaatacacactctcagcctatgaccagagataaactctctcagctttaaacgtaaaacaaacacaccttattcttaaaaaaagcaggtgtcttactatgcttaccaaactagactctaacctccgtgatgagagaagatccccatctctcacttaaaagaatttgacctaactttggtgaccctttcccaagcgcatttatgagaaacgatccagcccaataataagctatctgcacatattttcacgacgcctctccacgggagaaatgactcccatttactattttggtatctggcatgaagcgaccttcattaatactaaccctactcaaagttgttccaatattaaactttaaagtcctttccgcccaaccccttttccagaataactgtaacgcggtttgcc

SEQ ID NO: 482298 - DNA, 1363 bp, Homo sapiens
ccgcggggtctcttcgcaatgatctccctttcgggtgggctgttcaatcatcctcagtacatgctagtgccgttgactgtctctgtttctctgatgctcctttccggggccgtttcgacttgagaaaggtagggggcgtcgtttctcgccgcgtgattatccccaccgcgagacgcctgtcttctagtaatgtggacctccctgtgtgctcccgtcttgttagctcccccggtccccggttgcaacctctcccggttcttcggtgccgcgtgttgctcgcgtgtggtttgcgcgtttttttgtgtggataaagggggggtgctcagctatcggccaagggccacggcccaactaccccctcggggtggggggggtcgttggtgtttcccgtggtgaaatccccctggagttggtagtctgtgtgttgcagagagacactggaggggtcctgggtccccacggagtgtggtcgtgtgtcttatagccgcgggtgtgtcgcagaggtttttgtctcgcaccttggcacgtttccctcctttccctcgcccgcggtgtagggggtgctttgtcggcccctatctcgtcgttcttttgggagaaacattttcccctgcttcctcgtttgtgcgagttttgttttaatagaaaccactctgtctcttcgaacaacattcaacgcgggtgaatttttggtgttgtccaccccctgtgtggcaccacgggtcttctctctctctctggagtgaaacgccctcttgtgttcccccccccgctcggttggggagaggggagtcgcgaatctcccgcgaacgtgggaaccacttggtgtcacactccacggtgatcccgccctcgcacgtgtgtgtcccccacttgagcgtgagttcactgggctgtcttcgcactgtttctgtgtggtgaaatagtggaggagactctgtctcgcgagtagtcctgttgacacaggcgtggttcccccacaggccctcggaaagagaggagagcctctggttggtcttgccacaggcccctcgtggtgtccccggcacacacggcctctgggcctttcccctctcgcctccacaaggcctcagggcttcctccctccctctgttgggtcgggctcacattgtgagccacctaggcctttttaacacgcaccggcctgtggcctgttcataaggcacgataccaccgaccccttgagactcccgggtggggaaggtggcccaggatgcctggaagctgaaatcacagacgcggacagtttttcaggcactttttatttcacccatcgcaattgaagcacacttggtcccaaccaaccttgcaattctttagccccccaagacacaaaaagaaa

SEQ ID NO: 482299 - DNA, 317 bp, Homo sapiens
aattgaaaattcccttattagattaatgaaatttttgctctgcttaaatggaaacgaactggaaatctgaatttttaaatttagatctttaaatccaattatttttaggcaaattttcctttaaaatagaggaaacccatcgattgaagcctttcccaaggagtgcggtgagctttttttattgaaaagagtgaattagtttttgagaagtccatctattgggaaaagtttcaaatgagattatttttttttagtctttttaaaaatccccaaaaggatttaaaaagaagccataaactaaaaagagggttttttga

SEQ ID NO: 482300 - DNA, 386 bp, Homo sapiens
caggaccactcgttctctgctgttacatgggtggctgaagcagaagcccattgtgcacataccagcatattactgagtgttatagggagggcattaagagccctatgactttcagatctatcctcaggagagacacagactgagagttcctgagtcgggataacatcatgaactgcatccttttgcactaccttcaagacaaccttggatcacgggttgctgctctaaaagagatgtacttttgacctgtgtagaactctctgggatacactgttctatttaaccaggtgaggaggttgaatcatacagtaactcacataattgatcatcacattttgatacctgccatggaacatctactactgaaaagaagtgtggtgccacgc

SEQ ID NO: 482301 - DNA, 420 bp, Homo sapiens
cccagtgctcacatgtgtcatctcccctttctgctgcagaaccagcttcagttctgcatggagcagctgcctctgagcctgtgggaggacagcagtggaggcttgaggccagtaggggcacgagcagtgtggagtgccatgctgagtgggcagcaacagcagggtgtggtcattcgcacaggggagaagggccccaccccagctgtcctctcaccgctgccctgggtgcaggcacttcctcctcacaggcagcccagccctgatggtgcgcccagctgtctgcagggactcacgcccttccgtggggttcttgctgcctgagggtcacctccagctccttgggcctcctgggtccggcgctctaagaagaatcatgtgacgagtgttattggctaacagccaccgatgactccctgagtg

SEQ ID NO: 482302 - DNA, 145 bp, Homo sapiens
accacccaggagcttgcaggggcactccccaaactcaatgaatcagaatctacaccttacaactttcccaggtgatgtacaagcaaattaccgttggtaagacaatgccctggaacacttgtttaataaaaatttgttaactgat

SEQ ID NO: 482303 - DNA, 1620 bp, Homo sapiens
  misc_feature (862)..(862): n is a, c, g, or t
  misc_feature (1118)..(1118): n is a, c, g, or t
ccccttgtttgtgtggtgttgttagtagtacatgtcttgtgaggacgcatgataaactagtattgtgctcacgacaaatagagggggggagttagataagaacagaatgtgttgtgttgaaaagagagggtggtggtggtgatagttggagtaaatagattagcggcagcaaggtgtttgtacttcgttcgtcccggtttttggtttgcctaccaccaggtgtggtggtgtgcgaccacacaggagatatgtggggcggccgcccccaactgttgtgtgctcgataactagctcctcccacagaaatagtggtgctgcctgcatagtgatgaagtgctgcccgccggtgcgaatgagtaaggggtgtgcgccccgctatgttgtgataaacaagagagatgatgtggtggttagaaacgacctccccctgcggtgtttgttattgtgtctcccacctctgttgtgagagcctgctggaagtttacttattgtgggcttgctgtctgaagacacacccccgctgtgtgaaagaaacaattttggttgtggtgtgggagagtttattgttgtggacaccccatcctctccggtggtccgccacatctgattatttggttgtcttcaataatgcccccgcccccctcgcccgaaaggtttatttttctgatacgcgccccgcgtttttcgggggaattgatgtctccacgcccaccgtggtaacgcccccccgcggggggtgtaattttgtcccccactctgtctccgtaatagccgccactcgtgatattgggtgttccctctttgtgttgtgtggcgtcgggttgtgttgtaaatagccgcccctccttcccaacataatatnttgttgccgccccacaaaatagtgtggggaagagttgttgtctcctggtgggagaaagagataagaagacaccgcggctcctctggaagtggtctgctatgaaaaaagaaaacacgatatgaccctcaccgtcccccccccccctcttttcttcgtttaagagcccacggggagaagcacacagcagtgtgggggctcttgggtgtttctctgggagagaaaacttctgtgcgcccactccagcacagagaatgtntatagttagaagataaagacacaggggtatataatacgtgttctcatatgcacatgttgtgtagaaatagtgtttttttgttttaataaattgagtgtttgcgcacacacgcacaaatggtgatacgcttttggagatattcacagagatgcacctctgtctctatttccgtgttgtgtcattaatagagacttgtctcggataggtctctctgtgtcactctcaccactctgaagtggagtccacggagatatgtgaggggtggtgaatgtgtccccacacaccccctcggcccgccacaagaggtctaaagtatggagtcttatctcgtaaagttgaaagggaggttttgtccctcaaactccactggagttgtgccaagagatgaactcgctcgcttgggtgttgagttgagctcgtcgatggagttgtggtgtggtgtattctgaaaggctattgaatgccacttaccatgcttaattcaaatctttattcttttaga

SEQ ID NO: 482304 - DNA, 632 bp, Homo sapiens
agatacgaatcgagctcggaccgaatcggcaggcacaggatgactggcgatgtgggctctgttttgggttccatatgaactttaaagtagttttttccaattctgtgaagaaagtcatggtggctgatggggatggcatttaatctatacattaccttgggcagtatggccattttcacgatattgattcttcctatccaatgagcacagaatgttcttccatttgtttgtatcctcttttatttcattgagcagtggtttgtagttctccttgaagaggtccttcacgtcccttgtaagtgggattcctaggtattttattctctttcaagcaatggtgaatgggagttcactcatgatttggctcactgtttgtctgttatgggtgtataagaatgcttgtgatttttgtacatggattttgtatcctgagactttgctgaagttgcttatcagcttaaggagatttggggctgagatgatggggtttcctagatagacaatcatgtcatctgcaaacagggacaatttgacttcctcttttcctaattgaataccctttatttccttctcctgcgtaattgccgtggcagaactccaacactatgttgaataggagggtgagagacgct

SEQ ID NO: 482305 - DNA, 930 bp, Homo sapiens
atgagagattttgtcaccaccaggacctgctctaaaagagctcctgaaggaagcgctactgatgggaaggaacaataccggtaccagtcacgtcctgccaaaatcacgtccataaatgtaaagaccactcaagactaggaatgaacactgcttctctcataacggagcggaatagtatagctagctaacatcatattgacaggatcaaattcactacgataaataacaatattactctttatagatgtaacttggatctacatatgctccaattaaaagaccactggactgtcgtacttggatatacgagtcatgtagccatcagtgtgctgatttcaggaaaagcgcaatctctagagttgcttagaggatcttactaccactaggtctcagagatatacaagggggagtggatggaaatgaatcttgatgggcttaaaaggtataggatgggataaaatcaataaacaaacatgtgtcaagggagttgcacatcctcagctctctgatttagatacgaggacgtttgaaaagtccaaaacaagaagaatctaaaattaagacgccatatgaaggtgcctagttagataaatggtactaggggatctaaatgtgcattcacaagaaagaggctaactatccttaacctatatactgcatccccaagttagcagctgaagcggcaagatggcataaaaagccaccaggtcctgtaggtgaatcttgcaaaagaggacttatgagctcctcacaacaatttagtatatgggtgaagacgtttaaatcactcgcccaactgtcgaaacattatagcaggatcaaagagacaagaaaagtccacacaaggattacccaaggaattgaatgcagggtcacggaaccaagtggacctaaatagatttctacgaaactctctatcgccaattgata

SEQ ID NO: 482306 - DNA, 450 bp, Homo sapiens
catctatgttaaaaaaaaaaaaaatcacaataggagcagactcgggccactccggtcacgtgagaggcaatttcatttcctatcctaaaacaaaccagctcaactagtgaatttttggcataataatggctgaacaaaacacacattacggggctggccgggctaagggcagtcaagcttagcccctctaggggaggacaagggatgagcaatcacaaaagcaggctcagatgggccagaacggttggaaagggagttcttatcccgggggtgggtattacagctgagcacggaaaataatatcacctccggggagctattaaaaactcgggagtgaccaagtgtccctatgagcccagaggggctacacggaacccttctccgcttcttctctcacccggaagggaagaagtgggaaatgccaagttcggagagaggacttaaagcctt

SEQ ID NO: 482307 - DNA, 361 bp, Homo sapiens
caccgccagtatattcccgtgccacgaaaaagataaccgcgactatcttagcgtagccactcacaattaattctctcactgctacgattgatagcatctggagtggtaattgcagctgtgcatgatcggctcgcgcctgtactggcccccctttgtacaggctgaggcaggtggattacctgaggtcaggagttcgagaccagcctgaccaacatggaaaaaccccgtctctactaaaaatacaaaattagccaggcgtggtggcgcatccctgtaatcccagctactcaggaggctgaagcaggagaatcacttgaacccgggaggcagaggttgtggtgagccaagattgtgccattgt

SEQ ID NO: 482308 - DNA, 662 bp, Homo sapiens
  misc_feature (22)..(22): n is a, c, g, or t
  misc_feature (162)..(162): n is a, c, g, or t
  misc_feature (164)..(164): n is a, c, g, or t
  misc_feature (171)..(171): n is a, c, g, or t
  misc_feature (181)..(181): n is a, c, g, or t
  misc_feature (207)..(207): n is a, c, g, or t
  misc_feature (232)..(232): n is a, c, g, or t
  misc_feature (245)..(245): n is a, c, g, or t
  misc_feature (247)..(247): n is a, c, g, or t
  misc_feature (255)..(256): n is a, c, g, or t
  misc_feature (334)..(334): n is a, c, g, or t
  misc_feature (390)..(390): n is a, c, g, or t
  misc_feature (392)..(392): n is a, c, g, or t
  misc_feature (411)..(411): n is a, c, g, or t
  misc_feature (461)..(461): n is a, c, g, or t
  misc_feature (469)..(469): n is a, c, g, or t
  misc_feature (542)..(542): n is a, c, g, or t
  misc_feature (597)..(597): n is a, c, g, or t
  misc_feature (642)..(642): n is a, c, g, or t
cggattcgggtgacaagcaacncccttcccaccactccccactccctcccgaagtacagacaaccgttccgtcgctgctccagttgaaggggtgacaacgattcctgaagcattctgtctgagtctaatggtggctctagccagacacagggaaatgtggcngngctggcngacgggtganccagggccgtgggagccaaggtgggnacccccgcggatgagcggggtggcncacgaaaagaagnanggagaggnnagagcggggccctctgagcgagttgccgaagacttcaggctggaggaaaaagaacagggcttgatagaagtgcaaggnggatccagcaccaactctgccattttcgaagccgagggccggagggaacacggacngncagtttacagctcaggtgngtaggcgagcgtggagggaggcaaaaccggtatggagaaagccagatatncaacacancacttggaaaacaatcaggcatgggaatgctgagtgacaggcaccatgggccacgctgagccccactcgctcntctggctgggggtcatcagagggaggcccaacccaggatctcctgtccatgggcnggggagcagcaacagttaggagcgagggcccagcccacctccccnaggaggtggagggaaggggg

SEQ ID NO: 482309 - DNA, 184 bp, Homo sapiens
ggcaacgtcctcgcaggttatccaataaagctccctaagtcccagacgcccatgggtccatttccacagaggaggcccaaggctactatccacaagccctgtggggccaaggtgcaatgtggaagatgctggagggaaccccctgggcaggctccctgattgctctcccccctggcccccgcgt

SEQ ID NO: 482310 - DNA, 212 bp, Homo sapiens
aggatcctcatgtcagaagataccttgcagctgggcacaccttgtgccctgggcacgacgcgccggacacctgccctggcaaagtaccatcctggccgagaagaagaaagaaggagctgccaaggtgacggacgctcaagccccgaagaagaacacccgcaccctgatcggcctgcgtggtgagcgacaagcgcgccaagaccgtgacggtg

SEQ ID NO: 482311 - DNA, 1220 bp, Homo sapiens
  misc_feature (41)..(41): n is a, c, g, or t
  misc_feature (213)..(213): n is a, c, g, or t
  misc_feature (220)..(220): n is a, c, g, or t
  misc_feature (250)..(250): n is a, c, g, or t
  misc_feature (271)..(271): n is a, c, g, or t
  misc_feature (287)..(287): n is a, c, g, or t
  misc_feature (326)..(326): n is a, c, g, or t
  misc_feature (336)..(336): n is a, c, g, or t
  misc_feature (344)..(344): n is a, c, g, or t
  misc_feature (351)..(351): n is a, c, g, or t
  misc_feature (500)..(500): n is a, c, g, or t
  misc_feature (745)..(745): n is a, c, g, or t
gcaagatggctgtggagctggggtgctgctcgtcggccggncggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggaaactaccggacgcagctgtatgacaangcatgcngtggaggatgtaccagccggccaccccggnggcttggcatgtttgtggagngtgaaggacccagagngacactggtcatcctggcccgtgcagtatggctccgagngcaggttcantttcactncccatanccctggtgagcaccagatctgtcttcattccaattccaccaagttctccctctttgctggaggcatgctgagagttcacctggacatccaggtaggtgaacatgccaatgactatgcagaaaattgctgctaaagacaagttgagtgangttgcagctacgaagtgcgacagctggtggaacaagtggagcagatccagaaagagcagaactaccaggggtggcagagaggagcgcttccggcagaccacgtgagagcaccaaccagcgggtgctgtggtggtccattctgacagaccctcatcctcgtggtcatcggtgtctggcagatgcgggacctcaagagcttctttgaaggccaagaagcttgtgtagctgtcccaggtgtcacaatnccatcctcccaggctgggggagacaaggacctcctggaactgacttcttctgtcaggaggactggtttccagccatacctgtactggacagggagaggggctggaggcatccataggacacaagctgaaggcagcagcattggctaatactgagcaggtagtggggcaaatgcctgccctctctctctggcctctggggccgttgggtagtaatcacccaggggctggtaagagccctcctcttggcacatcagaatcacacgggtactgatcagggatgtgacggtctgatgtagcgagggtgggggggacgggcgaacgtgggctggactagcgagattttgggacaatgctgttgggaaacatacggggttatgagcacgagtcgaggaatgggggcgtcaaaaagcacatagaaacatgggaaacctcatggactctgtttaagcctagactgatgaacaagggactgtga

SEQ ID NO: 482312 - DNA, 424 bp, Homo sapiens
  misc_feature (293)..(293): n is a, c, g, or t
  misc_feature (415)..(415): n is a, c, g, or t
  misc_feature (423)..(423): n is a, c, g, or t
taaagacggagctcgctctgtcacccaggctggagtgcagtggtatgatcttggctcactgtaacctccgcctcccgggttcaagccattctcctgcctcagtctcctgagtagctgggattgcgggtgcgtgccaccatgcctggctaatttttgtgtttttggtagagacagggtttcaccatgttggtcgggctggtctcagactcctgacctcttgatccgcctgccttggcctcccaaagtgatggggattacagatgtgagccaccgtgcctagccaagggatgagnatttttaaagtatgtttcagttctgtgtcatgggttgggaagacagagtagggaaggttatgggaaaaggttcatgggggggaaggcagaggttgatttcatgggctctgtggaattttganggtgaatng

SEQ ID NO: 482313 - DNA, 948 bp, Homo sapiens
  misc_feature (10)..(10): n is a, c, g, or t
  misc_feature (63)..(64): n is a, c, g, or t
  misc_feature (67)..(67): n is a, c, g, or t
  misc_feature (71)..(71): n is a, c, g, or t
  misc_feature (75)..(75): n is a, c, g, or t
  misc_feature (77)..(77): n is a, c, g, or t
  misc_feature (87)..(87): n is a, c, g, or t
  misc_feature (129)..(129): n is a, c, g, or t
  misc_feature (132)..(132): n is a, c, g, or t
  misc_feature (138)..(138): n is a, c, g, or t
  misc_feature (142)..(143): n is a, c, g, or t
  misc_feature (146)..(146): n is a, c, g, or t
  misc_feature (148)..(149): n is a, c, g, or t
  misc_feature (160)..(160): n is a, c, g, or t
  misc_feature (783)..(783): n is a, c, g, or t
  misc_feature (873)..(873): n is a, c, g, or t
gtcttctgangggaaaaaggaaccatcagataaagctgtgaaaaaagatggaagtgcttcagnngcngcanagananagcttaaaanggtggacaagatcgaggaacttgatcaagaaaacgaagcagngtnggaaantggnnttnannatgaggaaaanacagaaccaggtgctgaatcttctgagaacgctgatgatcccaacaaagatacaagtgaaaacgcagatggtcaaagtgatgagaacaaggacgactatacaatcccagatgagtatagaattggaccatatcagcccaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcagacagaagaaggaaacttaagatgtgcaaggagatttaatgatttcaaagaaaataatggttcttgtttttaatgttaaccttttttaaatacaatactgatagttagaagaaaactattgtactcttttgtattagtggagaaataatagatgtctgttcatgtgttaagtgttatagcaaaaaaaatacacatatggttaagttaatgaatagtttggttatatcagaatggcaacagacagaaagtactttgtagagattgacttcctaaggctacttaagacaacttgcaccactaagaaaaaaatgtagaaccnattgtggaaaaatgaacatctagtagttccaagtttcaaagaaatgtcaacattttattccattcaataaagaacaaaaacaatagtgtngatttactttcatctgaaacattccatgtttaaatctgagctgtgagacttccattggggttgaacccgtaggtg

SEQ ID NO: 482314 - DNA, 306 bp, Homo sapiens
ttttaaaaaccccccccttttttttttaggggaaagggccggtttttttccaagtccccccagggggggggaaaaaattgttttttgggtaattttggaaaggaaaattttttttattttccccccaaaaccttttttttttttttttttttgaaaaaagggcccttggggcccccccttcccccttttttttccccccactttaaaggttaaaagggtttttttttccctggggggggggggggggaaccaggggtttctttttccttttttttggacccgttttataaaaggggccccctttta

SEQ ID NO: 482315 - DNA, 170 bp, Homo sapiens
ccgtcaccagctgactggctatggtcggaagtacagtgtggctgtgtgccaggagtctgagaaatctcatcttcaggattgcccttgggtccaggcgcgggactgcgggcgggtacactgcggatgggtctaagtgacgaggtcttgatctacgcaactggtacggcggg

SEQ ID NO: 482316 - DNA, 513 bp, Homo sapiens
agatccccgttctccctgacaacaaatgctgatgaggatgtggagaaaagaaaactttcactgttggtgaaagtataaattagaacaactactgtggaaaacagtatgtagatttctcaaaaacctaaaaatagaaccaccacatgatccagcaaaccaagtataaccacaggaaaagaaatcagtatatcaaagagatacttgcacttgcatatttatcacagcactattcatgataacaaagatatggaattaacctaagcatccatcagcggacacagggataaagaaaatgtttatgtacacagtggaatactatttggccataaaaaagagtaaaatgttattgctaacaacatggatggaacttgaggtcattatggtaagtgaaataagccaggcacagaaagacaaataccacatgttctcacttatatgtgggaggtgaaaaacttgacctcatggagatagggaatagaataagttatccggggctgtcaggggagaagaggg

SEQ ID NO: 482317 - DNA, 402 bp, Homo sapiens
tttttttctgccctgggacatttttaataacttttagataacaacttcaacaaaaatttacctcccaccaagagaagttgtctttattgtgagaagttgtctttattcccaagaaggggaataacttactctttaagtcagttttattacaggtaaatttgtaccagctttttcctcaacctgggttaaaacctgtttcccaaaggccttcccatttaggattgtggaaataaccaatttcattggggtctggcccccactgaaggcaaaaaactggtttatttaggccccaggcagagcccgcaggggaggcaggtaacttctcggaccaccagattatcttgatcttcagccagctttattgttgttctacattttaataaccgctacatgtttatttta

SEQ ID NO: 482318 - DNA, 264 bp, Homo sapiens
tagcctcggtgcgcaccacttgagacagtgtgcgttgtggagcaacatgtgtgtctggccggtaaatcctgcaataactcagtgcgcagacattgccaggcaaggcctttcatgggagaaatgatccaatgacggggaaaaaatacttcagcccagaagagagatgatcttcatctgttggagctggtatattagaaaataccatagactaagtggcttataaaccatgaatgctcatttcacagttctggaggcagggatgtt

SEQ ID NO: 482319 - DNA, 239 bp, Homo sapiens
cctactccgttggtgctataaacagcattggtaatgccatgtttgcaggacatgttccaaccacagctggctttcacctctgccaaagcaggattatatttgtaaacaaacagaattttatattgggaattatttggacctcctgagatttttcttttctttcttgccaggtataagcccaatgtaagaatcatcatgctcctacattatttgtaaggttgtcattttcctcctccttt

SEQ ID NO: 482320 - DNA, 134 bp, Homo sapiens
gggagctagcatgtctggttttccatcagattcccgtaatcagccactgctgcctttgagagtgcagagggggtggtgtcatctggccactgtcctgccccctgtacatgcctgttcatgctccaatgctctga

SEQ ID NO: 482321 - DNA, 123 bp, Homo sapiens
  misc_feature (3)..(4): n is a, c, g, or t
acnnccaaatataaatccctttacacctaagtacgaaactccccaatttttttagaaaataaataaagggttcccataagtaagttcaaaaaaaacaacttattgccgacctaacggtttttt

SEQ ID NO: 482322 - DNA, 263 bp, Homo sapiens
gcaaatgatacagggcttattcactctggggaaggactataagacatggcacattttcctggtatatacccaaagggctacatttttgagcgttgggcttatttgtgtttccttaagcacacacaaccactgcatgaagcaaaagaggcctctgacaacgtgaaagtcagtgcgcttcctttaaatttttttttccgtaagagccaggataccatttattcttcccgtgtgatttaagatgagacataaagagcatttgggaa

SEQ ID NO: 482323 - DNA, 118 bp, Homo sapiens
  misc_feature (84)..(84): n is a, c, g, or t
tgccagaagtgaggctgcagtgagctatgatgcatactgcactccaacctgggttgaccaggaatgagcaccctgtctcaatgnaaaaaaaaaagaagacaaatgccgcatgattggg

SEQ ID NO: 482324 - DNA, 454 bp, Homo sapiens
  misc_feature (3)..(3): n is a, c, g, or t
  misc_feature (14)..(14): n is a, c, g, or t
  misc_feature (46)..(46): n is a, c, g, or t
  misc_feature (147)..(147): n is a, c, g, or t
  misc_feature (155)..(155): n is a, c, g, or t
  misc_feature (295)..(295): n is a, c, g, or t
  misc_feature (349)..(349): n is a, c, g, or t
  misc_feature (405)..(405): n is a, c, g, or t
  misc_feature (415)..(416): n is a, c, g, or t
tantgggtcatggnccttgggcagattgtaaagagcccccagcagnagcgggtggtggcccagctggggagagcatcccttgcttgggctaggaaagctttaccttctctgagtgcctccgcctgagagattgtgtgaccccgtggnacccaggnacccacgtcttggagtggtccactgtaggccatgcgcttcatccaccccccagtcccctcataggcccctacccttgcccgggagcttctagatagaaatcagaaagagattcaaggagccaaatgagcggtcagccccnaccatgcactccttgccccgtcagagcatccagccagcttcagtcaccagcccnacatggcaccatggttggaacagaaagggtctcatggttgcactgaatgcagctcntcaaactggnnttgtacttgcatgaataaatactgttgttcttgcctta

SEQ ID NO: 482325 - DNA, 200 bp, Homo sapiens
taatagttcacaatgttctaaatttggaaggacttaaaaaaaaaacttgtttaaatttccatcatttacatatagagctagatattacaaaacagatggaaatgatgggtttgttggtatttaaaatgaatacaacttgaatgtaattaaagtgctgtttttttggaagcgataaactttaaatatacttattaaaatga

SEQ ID NO: 482326 - DNA, 100 bp, Homo sapiens
ccagtactaaggcgctgtggttacgggctgtacctcgcattatgatgctgttgaactctgcttcctccggagtactttcagctggcttaaattcaggggt

SEQ ID NO: 482327 - DNA, 987 bp, Homo sapiens
tgagttgtagagccgtctctgccggcggtcaaggtcgtgcctcttgtacaggtgcgtttgaccggaggtcttctccgggacaccatgctgggttggacactcgaggtgcaacatgcgcggtggccacaaacaagttttttttggacgccctcctgcttcctgttggcgcgcagattgttgcccgtccccgttccacgccgttgggtacgggttgctccaccccaaaggtatttggcggcgaaacccctgctccatggtattgtgcaacccctcttgcttggggtgggaatatccaatacaccggaacttgggaataccagtcttgggggggggccctgtgtgccgctccgcgccaacgccctggtggtgttggtgtttctaaccccgggggccccggccccactcgtttaagctcgaaggccaaaccccaatctggccctctttcccaaagctgtcttgggtagtctcgtccgtgctttgtttcctcgcgctccccggtaggtgtcccaaacgggacgaggttcccccatcgggggcgccaaaagggtcccccgcgttagggtcgagctcttgattgggccctggcatgacattggcgccccaaagggcgccccacattgttttaggcaacgctccctggcgccccctaggtcacaacatggggagcaccaatgagctccgtgccgactgcgcacacaccccatcggtgggagaacacttcgcacctggtgccgacagagatgaggcaccaaaataccgacttgcccttgtaactcgaggagaaccgacggggcccgcacgcggtttcctctcttggcacagcccctcccgaagcctcgcgcccaccacgccaggagagacctcggctgcggagtctgaaaacgccaccacactagagacacacctgcggagagacgcaccccccacttaaggggccctcggggaaaaaccaaaacccctcaaatattttttgggtttaacaaaaca

SEQ ID NO: 482328 - DNA, 232 bp, Homo sapiens
caatcctgaataattcactccttcaatctcggcagtcaggctccggtgcacaccactcggcaccgtgcattcctgaagataacatgaacggcctcttagtcaccaccccaccggcctctcctcggtactcatgctggcattcatttctctaaaatctaaacggggccaggcaggggggctcatgccggtaatcccagggcttggggaggtcaaggaggcgggatcacttgag

SEQ ID NO: 482329 - DNA, 110 bp, Homo sapiens
tctctagctcggtaccccagagtcaaacagtgccaatgatctggacactgtctcaaccgtgagctcagtgaaattgtagtatcggtgaagatgccgattacccgcgatgg

SEQ ID NO: 482330 - DNA, 179 bp, Homo sapiens
atccctaaccagagggaaagcctcctgctcccaaaccagccagtcccaagaagaacatttaaactaggagtgccagaagagaacaaaccgaaaagagtgtgagctaactagtttccaagcggagattccgacttcttacaggataagctggattgctggacaactatgtatgcatgtgc

SEQ ID NO: 482331 - DNA, 221 bp, Homo sapiens
agatctcatagcacgatcccccatgagggctcctgttagtcaatgctgagatcatcggagccttcaggcagtgtcctactgaatattcagtgtcagcatcagatccctcatgttttagtactcagagtgctgcgtgtgacatgttccagataccacctaccagagacctctatgttgggtaccgcagcctcgaatttcgctaatcagtcgttcactagcct

SEQ ID NO: 482332 - DNA, 452 bp, Homo sapiens
tttttttttctttcctatttagggctgttcatcccagggcatttaagagctgatttaaggcaaagtatgtaagccagtaatgagcttttggaatgccaccccccactcaggcaagggatcagagaagatgcatgcagggctgtaggagagaggcggagaatgcttgctttgatttcttgtgagcccctctaagccctggcccagcaggcgttcccgcctccaagcaagagccaaatccagctctgagctggggataaggagcccctagattggaacgaatctcttggggcagtctgaagaatttcttgcaatgccagagaatctagcagagataggtgtggaccagagtcctaggggaggtttgttacatggggagatgcattaactcatggctttgcatggctgtgcagcaagatggtatcacagtgaagcaatgcacatgatgctaaaaa

SEQ ID NO: 482333 - DNA, 568 bp, Homo sapiens
tgggtgctgggggagggggactgggaagttcgtgtttaatggggacagagtttcggctcgggaagataaaacatctggaaattgacagttacagttaatatgaatgtatttcatgccaccaagctgtagattcaaaaacagttaagacggtagggtttgttatatatatatacacatattacacaagttaaaaagtaatttttacaacacatacaacatgaccccagcgatgtgaggacacacataaacagacgtgtttgtacgcacagagagacacacacagacatgtggcttaaaattctgaaagaaatgcccggaaggctgacgtggtctttgggtggggagatagcgcagcccagagataagacccctcccccatggcgttgtttccctgctggagacttgctgtgatttccaagttttctaaaaggggcaggcagtcctctcacagtggactgaagttatgaaatgtgcttctttccctgcccgtcccacttggcctttcggcctcactccacacaatggggtcgttcagccgccctgccacgctgccacgcacttgcggccg

SEQ ID NO: 482334 - DNA, 909 bp, Homo sapiens
  misc_feature (31)..(31): n is a, c, g, or t
  misc_feature (72)..(72): n is a, c, g, or t
  misc_feature (74)..(74): n is a, c, g, or t
  misc_feature (112)..(112): n is a, c, g, or t
  misc_feature (132)..(132): n is a, c, g, or t
  misc_feature (139)..(140): n is a, c, g, or t
  misc_feature (143)..(143): n is a, c, g, or t
  misc_feature (145)..(145): n is a, c, g, or t
  misc_feature (147)..(148): n is a, c, g, or t
  misc_feature (150)..(150): n is a, c, g, or t
  misc_feature (167)..(167): n is a, c, g, or t
  misc_feature (226)..(228): n is a, c, g, or t
  misc_feature (230)..(231): n is a, c, g, or t
  misc_feature (258)..(258): n is a, c, g, or t
  misc_feature (265)..(265): n is a, c, g, or t
  misc_feature (288)..(288): n is a, c, g, or t
  misc_feature (292)..(292): n is a, c, g, or t
  misc_feature (295)..(295): n is a, c, g, or t
  misc_feature (352)..(352): n is a, c, g, or t
  misc_feature (391)..(391): n is a, c, g, or t
  misc_feature (408)..(408): n is a, c, g, or t
  misc_feature (410)..(410): n is a, c, g, or t
  misc_feature (437)..(437): n is a, c, g, or t
  misc_feature (497)..(497): n is a, c, g, or t
  misc_feature (600)..(600): n is a, c, g, or t
  misc_feature (621)..(621): n is a, c, g, or t
  misc_feature (844)..(844): n is a, c, g, or t
attctcaccatttgtctcacacccacaaaanccacttcacgggcattaacgatctcccaaaactcatcactntnccccaagtcaaccatgtcaaaccaaaaaaacccttgtncacttgctcagtctaaaggntattaanntcnancnnanaaagcccattactagangtagaaatacaggcaatatactattacggcaacaaccatcaattacagttaagaatatnnnanntaacaaccaaatggataatcaaatatngcaacanctcaagaaaaaaaaaaaaaaaanaaantcnaaagaattcagtgttgctattcagttttctaacttaaaacagcctatgataactggnagcaaagaaggtccttgcaatagactgcctctgcttganaacttatgatgtaattntngcatgctgctaatatactatctaaacnttaaagatactcctaaaatatttgatggtagagctatgattaagacattacactacaaangaaccttatgcagaaggaaatcctaactgacgtgcttctgctttaaatattgtgaaaacattacagcggaatgaattttcgcagtggttaggtcaaatgcagntacatcatagcaacagtatgntttgcacaatttaaggctttggctggttctttagtcagcttcttcctctgattcttcttcttcagcagtttctaaccaggttagccactgattcacctggaacaaagccttgccttttcccggaaactcttgggttatatcttctttccaagccaagaaagcttcttcttcaataatttccatgtcatagaagtgcacaaaaaagcgaagtaacatgcctttngggaagttgctgttatagcagtgcacctggagagcatacagggcactgacctgtagatcacgtga

SEQ ID NO: 482335 - DNA, 1149 bp, Homo sapiens
gatggctgcagacgcagtgtcacccggagtgaaagtctgttactactacgacggtggatgtatggaaattactatatatgtgacaatggccagccaatgaatgcctcacctgaatcctgcatgactcataatttgctgctcaactatggtctctacctgaaaaatggaaatctatcgccctcacaaatgccaatgctgaggagatgaccaagtaccacagcgatgactacattaaacttcttgctgctccatccgtccagataacattgtctggagtacagcaagcagatgcagagattcaacgtaggtgaggactgtccagtcttccgatggcctgttatgagttcttgtcagtatgtctcacttggttggtatcttgtggcaagttgcttgtgaacactgtaatcaacgccagcatgcacggcaccatctgctggtgacatatgggctaggtgggcctagcacccatggcacaagaacgtccctgagtggcatcttggctatctagtatacctgtcaaatgcatatacgtcttgtgcacatacctgtggaacttgctacacgtatacaccgagagtggtgcttgtacaatacgcacatttgatcattcaccattggtgaccggcgttggacgaggccttcatacaccactggaccggggtcatgactgggtcctctccatcacttcatggaagagtaacttcccagtgaactggggaaccttacgggatatcggcggcctgtgcaagggccagtataattgctggtacctaaccgctctgagacggcattgatgacacaatcccatgaggcaattacaaggccggaaccatgtcccaaagaaatggccaatgtcccagcgaagtgcgagggcatacaccagtgtgcgtaaacatcccgatatctgctgccgaaatctggatacaggattgggacaacaccctaaccatattccaacacgagccacgccacacatcgttgcactagacaacgtgcacgtacacggcttaagaccaggcacaatgataggcacctattaaagctaggtgtgtcacaccaacacttggaacggatctgacaggcgcagcgtgcacaacatcaagagaccaaagttgcgccgtggaaaaacgtgactaccacaagatggct

SEQ ID NO: 482336 - DNA, 148 bp, Homo sapiens
tgcagctatagagaagagcaggccggtatcagaggggtagcttgagtaccctctgggactcagaagtgaaagggggctatacctagtatgagtactatagccattatgattattaatgatgattattgataggcagtattgggtgtgc

SEQ ID NO: 482337 - DNA, 115 bp, Homo sapiens
ggtgctctagaggatccggatgaggaacgtcactgatatcttctccactagaatgtaagctccatgaaggcagggtttgcgtatactcactgtggtatccccagtggccgaatca

SEQ ID NO: 482338 - DNA, 101 bp, Homo sapiens
cccgactagccgacaggaggctgataaaattataaacatcacactacagaatactatagtgatttggccgggcacaggggctcatgcctgtaataccagca

SEQ ID NO: 482339 - DNA, 382 bp, Homo sapiens
cagagcaccccccccccccagatggtattcaaaacaaaggccctgatagcctgggtttcccagtttgttcccttttacccaggggatgtcatcctaactgggacccccccaggggtcggggtattcaggaaaccccctgtttttttcaaaaagggggatgaagtccagtgtgagatttaaaaactaggggtcatcatccccaaggtggtgtgatggctcctgcccaggccccccataggatgagggcatttgctccccctcagcctagcccagggaaaggcccagtggcaggggtgggcaggggccacccctccaaacccccttttttcggtaaaagggaaaaggccaaagcttttttcaataaatggggcgggtcaaacca

SEQ ID NO: 482340 - DNA, 531 bp, Homo sapiens
  misc_feature (22)..(22): n is a, c, g, or t
  misc_feature (337)..(337): n is a, c, g, or t
  misc_feature (380)..(380): n is a, c, g, or t
  misc_feature (448)..(448): n is a, c, g, or t
  misc_feature (476)..(476): n is a, c, g, or t
  misc_feature (489)..(489): n is a, c, g, or t
  misc_feature (509)..(509): n is a, c, g, or t
  misc_feature (523)..(523): n is a, c, g, or t
  misc_feature (531)..(531): n is a, c, g, or t
atgaaaaaacattacaggaggnatttagcaatttccagcttaaagaacttgcccaccaacataaccaatttatgaaagtgaatttctattatataaggtatagaacctcttgttagtggcatgataggcaagggacaaagctacaacttggcctgtgcctttggaagctgaggcgaggaggaccatctgagcgcaggagcctgacaccagcctgggcaacatagagaatccgtctcaacaaaaaaaaaattttagccaggtgtactgtgagcggtagttccagcggacaagtgtgggaggattgcttaggcctgggtgattgaggatgctatgagcngtgattgtcccaccacactccagcctgggcaatacagcgagantgtttcaaaaaaaaaaaaaaaaacccaaaaaaactcaagaatgtaatgaatgagacccaatgtgcctnttctagaaaaagttgccaaatatatctnttggatctgctgngcatgttctctgatacatanggcaagcgtgtttntacacccn

SEQ ID NO: 482341 - DNA, 404 bp, Homo sapiens
  misc_feature (13)..(13): n is a, c, g, or t
ccataaaggcctnccctaaaataaaggccccatttcctaaagtaaattagtatcccctaaacaaattttaaagttagctctgccttctcccagtgacattttggtttaaagaatcaaggggaggctgggcgcagtggctcatccctgtaatcccagcactttgcaaggccgaggtgggcagatcacttgaaccccaggagttcaagacaagcctcggcaacatgacaaaacctcatctctacaaaaaatacaaaaattagccaggcccagtggcatgtgcctgtaatcccaactactcaggaggctgaggtgggaggattgtttgaacttgggaggctgaggtaggagtgagcccagatcacgccactgcactcctgcctaggcaaacagagctagaccctgtc

SEQ ID NO: 482342 - DNA, 209 bp, Homo sapiens
actattcagctctcctcatttgaaggacctgcgtttaaggaactctgacccacgcgagatgctatttaaaagagtcccccccccgaggatggcagtgaccaagaatgataccctggtgactatgtagatatgtacactgccatccggaatctacggagaaggcacatgcccagaagccccacacagatgacatgcaagccctgtgaagt

SEQ ID NO: 482343 - DNA, 476 bp, Homo sapiens
  misc_feature (160)..(160): n is a, c, g, or t
cagtactataaggggccttatggtagcgaggcctgggtggcgtgagccgtcggcgtcttctggtgcctgtggagtttcttgtgacatgtggtgcctgctggggctcagtgacggcgcccttagcgacaccatggcccgaaatgcagaaaaggccatgacngccttagcaagatttcgccaggctcagctggaagagggaaaagtgaaggaacgaagaccctttctggcctcagaatgtactgaactgcctaaagctgagaagtggagacgacagatcattggagagatctctaaaaaagtggctcagattcagaatgctggtttaggtgaatttcgaattcgtgacctgaatgatgaaattacaagcttcctaagggagaaaggacactgggaggcccgaataaaggagctgggaggccctcattatggattgccctaaatgctggatcatgaaggaaagagctccacgacaccag

SEQ ID NO: 482344 - DNA, 319 bp, Homo sapiens
  misc_feature (36)..(36): n is a, c, g, or t
  misc_feature (63)..(64): n is a, c, g, or t
  misc_feature (74)..(74): n is a, c, g, or t
  misc_feature (83)..(83): n is a, c, g, or t
  misc_feature (87)..(87): n is a, c, g, or t
  misc_feature (94)..(94): n is a, c, g, or t
  misc_feature (102)..(102): n is a, c, g, or t
  misc_feature (106)..(106): n is a, c, g, or t
  misc_feature (164)..(164): n is a, c, g, or t
cctggccctcctcttcctcgggagaacctgggattnaatctgtgaggtgggaagcctacaacnnggagaactcnggctctgcngagnccctgtncccctttntctncctttacacccaataaaaccctgccttacccttcaaattgtctgcgagcctaatcttncctggcgtgtgacaaggacctccaccgtctttagctgaactaaggaaaagtcccgcaacattttcatgtgtgcctttgtatttttattacatatatggatgtccctaaacaacatacattattgttttgctttatatattaaaaaggcattctgc

SEQ ID NO: 482345 - DNA, 502 bp, Homo sapiens
gaggatcccctatgtctcgatcgttatttctactggctgtgcagaagcagtcattggttaggtcccatgttatttattttcattggcttccggtcattttcctgagccaggaatgaaattaaaaattcctttctttagatttatagcagacaacagtgatttatttatttatttagaaacagagttcactctggtggcccaggctgaagtacaagggcacgatctcggctcactgcaacctccgccttcaaatctaattaaccttctcaaaagccttcctatttaaccattctcttccatcttcagggccacaaccttagtccatgcggccatgatttcttcccgggacaactgcaacacttcctcactgtttcccggtttccactctggccctcctataatggattctctacatggcagtgatgataatatatatacatatttttttggagacggagtcttgctcggtcgcccaggctggagtgcaggggcgcgatctcgg

SEQ ID NO: 482346 - DNA, 268 bp, Homo sapiens
  misc_feature (24)..(24): n is a, c, g, or t
  misc_feature (26)..(26): n is a, c, g, or t
  misc_feature (28)..(28): n is a, c, g, or t
  misc_feature (153)..(153): n is a, c, g, or t
ggaccaccacccggccgcacgggncntntttgtcccccgcccgccgcttctgtccgagagccgcccgcgagggcaatcctgaccgcgagcgtcgggtcccagagccgggcgcggtggggcccgaggctagcatctctcgggagccgcaagtgnatgcctgcaaagatgtaaaagtcaagagaagactctaaaaatagcaaagatgcttttgagccagaatgccttcatcttcagatcacttaatttggttctcatggtgtatatcagc

SEQ ID NO: 482347 - DNA, 497 bp, Homo sapiens
  misc_feature (79)..(79): n is a, c, g, or t
  misc_feature (171)..(171): n is a, c, g, or t
  misc_feature (173)..(173): n is a, c, g, or t
  misc_feature (175)..(175): n is a, c, g, or t
  misc_feature (180)..(180): n is a, c, g, or t
  misc_feature (190)..(190): n is a, c, g, or t
  misc_feature (265)..(265): n is a, c, g, or t
  misc_feature (340)..(340): n is a, c, g, or t
  misc_feature (343)..(343): n is a, c, g, or t
gtaccaatctgaagtgggtcctaaactaggggtcacaaagtcaacttctcctcccgtgctatccaaggtgtcctccggncgtgataggcaggaagtgtggatgcatttcagtgtcctggacaagattctctcgacctttccttttcccataggttgttcacatcaggaccngntntctcnagtctctggnagtcgaagggcaatcaggccacccccaaccagagaagcagcagccagaaggatgggggaccactttggttatccnaacaaaagaagcaaagatggtgttttccaaggaatggcgccaaatttgcaataattccatttgaagaatggccgnagnggttttgctctctgggttgggtggggatacagcttccactggtggatcacatccaggaagcattccaaggctgcaatgcttggtcccacagaacaggcactgccagccgattcattgcagactcactgttgccaaaaaacaggaagaagcagca

SEQ ID NO: 482348 - DNA, 150 bp, Homo sapiens
ggccactgaagatcctggtgtcgccatgggcgccgcccgccagttgttacggattgtaagaacaagccgtacccaaagtctcgcttctgccgaggtgtccctaaagccaagattcgcaattttgacctgggcggaaaaaggcaaaagtga

SEQ ID NO: 482349 - DNA, 883 bp, Homo sapiens
ggcagcacgtgaaattgagcggcatgccatctgcgtgagtgacagggagtgaagaagagtggggattgaagagaaatgagtgcccccacgtgggagagagaagagtgccaagccgctctggaggaagagtaagtgtgctgtgcgtgtgcggcgtgctgcattggcttctgcctgtccctggcccagggcacatatcggccgctacgtgcgcttcttccacgacatcctgcacaccaagtaccgcgcagccaccgacgtctatgccctcatgttcctggctgatgtttgtcgacttcatcatcatcatttttggcttctgggcctttggggtgagccaggccctgggacccaaacccagtgtacgcagatgctcagcagccaccgcaacatcccctgtgcttggctccccctgacctgtgctctcctggccacagaagcactcggctggccacaagacatcacgtcctccctatcagacgagcaggtacccgagggctttcctggtcattgctgctgatccagtttcatgtaccatggtggttgaccgcgcccatctacctggcggcaagaaccgtgctgtgcaaggctggccttccagtgtggcgctggtgctggccatccacctatgggatgttcttcatcctggccgccgtcgactgagaggattgttcaagcagaatgttggtggcccagcatctggtagcttcgtgaagttgcttctactttcggccttgtccggctagcagatccgcttgtgggtacccgacccggattccttcggaacgttcctcaccaagaaagtacaagtcattttcagcctcttccttcttccaggggttacgggctgttagcgttccttgttggacttcgggcagttatggat

SEQ ID NO: 482350 - DNA, 945 bp, Homo sapiens
ccacgcgtccgcggacggccgtgggtcaggctccacttctaattctagttctcttgcagttttcacaacatcagtagttacttcctccactgaaatcttcaacccctcagtcatccatgagggtggaatcaactttttcccaattcctgttaatgctgatattttgacgttcttccatgaatcactaatgttcttaatttcatctagaatggtgattattttctaaaatgttttcaatttacttgcccagattcatcaaagcaatcgctatctatggccgctatagccttataaaatgtatttcttaaataataagacttcaaagtggcattactccttgattatgggctgcacgaatggatgtgtgttagcagccataagaacaacactaatcttgtacatctccatcagaggtctggatgaccaggtgcactgtcaatgagcagtaacatttgagagggatcttttgtctgagcaataggtctcgacaaatgggctcacatattcagtaaaccatgttgtcaacagatgtactgtcatcgggcttgttgcttcattatagagcaataagcagagtagatttagcataattcttaagggccctaggatcgttgacatggtacgtgagtacttggcttcaccttgagcacaggttgccaccaacaccttcacttgtacacacaatgccttatcagcaagtgcagtccagtcagaatgagacacgcctgtatttttaaaaatctcaattctggtaaatgtggcagatttatgaatgcatcgttagctattcatctggttctgcacctagcaaagtctatttagcctagggccactgaatgtacagaattacagaatacattttggcaaaggaggagacaaacacacctcgataaaaaaacaaaacagaaacaacgggagaaaaaagaaacaaagacaagacaacaa

SEQ ID NO: 482351 - DNA, 416 bp, Homo sapiens
  misc_feature (131)..(131): n is a, c, g, or t
ttttaattgtggaatcctgtataatcaaaattgacattttaataaataactgacagcaaggcagattaagaagttgagttaagaagagaataataccattggcaaggagtctaatcagaaagctttacagncctggtgctgtggctcttgcctataatcccaacattttgggaggccaaggtgggacgattgatcgcttcagccccaggagttggagaccagcctgggcaacatagtgagaccctgtttctaccaaaaaattttaattagccagacgtggtggttcacaccagtagtcccagctacttgggaggctgaggcaggaagattgctttagcccagtaagtccaggctgtggtgagccatgatcatgccactgcacttcagcctgggcaacaaagtgaaaccctgtctcc

SEQ ID NO: 482352 - DNA, 236 bp, Homo sapiens
cagccactgcgctctggatccgacgataaattttctcattgaaaatactccttttaagtccatatatggaaatttgaaaactgtgaaacgaataaataattagtcatgcagattatgaacagaaccatatttaaaatagcaaaaacataaagattgcgcatctttttcaagtaaaagagcagcatgatgtataaaacgactatgaatgatgtgcctaaaacctttacatcaacaat

SEQ ID NO: 482353 - DNA, 343 bp, Homo sapiens
ccaccttcctgtacgtgtggcttggtcgcttcgtggctaccgtagaacgtgcttgtggaagacaagtctgctggcttggtgagtctgtgtggccagcagcctctgatctgtgcatggtattaatcgtgtctagggctgaggtgttctgggatttctctagaggctggcgagaaccagttgttttgtcttgcgggtctgtcagggttggaaagtccaagccgtaggacccagtttcctttcttagctgactgtctttggccagacacaccgtgggctgttacttgctttgagttggaagcggtttgcatttacgcctgtaaatgtattcattcttaatttatgt

SEQ ID NO: 482354 - DNA, 1719 bp, Homo sapiens
agcgggcggagcggcgccggagcgggcgtacatggcgcggctacctactaggttagctaccgagggcctagaccctacggaactagcgcctacggcagggcggtagcggggccaagctgggcggctggccgtggccctggtcacctgggcacggggactagggtggacggcaggggtactctatagcaactgtagtagacgctagccgtctatagccacagtcagctgccagtaggccacacacagcacaacgtcaaccccccgtgccagcgagtatcttcacggatcgcaccagagcaagcacaacacgggcacactgggcacacccggcccgtatatcctcagctagcgtgcaatacataaactcgttggcaccattctaactcacaggtgccacaggcccaagatgcacattagttcattccaattataggcaagctagatacgtctcaggctggccaccgcaggagttccgcccgagcgttacatatataccacaggctctttcgcctatggcaaggccaagaacagcaaccacgcttaaacctttagggcgatacactttaagtatgcccagcaacgattaggcggcggactaggatgaccagcgataatgacagaggcatgatgtattatatacaccaggggcaacgacggcctttaccctacatgtagggtggcttaaactcggcgtatacccctatagtgaggaacgccgtcacccgttgggacacatgtacgcgaatcacagaccggaccgacccaaaagcgaacagccgaactggcggggcggagacattaacgcccatttagggcaacggtcggaacgcccgggattacccataggggtgcgcaaagttaacacacacactttcacccggcgtatatatacatcggcgggacactcataccctaacggggtccatttaacctgcgatcgaccatcccctactcgaccaacgcggtcgcgttatcctggagtgaccctcttatgggtccccacactacctgctcgcgacaccgtctagagaggtaggggcgacacactcgagacctttatccgacgagttactcccttaacacggggtgcgattgataccgacacccggggtttcacgggttgaatgattgaactcagcccatttatagggaacaattttacagggatctgcacaacgcatcacccatatacaagactagggacggcacctccgcccatccgcagagacaactcttcacggtgtgggcatagaccccaaacacgacacataccgagacgagggtctgcaatacgttcagatgacgggagaccgcaagatattataacccactaacccgacatcctacacaccagatacaacgtagtcagagtacgcagacccttaccattcgctgcggcaccacacacgtgggactttcccgcccaaagtagagataacgtgcccgcccgcacatgagatgaggagggaggtacacaatacgcaagccgatccacagcccaccctatgtgagtcaacatgcgtcgccgcccacaacattacaccagtattatattacgccacaacaacatcggtgcacaacggggactattcacccggcccacgtggtgacgtcttcatctacacacgctcccagatgatatatggggatcgcgcacctaacatgccatccgctccccgatgtttattgacgcaccgcacgtcctttttgggtcaccga

SEQ ID NO: 482355 - DNA, 169 bp, Homo sapiens
gcgagctggcctaatgtggtggcctgcaagccaggcattccctgggcgccacaagacgagctccgagccaggtcaagggttcggagggccacaaagcttagccttcaggcccagggaacttattttgggcaaaggggcccttacccaaggtttagctaggcccaagacc

SEQ ID NO: 482356 - DNA, 1238 bp, Homo sapiens
gtgatggcgggtccgtgtaggcgcacaatgctgctcggcccttccacgagatggcgtccgttcgcctgtcggggctcgggagagcttgatcgtccacgctgtcatgctcatgtggtcaaggagctgcgactcatggacggacgcgctgctccaagaggccggtccaacggcacctaggcctggctgggaagtaccgctgtgtctgtacactgaggtacacatttagtggcgcgtatgtgttcgcaccaaggtcggggactctgagaagagttcgaagaatgacagtgatggttggatagcggcatggctgatgacccacttagtagacgaaaatgaatgtcgatcggagggtacgtaggcggcacttgttgtgctagagaagtgaagacaatgggtcagacgggctgccaggaatgcatggcacagggaagagatcttcgtcttgcgataatagtcatgtgatgcaatggatagaagcgtggtcagcttgtagagaacgtgggtgagtacaaatctacattaacgaaacgtgggctttgtacccgaagatactgggaaagataatatgagacagggacttgaagggatagggcaaaagcagaagttaccactcgtggggcactcgtggagacttccctcaacagttaaacgcagggaacaggtcacgttggccgagatgttccatgagctggaagctaggctttgggtcgccacaagccccacggattgggccggacgtgggaattccggtcatgtgggcccacgaaccgtgacacgggcctccaacccttggagttggtgagcggaataccaaggcgttgacaagccgcgagaagccattgtggatgaggagcagacagccttgcctggggaccgatggggccacgagttcacggggggcgaccttgtggaaggaacgcctgggtagcggcctgctggaaacactaatgatagctgggcgttcacccgtacgcatgctggaggttgggacaggttgaatacgagcgcgggagagttgcccaagggtaaacaacagggggacacggcaatggtgggggtaaaccgaggaggtcgggttggggcaagaaaaattagagagaaggagtgggggccgagttataggaaccaaggggcaggtccctcggaataagggcagtggcctggtagttgagaacaaatggggatttagatatgggggcaaggctgtcttgtgggagtaaaggggtgggagaaaagag

SEQ ID NO: 482357 - DNA, 569 bp, Homo sapiens
catccgtgaaatagactattggaacacctataagctcgtctgatagattgactagtgcattcatactagacacgttaaagcccaaatatgataagttataaaaagctagtaaaagatgctaattaacactggaataaagtgtgctgaaattgatgttcgtctgtgtgatgtaagtgaggccatccaagaagttatggcagtcctaaacaaattgaaatagatgggaagacatatcacgtgaaaccaatccgtaatctaaatggacattcaatagggcaatatagaatacatgctggaaaaacagtgccgaatagtgaaaggaggggaggcaacaagaatggaggcaggagaagtatatgcactagaaacctttggtagtaccggaaaaggtgtagaacatgatgatatggaatgtacacatatacatgaaaaataatgatgtcggacatgtgccaataaggcttccaaaaacaaaacacttgtaaaatgtcctcaaagaaaactttggaacccttgcattctgccgcagatggctggatcgcatggaagaaagtaaatactagatggct

SEQ ID NO: 482358 - DNA, 141 bp, Homo sapiens
tgtggaaaagcacgttggcggcttttggtcctaagcttgggtcagatgacgagagagagttgtgatgcctcacagggtggggaggcctctctgctcagcgccccctggggaagcccccctttggtggaggacttgctctgt

SEQ ID NO: 482359 - DNA, 248 bp, Homo sapiens
gattcggctattgagtggcatgtcacataaaatctccagaatctgggcctacagttccttatcacaatttccactaactagtggaggtagcaagcagccgacatggccagttgtctccaaaccagtatttggtcttcagtaaacaggtataaacataaaacactgctccacccagccagacttcagcaactactgtgcacagcaggtgaacgactcctaagtcccactgaacaccttccacaggagga

SEQ ID NO: 482360 - DNA, 651 bp, Homo sapiens
  misc_feature (510)..(510): n is a, c, g, or t
  misc_feature (585)..(585): n is a, c, g, or t
gagcagtgtctcacacctctaatcccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatgaacccgggaggtagagcttgcagtgagctgagatagcaccactgcactccagcctgggtgacagagcgaaactccgtctcaaaaaaaaaaaaattaacttggcgtggtggtgggcgcctgtaatcccagctactcaggaggctgaggcaggagaatcactagaagctgngaggcagaggttgcagtgagctgagattgtgccagtgcccttctgggcaacaagagtgaaactctgtctcaaaanaaacataatataaaataagtgctctttaatatgtcgctgggatttggtcaggccaccaatattttg

SEQ ID NO: 482361 - DNA, 405 bp, Homo sapiens
  misc_feature (2)..(2): n is a, c, g, or t
  misc_feature (62)..(62): n is a, c, g, or t
  misc_feature (77)..(77): n is a, c, g, or t
  misc_feature (100)..(101): n is a, c, g, or t
  misc_feature (135)..(135): n is a, c, g, or t
  misc_feature (137)..(137): n is a, c, g, or t
  misc_feature (149)..(149): n is a, c, g, or t
  misc_feature (200)..(200): n is a, c, g, or t
  misc_feature (271)..(271): n is a, c, g, or t
  misc_feature (338)..(338): n is a, c, g, or t
tntcttttgggaatgaccataaaatagtgctatgctctgaatgcttgtatccctcccaaccncacaattgtgtgcgntgattcctaacatacgataattnntgggtcgagccttgtgaaaaatgactaggtcaananggtaagggcctnatgagtgggattagtacctctaaagaggcccaagagtttcccttgcttctnctaccatgtgaggaaagtgagaaggtgcccccaccagacaccagacctgccagcacttggatcttggactncccgggcttcagaactgtgggaagtaaatttatattgtctataagctatcagcttatggtatttggntatatatagcagcctgaatgggtgaatacaaacagggagagaggaactattgcaatagggtcaggga

SEQ ID NO: 482362 - DNA, 557 bp, Homo sapiens
ggcagtcgcagctccaggtctcgtcttcactgctctatgtcctctgctcctagaggtccagcttctgtggccccggttacctgcaggtattgggagatccacagctaagatcgccaggatctccctggaagcctagaaatgggaccactgacatttagggatgtggccagtagaattctctctggcaggagtggcaagtgcctgaggcacttgcacagctacgacactttgttatacggacatgctgatgtgtcagatacactagcagatagacctggttgcttacctggtgtattgctggtactctaaggtccagatcctgatcacttgtctggagcaacggatacatacgagccctgcaatatgaagagacagtgctgatggtagccaaatcccccaggttggagtgcagtggcgtgatcttgggttactgcaagctctgcccctcgggattcaagtgattctactggctcaggctcccgagtagctgggattataggcgacgtgccatcatgcctggctaatttccggtagtttagtagaagtgagggtttcac

SEQ ID NO: 482363 - DNA, 831 bp, Homo sapiens
  misc_feature (9)..(9): n is a, c, g, or t
  misc_feature (70)..(70): n is a, c, g, or t
  misc_feature (118)..(118): n is a, c, g, or t
  misc_feature (128)..(128): n is a, c, g, or t
  misc_feature (130)..(130): n is a, c, g, or t
  misc_feature (138)..(138): n is a, c, g, or t
  misc_feature (140)..(140): n is a, c, g, or t
  misc_feature (161)..(161): n is a, c, g, or t
  misc_feature (171)..(171): n is a, c, g, or t
  misc_feature (199)..(199): n is a, c, g, or t
  misc_feature (226)..(226): n is a, c, g, or t
  misc_feature (232)..(234): n is a, c, g, or t
  misc_feature (256)..(256): n is a, c, g, or t
  misc_feature (268)..(269): n is a, c, g, or t
  misc_feature (272)..(273): n is a, c, g, or t
  misc_feature (276)..(276): n is a, c, g, or t
  misc_feature (285)..(286): n is a, c, g, or t
  misc_feature (290)..(290): n is a, c, g, or t
  misc_feature (296)..(299): n is a, c, g, or t
  misc_feature (306)..(306): n is a, c, g, or t
  misc_feature (310)..(310): n is a, c, g, or t
  misc_feature (350)..(350): n is a, c, g, or t
  misc_feature (384)..(384): n is a, c, g, or t
  misc_feature (388)..(388): n is a, c, g, or t
  misc_feature (413)..(413): n is a, c, g, or t
  misc_feature (426)..(427): n is a, c, g, or t
  misc_feature (452)..(452): n is a, c, g, or t
  misc_feature (457)..(457): n is a, c, g, or t
  misc_feature (470)..(470): n is a, c, g, or t
  misc_feature (496)..(496): n is a, c, g, or t
  misc_feature (499)..(499): n is a, c, g, or t
  misc_feature (820)..(820): n is a, c, g, or t
ccgcgctcncgctctgatacacaaacttggttgtaaaaataatgcagaaacatatacgtcaatctaagtntctgaaatatggccaactctacctcgccgtatatccaacattaaaaanaaaaaaaaangntgtttaanantagaactcattcccggtttcnaccaaattanttccctaattcttaaatcctcaaataantccttaatctccaaagtctcggttgtnggaaannnattaatttgtgcagtccaacanttacatactttnntgnnggngggggaatnntgtncctttnnnnttaatgngggnagcggccaggtccttctgggttcccgtataattgcttagnacttaacatttagttttcatagttcttggtttanagangggtccgacagttagatacttttanttcctcctctttnntcctgggcgctgtcctccttttttnttgcnacccaagctaggnggcccagaattcatcttgcctcccangcnccctttcctcttccctccctggctgggcgggccccctttcctcttgcccccaggcccctgccggcctccctttctcttgcccttctggctcattttcctcctcttggcgggctcctcctggtcctcctccctcatctgcttattggtggccctagtcacatccagctgaggcttcttgctgttcatgacacgaagcagctccaactggttctttttctcggctgcaaagtccccgaaaaggggttgaaacttccttttcttgccggagccccggggcaccttcctccttgggggaggcgctcctgaaagcgccccacagangcggtggagac

SEQ ID NO: 482364 - DNA, 327 bp, Homo sapiens
  misc_feature (27)..(27): n is a, c, g, or t
  misc_feature (41)..(42): n is a, c, g, or t
  misc_feature (45)..(45): n is a, c, g, or t
  misc_feature (47)..(48): n is a, c, g, or t
  misc_feature (57)..(57): n is a, c, g, or t
  misc_feature (59)..(59): n is a, c, g, or t
  misc_feature (77)..(77): n is a, c, g, or t
  misc_feature (86)..(86): n is a, c, g, or t
  misc_feature (89)..(89): n is a, c, g, or t
  misc_feature (159)..(159): n is a, c, g, or t
  misc_feature (174)..(174): n is a, c, g, or t
  misc_feature (179)..(179): n is a, c, g, or t
agccatgactcctttttggcgcccccnccaactgcaaaatnngtncnnggcattaancncttttttctttggcaatncggtttttnttnaggggccccatgaatgctttcttctcctccatggccgggaagcggccatggccaaactgggggggggggncaatgaacttaaggncaatnttctccagagcccgccgtttcgtttgcaccagcaaggacttgcggggggggaccacccgcttttgggttcccaccacacagcctttcagcatgacaaagtcatgtggcacttcaccataggggacaaagccacccagagggttgatgc

SEQ ID NO: 482365 - DNA, 1230 bp, Homo sapiens
  misc_feature (1230)..(1230): n is a, c, g, or t
tggtaaagctctgccataaacttctagcgggtcaaggtatggaaccgggctaacggcaagctggaaagaccaaccactattgggccacacagggctatctggaacacggggactggtgctctccagatgggatccctctggtggcttctgggaggcaaggatgggccaggccatggttatgggagatctcaacagaaggcaaacaccttttacacgctaaagtgggtggggacattcattcaacgcccgtgtgtgccttcagccctataaccgcttacgtggcgtggtgtgtgcgtgccacaggccccagcattcaagactcgtgggattttagagggaaagaatcagtgggtaaagtgaacgtgaagcaagaaagtttatcagtaccagcagcaagggcagaaaccaccccagggacacctcccgggccggggtcgtgcgtgagtggccagaactcgggttgggcgggctacagggacaaccggggtgcgagtgtggtggcagggtgaccattgggcacacgctagaaagtttagtggcagagctttacaaattaaaaaaaaaaggggcaaaaaaaaaaaaaaaaaaaaaaaacaatgacacaaaaaaaaaacaacagcggggggggcgacacaaaaataaccccgagaggggaccacatatatagcagacaccaacgtatttgtagacacaacgagagcccaaaaaaggcgcgcaaataaaagcaacgaaaagagcgcagggtaacacccccgcgcgccgcgcagacacacaccgacagccagacgagaaccacagcgaagacagcaacgccaccacgcgcgggcagcacaccatctgcggacacaccacacccaacaaacgaataaacacgcaccagggagacaaaaaaacacgccagcgactgctaacgggcgtcaccaccacgcgcataagccgccgaccacaacaaaaatctaggccaccgcacgaggcagacaaacaggaacaaataaaggggggaagccgaggacaacaacacaagagacccacacacacaccaacccaccgcagacaaccacaccagcgaagagccaaccgacagacgacgcacgacaggcccaagcacacaagacaacaaacacaacccagacagagcccacaatacccagccaaccagcaccacgacgaaacacaacaagcacaacgagaacgccgagacacgcaacacaacgcaaccccaagccgtan

SEQ ID NO: 482366 - DNA, 130 bp, Homo sapiens
cctgaagctgttaatgtgcataaaatgaattctaattgattcaatgaggctctatagtgaataagaatcactcttctaagtttttccccgttatttgttaaaagtgtggtactctcttgcgagaacgttt

SEQ ID NO: 482367 - DNA, 329 bp, Homo sapiens
taccctgatctggccacgcccctgctccagcaatcgccggacctgcatcgatggaagcaaaacagcggacgcagattgatatctccctcaatgcactcaccggtagtgagatgagcgccggggaaaccatctttgaatatcccaattgtcattcccttacttgcgaatgcataagaatgtagagcgtaaagaatcaatacctcgcaatcatgtaggagatttttcttttctttgacaggtacttcccgttcgcggttaagcatcttgtagttaatcggaggaataggaaaagtacgccatgcgccactaccggcgaacgatcagacaag

SEQ ID NO: 482368 - DNA, 290 bp, Homo sapiens
  misc_feature (226)..(226): n is a, c, g, or t
agctgaggttcttggggtggcgtcgcgttggctcgggctcccgtcttcatgtcagtccctgtgggtttgtccctgttggtctgtggtccgtctcctcttcttcgctcgagcccggtcatggcctgacggcccaagtctaatccagcatgacctcatctctgtcatcattccaaataaggtcacattcaggggtttcaggtggacatgaatttcgggggaacacaanctcaaccccctgtttaaaaccccccctttttccccctcccccgtaacagatggttctctgggat

SEQ ID NO: 482369 - DNA, 147 bp, Homo sapiens
catcatacttgagctcctccctacacagttacaacctactctactgactgtcaagcgctgttgctacacagaggctctcctgtgtgctggggggaagggggcagctggaaaagtacttggcagaaagccaaagggggtcccgcggtt

SEQ ID NO: 482370 - DNA, 320 bp, Homo sapiens
tgggctagaccagtttactcccttcaccccggctatcgggggctttttcttaacttttcccccccttccgtctatgttttatgatgagacttctggaaagaaaaccattttccgtttgaacacccggaaaggtttgtggtcacctcatgcttcctctaatgcctgtttaaaacattaatcattaatcctgaagcaaaaaaaaattgagcgcgcctggggatcccaagaaaccggttgtgaaggtccagcccgctattgacctctcacttgcctcctgctgtgaagacagttttttaattaaacaggatttgctcgttaaa

SEQ ID NO: 482371 - DNA, 1371 bp, Homo sapiens
  misc_feature (1350)..(1350): n is a, c, g, or t
  misc_feature (1371)..(1371): n is a, c, g, or t
gacgaagggtaatatagtgccaagagtggtggtctccaagaaggggttcatatgatgtcttgatcctatagtgtcgtaacgcactatactggagacttgcctgaaatcagccctctttctccgtgatctcaggctgggagaacgtcgagtggcacgtgagctggttgtgcgcgaggggagcgatcggacatggtcatggtgagcgtggcacatccgcgagaggcaccgagtgtgtagtcaaaagcgcgtgcgttggtcattgcgagggatcggcgctgcgagatgctcaacgcctgacataagccacgaggaacgctcgaacatggtggagaccccttggtaaccacgtgtaggacaggttgttcgaagggacgaaggagtatgtgctaattggtcgtagggtcttagaatgccgacgaacttgcgcgtactctcgctccaattcgactaggcgcgaatcgtacaactcagaacgcaacgttgcgggagaagcataggttgggacacgcaacccacatgatgcaacacgctgagacctttagtgatccacgttccacatgggggcacgaaaccaggacaccatatgggtaggccctccatatacacagttaggcgtactgaggatctctttcgcgtttgccctgcaagggaccagtgagggcagtgcgtggaagtggaattacaccgtgagttagccatgggggtacaagggcccaagccgctcgactctgtcgttacccggaagaataacgcgtggcaccaccttacaatgggcagggaactggggggcaaagaagtccccgacagcaaaagccacgccacggcagagaaatgactgggcgggacagctaggtacaagggcgcgaaacacactcagcaccagcaaggaggagaccaccagagagagggaggcaccggcgtgagaacacggccacccaataactgggagaccggcgcaagacaataattcacgtcggcacgcggagtaacacacactacacgacggaggaaccgccccggcaaagcgggggcccacaacgacgcgaggaacagcgcaagggctacagataccatccagagagaagaaccggggaacagacgataggcacatggcgcgacggaagacgacaccactatcaacttaggccgctgaccggactaggggcagagcaaagggcaacatcgcaccatggagcacggcgagcaggatgatcacaaatgtcagacaaccgggccagaaccactacggcagcattgggacgagagcgcaccacacgaaggagtacgcacctaacgggccacgtagcaccacaggtggagcagccctagagacagaaacaagatcacgangcagcacgaccagacgagcgn

SEQ ID NO: 482372 - DNA, 1652 bp, Homo sapiens
  misc_feature (215)..(215): n is a, c, g, or t
cgacgttgttctggcattcccgtagtcatatcttacagggaaattatatcacaatgtcccgtgacccccattagatgtcctgcgacatgaagcgagcgacgcgatgtcctcaatgtcctcgttagtcgagcgacgaacccacttagtgtggcaccaaactcttggacattgccagtatggaacaggtacgatcgtaataagagaggaatagatangtgattggctatacatactatcagtaaagtctccacagacggatcctaggagaccaaagcattcttgctgggtcatgctccgatgctaactctgcttggccacttcgcaagacgcgctgcatgacttgtcatgctgttcatagtccgtctcgaggaattacatgaccgatcagggcgtgttgcgtgaagagtgttgtgctgacatgccacactgtggtagacccactacctgaatgtcgacgtgagcctagtcgtgtcacctcgcatgcgaacactcttatcaactgaaaacgcgagcatcgcaagagacaattcacattacccgtggaagcaccattgcgcgtaaagtatgctggttgttaacatgagaccctccacagggagtgtggactaccaccacatgtaccatacttcaagcggcatcgagcagttgcttaatagattccaatccctaacactaacgcaataatgtgggcctagctagtagacaagcaggaaattactcgctatcatggcgggcctactagtaggaggcaatttgcccagttccacaaatgccgagaaaacaaaccaggggaagccaccacgccaggcgagggaatacagagaagtgaaggtcggaagaagacctgagcatccgaggcgaaagcgtgccagacgacagacgcggtcagtcaccaaattcccacgagtagaaccagacccatctgggggaagggaccaaatgcgccggaaacctgggaagacccatacagaaaggaatccccttgtaagagttttcttaaccgatcccttgtacatcttaggggaaaacccgccaaaaattcttcgaacaggcaaagatgcgacaggcttgactagggggtaacacaccgtccagagtgaccctagacggcccacggaatttccaagagcgctcggaatgagtgccgtgttcatcgaggcaccataaaggatcgacagccaagaaaacctcgagagtattgacagggggggcctacaatcataaaaagatgagcacacatgataccatatataacacatccctattcaaaaaaaggacgaccatacaccgcccacaaaaaatatatttaccccaccaacaaaacaaacaatagtgatgcagacaaccaacgagatatcaaaagagcgatgattataagagaggcatacgacctgcagggagcagtcagtgcgacgaagaaaggagatgaacatcaagcagcggccatactaagattaaacctgtacaacagcacacagaacgaatatacatgaacgatactacatctagtctttcgtactctgacgctggtcgcgcgcagcgatcgagcagacaacaggaataaaagcaatgacagcatgattgatagccataactaatacacgaaacaaagaaagaacaaaaccatagataaggcgtatagaaccgaagcc

SEQ ID NO: 482373 - DNA, 193 bp, Homo sapiens
cccttcctatggaggtggaaaagaataacaccccctctgagcccggctctggccggcggcctccccaagaggaagaagaagacgaggatgaagaggaagagggcctaccaagaagatgctgaggccccaggcatcagagaacatgagagcctgtagccacccaatgtttcaagaggagcccccaccctgttcc

SEQ ID NO: 482374 - DNA, 100 bp, Homo sapiens
ttttgctactactctttcatgcaaaggcagacacgtcaggcatggaggcatttccagttccactatgtgccagccaggttctcccaggtagggaggaggt

SEQ ID NO: 482375 - DNA, 749 bp, Homo sapiens
  misc_feature (3)..(3): n is a, c, g, or t
  misc_feature (11)..(11): n is a, c, g, or t
  misc_feature (16)..(16): n is a, c, g, or t
  misc_feature (18)..(18): n is a, c, g, or t
  misc_feature (25)..(25): n is a, c, g, or t
  misc_feature (40)..(40): n is a, c, g, or t
  misc_feature (45)..(46): n is a, c, g, or t
  misc_feature (54)..(54): n is a, c, g, or t
  misc_feature (67)..(67): n is a, c, g, or t
  misc_feature (73)..(74): n is a, c, g, or t
  misc_feature (91)..(91): n is a, c, g, or t
  misc_feature (94)..(94): n is a, c, g, or t
  misc_feature (100)..(100): n is a, c, g, or t
  misc_feature (108)..(108): n is a, c, g, or t
  misc_feature (119)..(119): n is a, c, g, or t
  misc_feature (132)..(132): n is a, c, g, or t
  misc_feature (134)..(134): n is a, c, g, or t
  misc_feature (139)..(139): n is a, c, g, or t
  misc_feature (188)..(188): n is a, c, g, or t
  misc_feature (190)..(190): n is a, c, g, or t
  misc_feature (194)..(194): n is a, c, g, or t
  misc_feature (200)..(200): n is a, c, g, or t
  misc_feature (206)..(206): n is a, c, g, or t
  misc_feature (229)..(229): n is a, c, g, or t
  misc_feature (235)..(235): n is a, c, g, or t
  misc_feature (238)..(238): n is a, c, g, or t
  misc_feature (242)..(242): n is a, c, g, or t
  misc_feature (247)..(247): n is a, c, g, or t
  misc_feature (253)..(253): n is a, c, g, or t
  misc_feature (255)..(255): n is a, c, g, or t
  misc_feature (265)..(265): n is a, c, g, or t
  misc_feature (272)..(272): n is a, c, g, or t
  misc_feature (317)..(317): n is a, c, g, or t
  misc_feature (330)..(330): n is a, c, g, or t
  misc_feature (346)..(346): n is a, c, g, or t
  misc_feature (351)..(351): n is a, c, g, or t
  misc_feature (357)..(357): n is a, c, g, or t
  misc_feature (365)..(365): n is a, c, g, or t
  misc_feature (367)..(367): n is a, c, g, or t
  misc_feature (369)..(369): n is a, c, g, or t
  misc_feature (390)..(390): n is a, c, g, or t
  misc_feature (393)..(393): n is a, c, g, or t
  misc_feature (413)..(413): n is a, c, g, or t
  misc_feature (424)..(424): n is a, c, g, or t
  misc_feature (426)..(426): n is a, c, g, or t
  misc_feature (435)..(435): n is a, c, g, or t
  misc_feature (437)..(437): n is a, c, g, or t
  misc_feature (441)..(441): n is a, c, g, or t
  misc_feature (453)..(453): n is a, c, g, or t
  misc_feature (466)..(466): n is a, c, g, or t
  misc_feature (496)..(496): n is a, c, g, or t
  misc_feature (516)..(516): n is a, c, g, or t
  misc_feature (518)..(518): n is a, c, g, or t
  misc_feature (522)..(522): n is a, c, g, or t
  misc_feature (537)..(537): n is a, c, g, or t
  misc_feature (546)..(546): n is a, c, g, or t
  misc_feature (548)..(548): n is a, c, g, or t
  misc_feature (559)..(559): n is a, c, g, or t
  misc_feature (561)..(561): n is a, c, g, or t
  misc_feature (567)..(567): n is a, c, g, or t
  misc_feature (571)..(571): n is a, c, g, or t
  misc_feature (587)..(587): n is a, c, g, or t
  misc_feature (607)..(607): n is a, c, g, or t
  misc_feature (609)..(609): n is a, c, g, or t
  misc_feature (665)..(665): n is a, c, g, or t
  misc_feature (687)..(687): n is a, c, g, or t
  misc_feature (707)..(707): n is a, c, g, or t
tangtttccantatcnancttttanttattttttaacaanaaaannaaaaaaantttgccaggttanaaaaannagggctttcttgaaaanaanttaaantttccganttgaatggcanaacgcacgtagananaactnaaggtggatggctgtatctcccaatactggaccgggttgctgaaaaaantnaaanccgaanaaaaancctttttggtgttgtgtccaggngggcanaantaanttganccaacnanaaaaaaattnttgtaanaaaggaaaaaaacctggatgtacttatgccctgccaacccaccangaactctggaaancttgttgttgtccaantaaancccccncaaaagangngngtgggccaaaaaaccaatatnaanaacaaaaaagccgttgaaanccaaacccaantnaaccaaaanantcantcctttcaggcnaaccgcaacaacnctgccgaatttgttgccaacaaaaagtaantccgtaagggaaggaggaanancttnaggaatgctggtganattggtatnancaatgcggatntnggagancttnttcattccctggaaanccccattttcaattcctgancncttcagcggattggtgcccagttctatgaaaataatctggttcagtccattgaaantaacttttcgcactttggtganctcattttcatgggcacgcngctcctgaagagttttgggcattttttctggcaattccttca

SEQ ID NO: 482376 - DNA, 216 bp, Homo sapiens
cattgggtttcaatgggccggaagatggcacccgggatattcgctttacttggagacttagattcacttgggccatcgcaatgagaaagggtctgagattccttatattcaggccttcttcatgctccgtaaccacccttctctctgccactcctgctctactctccaaatcctactcaccagctcaaaagctgactcatctcccatcaccccacc

SEQ ID NO: 482377 - DNA, 147 bp, Homo sapiens
  misc_feature (42)..(44): n is a, c, g, or t
ggtgactctagcagttccatctagtagcaggcagctgttggnnnttcggtgctcagtggttgcgccaccttgaaaggcgcagacaggcgtttatggacctggtggggccctcgacccagtcccgggttcagggccattacgtggata

SEQ ID NO: 482378 - DNA, 958 bp, Homo sapiens
  misc_feature (73)..(73): n is a, c, g, or t
gatcatgtcaacagatgaggcgggtggcagcgacagagccaaaatcagagctggaacctgaggagagagtgtncaagaaggaagtgtatcttcatacatcaccacacctgaaagcagatgtgctttgccagacgtgatccaactgcagagatggcagctgagtcattggcctttctcctttgggacactgtccagctggtgagctggaagcctggtatgaggacctgcaagaggtcctgtcttcagatgaaaatgggggtaactatgtatcacctcctggaaattgaacgatggaagaatcaaagaatcttcaagcaatcttgaccctgcattctcatggcttggctgacatgaggaggagacagaagcagcagaggtcacaagacgaccgtcccagaagccctcactctccagattccagtcagagctccctggctcaggaggacagcaggaggaccgacaagggagaaccaggaaacggaaacagcagtggtcgatacccaagccgggctggaaaggcagcgcatgagaggcgaaagaacaaggagcaatgaccgggcaagtggcaccaactagctgcaacagactgaccggatccacgccggcaaatcgcagcgccgtgagcacgggacagagaggcgaacacgccgaactctgcatcgacccgacatggtgacaactggagccaacgcatcgaccaatcgcgaagcaaagagtcccccgaactagagaccacacataccacacacattaccccagaacgagggctactggaacaccgcactccacaaatggacaatgcttgtgaccctcaaatccaccatccgcagagaaaagcgcatgcagaagacacaaaaaggacaaaggcacaaatgcgttagcagaaaggcacccagcctacatacagagcaccaacaaacacaacaagaacgagatcataaaaaaatagataaccaca

SEQ ID NO: 482379 - DNA, 1266 bp, Homo sapiens
ccttcactgatgcaataattccattggagatcgaggtgttggtggacgccgaccctgcttgtggacgtctctcagaatcgctaccgggccgccagttgccttcttcacctacgtgtcgctgagccacgagaggcaggtcgatgcctgattccccatcctgtctgcccgagattcgtagggacgagcagagaaaccgcgtctttgcagcgaaggcatataaggtgctggtatccctgactagtatgaatagtgctgtaagccgatcgagtgccacggcgtacgcctcagtccctagaactccctcctcctgtcaattggttgacttctcgcatgttagccgatggataacacgggccccaacgatgtcacaggttcaactttcatgaatttccccactcttggacacatacaacatccaaattgctaacattgagaagctggatgttgtcatgtgagtttatcagtagtctacaggtgattaaccttgatagcgtctcttccttgcaaataactacgacatccaaaatgcgtcttagtttaatattctattccaagttatctaatagctaatcacaagtagttttgttccacgacgacgcccgtgagaggcgcggtttaggagcattaaagccctccgggcaattgctttcctgagccatctgctagtaatggttattggggaacgaagcctcagcaccactgaataaaagcttgcgtgctttgtgctttggcatgatatttccaacatcaacaaaaaacctaactactaattttaaagcgtatcactaacgttgtaaaaattcggcgcggactaattgatgagaaagaacccgcgtgcgacgtcgccccataaataaggacaaagcacgcctttcttctctaaggaacaccaaagtgtgccccccactaagagtggacgagctcaattcattaataaacacctgaatagaaccgagagcaacctagcatgtatccaataaattggccagtaaagcaagtcaaacaaataatcgttatctgggataagaaaccctccgagtactagaccatagacctatgtttaacccccgaaggcaagagactatgataaggtagttgtgcccatacttaccacagaagaacttaaaaacagacctcaaagggctacaatgtataccaggtaatatggccaatacagtgggtattcaccacaaaatgtattataaagtttggcatttgagaaaattgtgtgactacgaccatgttatcgagaacaaattatcagag

SEQ ID NO: 482380 - DNA, 121 bp, Homo sapiens
agctcggtacccgtccaaacagagcccagctaatttttgtggaaagagatctagtatttgctgaatcataatcacatcagtactactttggctggcttaagtacaaatgaataaaaccagt

SEQ ID NO: 482381 - DNA, 157 bp, Homo sapiens
gatgcaatattaatgagcatctgctctctatcaggcttggggggatatgttcagctcttggtgagagtgaacatgatacataagatcctttctctcatgtagcattctctccattctttttttttttttttttttggaagggaacaacttcagcccc

SEQ ID NO: 482382 - DNA, 276 bp, Homo sapiens
ggccacagtctgctagtaagacaggtgtaggagcatggaagccacactggctcggattttcagacttatacattgagttaggagcgaagtctcgactgaggttttatttgtccaaagtcagggcctgctggagcccgacaggttgcgtgcttggcctgtggagcagctttctccagagccactctataccctctggcttgtgccgaggcccagcagggactgagggtagaataatgacaggcacaggtcctcccctcaaggagtccactatctggg

SEQ ID NO: 482383 - DNA, 912 bp, Homo sapiens
  misc_feature (764)..(764): n is a, c, g, or t
  misc_feature (777)..(777): n is a, c, g, or t
  misc_feature (780)..(780): n is a, c, g, or t
  misc_feature (782)..(782): n is a, c, g, or t
  misc_feature (790)..(790): n is a, c, g, or t
  misc_feature (795)..(795): n is a, c, g, or t
gtaatcgttgattattctcaaccaatcacaaagatatcggaaccctctatctactattcggagcctgagcgggaatagtgggtactgcactaagtattttaattcgagcagaattaggtcaaccaggtgcacttttaggagatgaccaaatttacaatgttatcgtaactgcccatgcttttgttataattttcttcatagtaataccaataataattggaggctttggaaactgacttgtcccactaataatcggagccccagatatagcattcccacgaataaataatataagtttttgactcctaccaccatcatttctccttctcctagcatcatcaatagtagaagcaggagcaggaacaggatgaacagtctacccacctctagccggaaatctagcccatgcaggagcatcagtagacctaacaattttctcccttcatttagctggagtgtcatctattttaggtgcaattaattttattaccactattatcaacatgaaacccccagccataacacagtatcaaactccactatttgtctgatccgtacttattacagccgtactgctcctattatcactaccagtgctagccgcaggcattactatactactaacagaccggaaactaaacacaatttcttgtgatcccgctggaggaggggacccaattctctaacagcatctgttctgattcttgggcaccagaagttatatcttatctcccaggattggattatttcctgtgttcttacantccggaaaaaagnacntncggttttnggatnggttgcgcccaatgtgtatgggttctaaggtatggatgagcccccatattccgtggttttgtgaacgcggttttattgcacgtaatatggaccacgggtggtttgggttggccacgg

SEQ ID NO: 482384 - DNA, 559 bp, Homo sapiens
agcggaggaggaagttgcggctggtttgaaagcggcagtttcctggcagcttgggcaggcgttggtctccggctacagctccgcagcggcacgatcgatcccgcgacgggtctacgcgcgcttctgcgcgcaccccaggattcccgtcccggtcttcccccttactcaccgcccccgctacttacccgccgctcgggcgctgagaccaggaccagccggaggcagtgaccccgcacgaagccccttctggaacctcctggggacaataccctttaccttaactgcagcctaacccgcggtggccctcgcggatccggtcagccccggggagcgcagccgggaggggcgtcaagggcgtctcgcgttctgggaacggcggggccccaaacgaactgtggtcgcagggtgagggccggaacgagaggccccactcaacggggctgagcgggccgaccaggacccccgggcctgaaaggggccggaacggggagccccggacgccgcgcgggattgccccatggtgcaggggggttcggatgtcaagacgcggacgaacaaa

SEQ ID NO: 482385 - DNA, 370 bp, Homo sapiens
tcctaacttcctgtctgctgtagctgttcctgcatgtaagaattaagatcaaagtgaggggagagagaaacccactagcataaacaatgcactagtgatcactagaactgtttaaacatttccacttgccagttttatttctatgaagactgttgcttgtgcggaatgtttcttgtcactgattttatggttgcatctggtaatatactaaaggcttcagtcccctcccaccaccagaaattaacaaaaagcattttaccttaaaatacaccagcataatgtactcagcttcaatcacaaatacgtctgcttcaaactgcagaaattacctcattactcagcctatatcactcagctggattttttcctt

SEQ ID NO: 482386 - DNA, 746 bp, Homo sapiens
  misc_feature (395)..(395): n is a, c, g, or t
  misc_feature (441)..(441): n is a, c, g, or t
tctttaaaatgaagctttaatacttagcttcccccttttgtccaagcagctcttaaggcaagaaaagttaatcccaaatttataaacccagtggaggctctacagattatacggagtttcacccccagtgtattaaatctggaggtaacagctatctgggaggctcagccttagcactgagtgggagggaaaatattaacgcccaagatgtaaatattcttcactattctggaaatatatatagtggggcaaacactatacacactcctgggactggcggggaatataaatattggaagaggggcacatggattcaagaatgtaaacacttctctaagatatctctactaaactgctcccagggtgtctctacaatattggtgtcaccacactgnggttggcacaacttcccatgatgtcacaccagtctatccactactncaaatgttttggataaagaagaaaaagatgagcacccaacagggacgcacgcctgtgctggtgctgtgaaggattggtgtcaacatcttggaaatgagcttgcggatcagttctggggcggaagtccaccgtgggcccctttcacgagggccaagctatcagagtcaaccaccattcttgccccaccctgttcaaataccctgtcgccggggttgatacctgtccccgtgacattgttgggaacccggggtccctccctccattgcgcctgagattttgccttcgggattccaaagctcggagca

SEQ ID NO: 482387 - DNA, 355 bp, Homo sapiens
  misc_feature (53)..(53): n is a, c, g, or t
  misc_feature (71)..(71): n is a, c, g, or t
  misc_feature (96)..(96): n is a, c, g, or t
  misc_feature (98)..(98): n is a, c, g, or t
  misc_feature (113)..(113): n is a, c, g, or t
  misc_feature (119)..(119): n is a, c, g, or t
  misc_feature (174)..(174): n is a, c, g, or t
  misc_feature (193)..(193): n is a, c, g, or t
  misc_feature (197)..(197): n is a, c, g, or t
  misc_feature (202)..(202): n is a, c, g, or t
  misc_feature (217)..(217): n is a, c, g, or t
  misc_feature (221)..(221): n is a, c, g, or t
  misc_feature (238)..(238): n is a, c, g, or t
  misc_feature (241)..(241): n is a, c, g, or t
  misc_feature (259)..(259): n is a, c, g, or t
  misc_feature (274)..(274): n is a, c, g, or t
  misc_feature (279)..(279): n is a, c, g, or t
  misc_feature (329)..(329): n is a, c, g, or t
  misc_feature (348)..(348): n is a, c, g, or t
ttacaagggggagggaaggggggcaaagtccttgaacattttttttggctcgngccatgttatgatcatancccttttaaataaggggaaatagtntntttaaagttaatgtntagccnagagtttagtaaacgaaaaattaaactgccctgttgatcggggctttgggtaaanacatctttaacatttgggngganagggnccctaaaaaggcccnttcnttgtaggaaagcaattntgnacatgagtttaagcattnttgttgcattgtttntgcanattttatttttgtttccaatattaaaatgtatgttagcaaaatggggggnttttcaaataaaatgcagnttcccca

SEQ ID NO: 482388 - DNA, 421 bp, Homo sapiens
  misc_feature (10)..(10): n is a, c, g, or t
cgaggcgtantaccaatagcctaggaagacaggcagaaatgcaggattcgcaatgtcagctggtaatacagcaacagaagtgcacagcgtgcagaggaggggcaaactgcagtaggtcaaggactgaatctggatctcttagaaaatcttgcactctacttctgagaaacattgtttcttggcaacacattctgctgccctaaaccccagggatccaagcccaaaacagaggcattgccagagcagcattccccatcagatagggattaacaaactcagtaaggtcattcctccttggttagagtgcagaggccgtgagagacaagtagagaaggtagccagtttctgggttaccaaagggtccaaagagcttcccaattctaatctatcattaacttcacaataattgggcccttatcga

SEQ ID NO: 482389 - DNA, 108 bp, Homo sapiens
cttaggacgtgaagacgacagaagggaaggccaggggtatgatcagctatggctcttcttacagtagaaaatccacaccacacggcatagtgcactgtaagctctcag

SEQ ID NO: 482390 - DNA, 216 bp, Homo sapiens
  misc_feature (106)..(106): n is a, c, g, or t
tctagacggatcccttcgtaatatgtaacaactatagctacttgtaaaaacgtactccacctaaagctaacatgattcatttttttttccaggaacagaaatgtcnggtctgtattaatatcaaagaattaactttaaaactgatcccaataagcatggcccttacacagttcatgaccaatatttagttatatgaaaatggttacatattacggg

SEQ ID NO: 482391 - DNA, 682 bp, Homo sapiens
ccatttattttcacccgcgggcgattgtgttggttctgctctatccaggcgtccgcggggggacagcagggtctcgctcggggtcctacaggttcgctcgcttaactgtcgtgtctggtcggccggcaacgtgttataatggcctttaaccttacggcactcgtctgcttgactctaacctgttaagggcctcttgggactctcacacgcgcctgatcctcccggacttttttcttaggcgacttagcttttacgctccgcaaactctacgccatctgctgaagattgataagttcgtatgaggggccaagggtttactacttgtcgctcgcactaacttagcctatggggtttcggccgctttcccgaaattctaacggtcgcactgaagttaggggtgggcccctcgctacgttcaatgctctcacgccggctttaggcagtaaccgccccccggcgcctatttgtgtctcgctactgaagtagtgcctcgactggctctctcgagttattatcttatcgctatcgcgcgcgactatatggggtttgttagagtgttgccatatgttggtcatgacacgctcgtggcttacgggctacctactttaaattcttctacgacgcgatgatgcaagatagtaatccaccgtctgccccgcctcactaacgcgaggatagaaca

SEQ ID NO: 482392 - DNA, 105 bp, Homo sapiens
gttgggaagaaaggtgttttcctaactcaaaaagttgatgagtcctctggtagcagaacctaaggaagatttaagacacattaattctgactaccataaaaaggt

SEQ ID NO: 482393 - DNA, 166 bp, Homo sapiens
gctgagaggagcgtggctgtctcctctctccgccatggcgtgtgctcggccactgaatatcggtgtactcccgaaaagggggagtcatcttcgcaaaaatcgtcaattctggctccctgtattcaaggcttctattcgaccagatcattgtaaaactttgttcaca

SEQ ID NO: 482394 - DNA, 567 bp, Homo sapiens
tgataggacgggctggagactatatttttagatcgatcaatagcacatgcctgggattatcatggccgtcttggacaaggccctaaaggttatatctggtctggaactgagagaattgttcgggttcatctggctcgtataggacttgccactaacggatataactggcctagaactgagcgagttgttcttaatgctctggctgcatcaggcttctcaacatacatgtagccttatcatatgacccagcctgatatcctgcatgcacaaacctgatattactcacccagacggacggcgctttaggatttgacccaggcttaaagactgggtgtaccatccaaattgtatttaccctgaggtactgtagtatatcctggatgatggaatctggatcgggcgtgccttataagctgactcttctctgagtggcataggcctctgatgcatgcttggttctggcatggtacctgattttctgggcctcacaactttttttgggaaagccctttgaccccagcttgctagttgcataataataaattttctgttcctaaaaaaaaaaaa

SEQ ID NO: 482395 - DNA, 118 bp, Homo sapiens
atttaagtatagtgcatgtagtgaatgcagatcaaaatgttctataacatatctgtacagatttttttctaagacgggagtcttgccatgttgtccaggctggtcttgaactctgggg

SEQ ID NO: 482396 - DNA, 131 bp, Homo sapiens
gctatctttatactagacatcgtactacacgacacgtactacgctgtagctcacttccactatgtcctatctaattaggagctgtatttgccatcatacgaggcttcattcactgatttcccctattctca

SEQ ID NO: 482397 - DNA, 459 bp, Homo sapiens
aaggccacgtggagctgtctgcctacgttcactctgtggtctgtgccttctccctccacaggggagactgtgcacggtgggccaggtggtttcagggagtggcaacccaggggcagtggaaatagcgtaggctttggagtcaaaaagacctgagtttgaatatggctccacatatccctgtgtgttgccttggaatgacttcgtctttctgagtttcacttattttataaaaggggaataatgtccactgtgaagtttgctgtcatgtttaaaaggaggtaatgtttggccaggcgtggtggctcacgcctataatcccagcactttgtgatcaccaggtcacaagttcgagaccagcccgaccaacatggcaaaacccctcccctactaaaaatataaaaattagctgggcgtggtagtgcacacctgtattcccagctattctggaggctgaggcag

SEQ ID NO: 482398 - DNA, 1752 bp, Homo sapiens
ggcgcagccgggagcgcgctcggaggcgacggggaactggatcgggtatgctggccaggcggagatgaggcttcggccgcattattacaagaggtccagctcgcgctgtatcacagggagcagcgagtacgcgtttcccgcaagccgataccatcggacaggatgtctccgcctcagcccaaaggagagatctctggaagtatggctacagaacatgttaatggaacatggtactgaatagcccatggatactacgttctgcggttgtccattcagaaaattttcagacattgcttgatgctggttataccacagaaagtggctgaaagaactagatgaactgttacgtggcagggctagtggcacactagggatcagatgaaagagctattgatgcttgcctacgagttcactgaccacggtgcatggcaggttcttcaacagctttaaagacagtggatctactctcatgtccagaatcatgatagtgccttttatgtggagtcctgaagacttacaggcgagagcaacaccacgggacgaaagtagcagattctagtaaagggaccaaatgacgtcaaaaatcaagcggatctgggcaagaacaggctacacactgcagtgaccactggacaggaagcagcaggtggacactccagatccggcgatcagtcgcagcctcgtcggccgaaatttggggagacccagacacttggggccactgtcacatgagacggccaaagatcgcaaaagggcaccgacaaaggttctgtcttgtcaaccagcgatgtaatacataccgctgccctcatttgtctatttcacgaggtagtacttgctgtccagacacacatagatacatgcacacacccccacatacaccaaccacaccacgatccaccaccacccacacccgcaacaccacacaacacgcacgacaacacacacactccaatgcagacccctcccacctcccagcagcccccacccccacccaacaaacgagaacagcaatgacctagaaactgcatggagaacgagccagctatacagctatatagagagaagaggaaaagaaacaaaagacaatgaccacatacgcaaactaaaaaaacagacaatcgtcagacgagctacttcaagtgcggcaactaataacggactgaccaggcagcataacacaactacggcgaacaaacaacgaagatacaacggctgataatcacacgatagtcaagaagataggtacgtacacggacgtagacagacccgctggcagaaacagagagcgacgagactagagtgaataagatctgcgagggaacaacagatgaagacaaacagacatgacaacaggagcaagatcaagaaaggacagagcaccgcagcgggaagctcaggcgataaacaccataacagagagtagatgctaaggctctcgagaacattacgcaagtgatttacttctggcgtggcactagctcgagcgtagactgatgactactatcagtatcgatgaagacgaagcatatagatagtaaagcagaacatagttggagtgaacgattcgcgatagcatagctacagcactcaaaatatgctaccgttcagcgcgagagctaaatgtatatgaactgatagtgagtgcattgacgaagaaagtcaagtttcaaacaggatgaagcaagaaaaaaagagtatggaagtgaaaagaagatatgatagggataaacgagatagacacggacacag

SEQ ID NO: 482399 - DNA, 519 bp, Homo sapiens
gatacactgagagacgatgatataaccaggagaagaattgtgactgtcatgaatatctcaactgcagaatcactgattccacctggccagagaaacactgacagtgtagtaccttaccagtcaaataatctccagttcgtaagacgagatgcatcgctggttcaatttccaaaagtaaataaaggctcatcgtaacgtgaaaacattttgcatcccgtagctctctaaaggtagattaaaaagaaaattacaaagagaatgacctctaaggcttctgaacagcccacgtgtaggttacataaagtactttctgtcccaacactctctctaattcaaaagatatatacttcctaagtacacgacaaagtcttcatttcaaaccattcactcagtttccatggtaacattgcgggcttccttggctaccataagtcgcattagttgactgtggaatttctcaatcttctttacatcttgagcttggtctgttttatacaccaaacaaactaaatcatctgt

SEQ ID NO: 482400 - DNA, 150 bp, Homo sapiens
acagagtttcagtttgtggtgataaaaaatgcatgtaagccgggtgtgtgtgtcacgcctgtaatgccagcattttgggagccaaggtggccggatcatttgaggttgggagtttgagaccagcctggccaacatggtgaaaccctgtct

SEQ ID NO: 482401 - DNA, 1222 bp, Homo sapiens
ggatgcgttgttggtcgtgtccgtgtttcggctgccttcgctgtcctgtctttattcgcttttctccatgtatttttttcctatcactcggctctcccaaggggttctctctgttactggctttccctctacagttgcctctagagcatcaccgtggcccccattgtgaatgtctcgcgtcaaataatttaatacggcatcattccaccatcttcttccactaccactttctctgctaaaggggttgatattccgggtacttgcacagtacgggattcgtctgtgtgcacttgcgtctcatctacgcatccttgggtcttgtccatcatttgtgaatgtctctattctcttgcttccatgtgctcgacccccatgtgccctacgatcgtcctgcacttacgggcacgggaatcatttaccaggatcaccaatgttgaccaactgatcgatgtgccccatggggtactaggatgaactattgtgtcgtgctacaaggccccgctactgcgtggcattggtactagacaggtctcaacacgtggatcccatggggatgtcgaagtcagtacgtgaccgttgggtcttggatcacttgttgactcagcttagcaatcatggttggtagccacccgaatatactctgtaactcatccctgaatgtccctcgataattacctgtttagaccatggccggaaggctttcttgatactgtgtatgagacatatgcacaaacgtaccaagggcctgagattctctcgtgaacagtctgtgtgaacgctgctatgtaccctagcatagtgttaaactagtatagcctcggcaccttacgatcgcactgagccacattagtaacatgtgctctatctgctgttgagcatacgctgacaacatcagaatcttgggagtggtgagacatctgcaccagaagacagtcagcaagtgtgctggcctctctgacactatgctaacccccatatactgctgaatttcggagtctgactgtgcccaagtgggtcacaagtcgcgctgctgacatcgtacgtatggctccacacctccaatgctgcactgggaagccagggtgagagtctgggtccaggccatggccatgtggccctccagtgcatgagagggtcctgcctgactgcagtcttattactagttgccgccatccaccgacagcttcccttactcccctatcccattctccctctcaagcca

SEQ ID NO: 482402 - DNA, 682 bp, Homo sapiens
cagctcgctactaagcccgctcgtaagagcgctctggctaccgacggtgtcaagaagcctcaacggtacaaggcacggaacagtgtctctgcgagagatccgccgctaccagtagtgcactgagctgctgatccgtaaactgcccttccagcgtctggtccgagaaatcgctcagaatttcaagacggatctgcgcttccagagctccgccgtcatggctcttcaggagtccagcgaggcttatctggtcggtctgttcgaggacaccaacctgtgcgccatccacgccaagagggtcaccatcatgcccaaagacatccagctggcacgccgcatccgcggagagcgcgcttaacttattcgttaacttgatttaaacacaaaggctctattcagacgcacctcagtcatcaaaaaagtgcaatttcttacattttcaggtttattatcccctatattcgttatcaagatgtatattatattaaatggtataactttttgtgagctgtagtgaccgagtacgggtttacaggtagtatcaagtaaaagtattaatacactttaaccactgattgtatgaaaacaaaactagtggtattaaaaatattttgtcggaaggctgtagggttgcttttaaatatttgtcaatataactgccataacatcaaattaaaaaaaaaaa

SEQ ID NO: 482403 - DNA, 334 bp, Homo sapiens
tacagcccataactcctgcacccaacccatcctccaacctcagcctccacgagatagactaggatatacaggcgcacaccatcaatgcctgaataatataaatgtatttttagtagagatggggagggggtgggtgggtggtgtgtgcttcaccatgttggccagagtgatttcgacctgacctcaggtgatctgcccaactaggcctcccaaagtgctgggattacaggtgtgtgccaccacacccagctgcacccaattgttagcatctaattttaatctaatctcaaaaatggtcttttaataggtgatttttgccttttaattggaggtt

SEQ ID NO: 482404 - DNA, 303 bp, Homo sapiens
gatcgagccggtccctagtttagaagttcaatagcatgacgatcggtgccttaaagacatgctcctgctgcagttgaactagcccaagctattcctttaattcagcccatcccttcatttcccataaggaatacttttagttaatttaatatctatagaagcaatcctaatgactggttggctgttcataaatatgtgggtaaatctccattcagggctcttagctctgcaggctgtgagacccctgatttcccaattcacacctctatatttctgtgtgtgtgtgctattgaaacttctaaa

SEQ ID NO: 482405 - DNA, 1189 bp, Homo sapiens
  misc_feature (45)..(45): n is a, c, g, or t
  misc_feature (613)..(613): n is a, c, g, or t
  misc_feature (616)..(616): n is a, c, g, or t
cagctagacatgatacgatcgagctcgtactcagagctgttggantgcaaaaagttaactctccttccccacgccagccccatcttgaaccactcagcatggagttaggggaagagaactgatatttagtgagcatcattttatgaaacactttgcctttataatgtcatttaatcactgcaacaactcttgaggtaggtattcattatccttgtttttccaaaaaatgaaactaagactcagggagtttgtgtcctacacatgctctgatatttttattgttgatttgattgttttgtttactgtatccccacaccatattgtaagcttttaaaggatagagatcttgtcactgcttgatcctccatgcatagaatagtttctggcgtatagtagaaaccgggtatctgtttgtggaatgtgtagagtggcagagctgggatttaccctgagtacctctagttacagactctactttctttcacattatgctgtctccttggcattctagaacaggaaatcggcagctattttctcctttctcactagttcctgtttctctggacaattacctggacccaaaaccttaaaagatgtgtccagattttcttgntgnaacccacttgcctcttacctctttaaacccttccatgttcatgctggctgaccttctcttattatgaggaattatcttaaaaattaaaatgctgggagcaacctccttctattcccattctgaaaaagataagtaggacaatatcagcagcacgtgagccactgagccagctatcatgtagaatgataattctgtctttttgtttggttggttagtggtggtgtgtggtggttttttgagacagagtctccttttatcccccaagctggagtgcggtggcacgatttcatctcactggaaactctgctccctggttcaagtgattctcctgggctcagctcccgagtagctaggattaaggacctggcaacagggctggtaatttgtttttagtagagatgagattcccatgttgtcagctggtctcaaatcctgggcccaaatattgggcgctcagagccccaaggtggattcggggtgagcccagccactcgaaaatgtgtatataaatgggtggggcccccaaattggggtgggtgcagatccccaaaggtcggagagcgagggctctta

SEQ ID NO: 482406 - DNA, 1225 bp, Homo sapiens
  misc_feature (328)..(328): n is a, c, g, or t
  misc_feature (489)..(489): n is a, c, g, or t
  misc_feature (563)..(563): n is a, c, g, or t
  misc_feature (667)..(667): n is a, c, g, or t
agcggatgtgacgcggaactacgccattaacattagtcaatgaagtgtgtgtcctttacgacaaacgtgtctgccaggtgtctggctagatacgattcgtcggactagcatgccaggacatccggttgagcgttgttgcatcacaaggtagtacagcagaaattatcgtgcgttatccgtgtatagtggtcgcacacactgttgtaggtggattgggctcaacagtcacactgtacactcgcgagtctgaaggcgcaggttgtagggtgttggctggcatgatctgactggatatacagtcggagtaactgaccctgagatatcacancacaagacaagacttctctggctagaggggtgggcccagagatgcatgggacttgtcggacggtggtccagaacggacataagccaaatgctaccgtctgacttcggtgtcagcgcaaactggggtaccattctatacataaataggattggcgcagggcnatcgagtgattaaattctaggtatgtgatctgccctatcgaacaggaaggatactacgaacttctccgtcttantctttggttcataacggctagctgcggaactatcgagaacttgcacgggcaaactgctctgtcgggggcactgaacttgaatcgattgctgctcagtcgaaacnggggaagccgcaaacacagtccccacggcaatggacggggcccgctaggggtggtctacttccgaagaggcattgaattttggtggacgaaagcggtgttacaaaccaacttcctagccggtctattggcgcccggcaagttttctgaataaccgggtaaggcggttaattccggggtaacagacgagttcaccgtgaggctcttgagttgagtgtgtggggcaagactattgcccacggggattaacgaacggcgtaaaggggaatacttggggcaaggggctgtccttacaaaaaccactgcccttctatggcctttggttagctcacacgaacgtttgcccgaagggcttagggccaaacacacacaaaggtttcccacactttgggtgggccctataggcacaaaggaaacctcgaggggcagcacacacaagcattttgtgcgaggagcgacacactcatatcactcacacacacatcgtgaggcgggcgcggcgcgcggcgcgctcagcagatcaatatctatcacacaactacacacgcagtttctctggg

SEQ ID NO: 482407 - DNA, 872 bp, Homo sapiens
aagaggtgacccgcgaaagataataaatcatcattgtgatcaagatgtcttcggcacctgagcctccacacattcacaaaaggaaccaccacaaagaaaaagagtttcaaagcaccagggctcagaggggtgcgcagaacaaccttattgtacgtgctgtgaatccagaagctcttcattaaagcctaaaaaagctgtaatggcttatcggattggtaactgtttcactttgcgtggatatattggttatcatacaatgcaatacaagagaataaaaaggacctcatatgaagctattgatagtgaggggcacagattatatgaaggcggaaaagaatccaaatgggattagacagtgctggttcagtgcagatggaactttattaaggttctgaagatcttccaaatgacagacccttgtgagtgtgaccagaatacattgttgaacttgttgctagaagatgctaaatgaagagagaagatagcaggtgcaaagcagaagaactgtcgaaacattttgtgctttccacaaggttggagacgagctatcatcattacttttgtaccaaacaggaagtgagacgtcaatcaaaattagggaccgacaccttaacctcttaatacaaaagtgcctggcgcaatgggcagtgtacgtcggtcaatcatctcacacgccgtataacaacgaggaacccatgctggcaaatcagcaatgaacgctcgacacactcaagacgactctgcagtcgaactggcagcaccagtacaggggttgcaacagcgcaggcaacgcacattcactccggaacacaccatgaggaagaaccaacaagaacaagccgagccaacacagccacaacaccaaacaccag

SEQ ID NO: 482408 - DNA, 383 bp, Homo sapiens
caaagccgtcaaaatacgacggttttgtcaattatttcgttacattgaatgactgttcaacaatgatggccatatggcatcattcaaatcaaaaagtatgcaagagggtgaggcacacaacacaatccgcagcgcatcaagagcctggcgccttaccggtgttccggcctttccgtccaagctcctgaggcctgcacgccaccgtcaaggagcattccatgcagttacggaatatgtagatcggcattcgcgctgccagcgtattcgccctgttgggcatcctggtcctgttcatgggccttatcgcactctacgaagcccgccagatggacacggctaccgacgagatccgggtcacctggatgcccgccgtggtggcgttg

SEQ ID NO: 482409 - DNA, 883 bp, Homo sapiens
agcggtttctcgtcgggcggtcgccgtccctcgcggccagtcgtactcggcgcacccagactcgcggctagccgacatcattctaggaggacaggaggagaggcgaaggctcccccatcccctatgatcgcgtccgcagctctcttctaagctaaacggccttcgcgccctcacgtctcacgttacctcgaccagctaaggccgacaggattcgtcagtctaccatgtttccacgtgctctatagaggcgaataacgaacaatcacgcagctcagtaatggacgacatgcgttccaccagaagaagagtgtcgtaagcgcaactaggcagtcgtcagcgtttatatatactccaggaagacagcgctgcgctactgttgggactttgcaaagcctcgcccagatcaatgttcacccgagaaattcgagtgaataacacaggtttgagatgttcaacatctgataggtggtcaggtgaaggtcaggtctagcgaaagatcgtagctcgtcagtgaaacagacctcattgccgtgacactcgatctgtcacccaggagaagagtcataccgtggagcagcgaggagaaagaatcggagaagtaactgtaccagaattagaggcttcaaagctgtcggaaattgaacgtagcgaggaggtcagagctacgtcctgactagtcggtagatacccctgggctatggtgacgctatcgaactgcgagcagattgtggtgaagacaattatctcctatattgatgagcaaatttgagaggtacctgcatgacgagagcgctttgaacaggcaggcacatcattgataactagggtgcattgtggcttaacttaatttcacgctttggacctggccttaagccttagatgt

SEQ ID NO: 482410 - DNA, 193 bp, Homo sapiens
cggcaggggtctgtagctactgcccacagtcgggagaggagaaggactctggtagtttctctgggcagacgagctcggctgtcccaggctgcctgagcgtgagccagactccaacagaggctgtgtgtgcgtccggggaccctggacactgctctctcccgacgggaaactccccactgaagtgctgtcagca

SEQ ID NO: 482411 - DNA, 211 bp, Homo sapiens
cggctccacggcacccccttctcagtacaacagccaagaactgggaactcacagcatcacgcctcccaccagccgccaagtgtgtatccacagggcctacagcagtacaccactgttggctatctccacgctccactagtctctgactgctgtgggcgtgagctgctgatgtcgtctcctggtcatgtcctacctcaaggtcgaagctcac

SEQ ID NO: 482412 - DNA, 297 bp, Homo sapiens
gagactgaggccgatgagttgcgcctcctccactggattgtgagggccagagatgaactccctcattttccggtccccagcattggcaggttctgggactggtggctgtggtggctcgttggtctttgtctcttagaaggtggggaataatcatcatcttgaaaaatcggatggttgccgtgtctgtgtagaaagaagtagacatgggagacttttcattttgttctgcactaagaaaaattcctctgccttgggatcctgttgatctgtgaccttacccccaaccctgtgctctct

SEQ ID NO: 482413 - DNA, 414 bp, Homo sapiens
acaatgtgtcactcagcgatatgagatgtatgtaatagaagcatctgagcagaagagtggaatcagaaacacatttacagacgttgatatatgaagatgaccaacattttgcaaacacaagattggacactactagcgcaactgctctctgcacaggattcaaacttcgatgtgacaaattccgttcctgaagactataagtctagcacagtatctaatcaatcagacactacattatagcacgagatagctcaaaacctcagggtataacacattttgaccctttgaacagttggagtgaactgacatctccacttaattcctcagcgagcatcaacatagatagttatacctctgaagatagttcgcctacaggcgagtggactattctggcactgggaactcagcattact

SEQ ID NO: 482414 - DNA, 201 bp, Homo sapiens
catacgcctcatttctataaagcaaatgtaatatcctttatcttgacacgcggagaattcagatagacccgaaggcgagtctagtaggacgtggcctatcaggttgactaccaggaaataggtaggcatgcaacatgaattatttatgatgatagcaagacatgaacatgttccagagtactcacaacttcttgtaggtgc

SEQ ID NO: 482415 - DNA, 224 bp, Homo sapiens
tgctgagacatgtgcggctgacgccggcgcagacgacacgtggactgtctggcagaaaatgggcacaatgtgtgggccctgagacctgctgtgggccagtgtctggagctacagcgcagtgcagtgacatcccacgcgcgccgaaaccctcgcgctggtgccctaccgcctcgctggatcgaagccaccacagcgcacgcaacctgggacatgcctcgtgccag

SEQ ID NO: 482416 - DNA, 619 bp, Homo sapiens
aggcgcagtaaggacttggactcctaggtccagcttttaacaatctacgttactccctctgatcggtcacactagattcagatctgctctccagcatcttctgtttcctgtgaagtgtttcctgcttctgtggataggacacgatgtgctggagctgccttgtgacatgggtcttagggcttgtgtgtcagaggatctcccgcctggcagtggaagagaatgaactggacgatatcacgacctttgtcaaggccttcagaccagaattgaaagaggaattttctaagctccagaacaggaccaagctgactgtccttgaaggagacattctgcatgagccattccttgaaagagcctgccatgacgtcttggaagatatccacaccgactgtcttaatgatgagtttggaggcactcacagagagtccattttggatggcaatgttataggcacccaattactgggaaggggcccttgaccaacccaagtgccaacctatatctacaaccggaggattaaggggttcgggcccaacttctaaaaggaaaattatccagaacggcccccaatgagagggcccgggggaacaccatgggccctacatacccccccttaaaa

SEQ ID NO: 482417 - DNA, 815 bp, Homo sapiens
tataaaaaattaagcctttatttccttgttttggcaaataaaatgggctaagtgggttgcttttgggtgattcagtcaaaaaaaccaaatcccatatcctgcgtccgaatcctcgcgattcttccttgtggttttacaaccttagctttggggctgcagccatcagccaggaagccagttgttgtttgttggcagatatcccacaggggtcagcaacccacacaaggcagaatggaatcagccaagaaaaggccattgaccttttttacagcaaagtgtgtggacaggttgattaactcgcgtcctccaccaaacagagggccaggatcctcgctttgtgtccccgttagatggatcagacatggggtgtatcttgattggcaacctgttgggtgtaccgccacatcctggcaagacagacttctgggcaaactattcgcggaaacaccccaggagattatacaatgtggtgcccctggaagatttcaacggggtagatcacctaaacgccttggaacaaaaggacggtctttctcgggcccagaaaccagcgtgtacgtgggcgtggcacagatgatcttcacagtggggcaatttggcccccatgcacagggcaaggccagtttggcccctttattgggccagacaacattgtccctgaatctacaagggaaggacctcctttgttgaaccccaaaggcccatttttcccccggatatgagcgacaagtttctccaaagctggtattgtttcccaggcgcctcgagattgcctgcaccatataggtgttcttgccattaaacccagtatccca

SEQ ID NO: 482418 - DNA, 722 bp, Homo sapiens
gagcgggccggccttcgtgtgcagtctgtcactcgctgttggctaccagctccccgctgccctgagctcggctgggctggcattcggcccggcggaaaagccgggagcagtgtctgcgagtgctaagtgtctccgcggcgcacctcgcggcgagaatccggaggagaacggatgactgcaaggataggcccagaaaaacaaccagaaaaaacaaaatctcatcatggcaaatatacaccacggaaaacgaaggagatggagcacgcctatgcagaatggagaggacagaacacgccctatcgaggacggagggtgaaggccacaagacctgccagggcaaatcgagcggcggaccaggctacgaccgaacatgagcccctacatacaaccgaccgggccaaaacccaacaaggcacgactcacagcgaccgcggatcgggctggagcatgcacgaactgcactcatggtgcacaatatcccactcgcgaccgcagacattggagcagttgaagtttccagaacggcgagcaaacctttaagtgtaagactctggacaagtatgcacggccaattctgcccgcggacggaaattccctttcaatgcgtgtggggaaacactcctcactaattcgacccatgtgcacccaatccatgtagtgcaaatcattgggagctctattgcccgtggggaatccttgccgacatacatttccctgacgca

SEQ ID NO: 482419 - DNA, 290 bp, Homo sapiens
tcctgtcggtcttcggcaagcctgaatgacggcccagctccggccattccagggactcctaggtgcctcgggggtcatgaatggtgtcagccaacaggcatccctgggcaggttgaggaactgaaaccgaggcagaaggcaaatccggccgacctcattactgaacggcaactgtgcggccttcacagttctgcgcctgagacgtgctggtggccgaaaggcctcgcgcacctttgagcaggaccctacggcttcggggcgcgtatggagtggcctgctttcagaggtcc

SEQ ID NO: 482420 - DNA, 320 bp, Homo sapiens
tcgtcgaagaacaacggcaggctcatgtccacctactgatcatcgttggcaggtggggacacggaaggccatgccattgagcttcccgttcagctcaggtggataccttgcccagcgccttgtgccgctgcctagtcgaggcagcggcatcatgttcttgcgtcagccccgtcggccgtcacgccacagtttccctggaggggccctcccacagtccttctgggtggcactcgactggaattggacctgtcgcgtctatcagctccttccacgtataccaatagttgtccctggatgcccgctttttctctcgcacgaaa

SEQ ID NO: 482421 - DNA, 449 bp, Homo sapiens
cagactagcattgctaccagtgatctggaccagcgcactgaatgaacctcatgtcccttctggaggtggaaaagtttgggtaagaataaatgacaaattgagaaaaggagaaataacagctgagagtaaagaaatgaatagatgggttacattaacaccttaaaataggctcagagccggagatgacattgtctcttagctcaattacacaatgcctgaaagagtgaagctctatgtttgccaagaccactcctgcttttggaacttaacaagattaaaaggaaacctgggccaggtgcagtgactcacacctgtaatcccagcatttgggtagctgaggcaggaagatcgcttgaggccaggagtttgagtccacgcggccaataagcaagactacatttctattaaaaaaaaaaagttaaaataataaaaaagaaaaagaaacctgc

SEQ ID NO: 482422 - DNA, 1599 bp, Homo sapiens
  misc_feature (516)..(516): n is a, c, g, or t
  misc_feature (566)..(566): n is a, c, g, or t
gtgcgaacgtgggagagcacggccttgaaggcttcgggaacgcatacgatagtacacggtagaggtgtccgatgacctgtctaccatccacagatgccgacaacgctcagcctccttcatcacactggcatgctgcattcttatgcagacctcacatctatgtcagtacgccaaagtcccgcgttcatggtcacttcgtaatctctagtaaaaagtaagatgacagacagtctatccagtggggcacggattggtcttaacttgctgtgcgtcaagtgctaggtggttggaaggacaagttcacacacctcctagacagggtgatggacacgcatagcattttccggggactaccttgggcgtaggccgcgttaatggacctacacacgagaatgcctgcgataactcgcaaacgaaccaaactgcttaacgccgcgagtacaattatccctgagcgtaactcctagaccactatcaccgtcaaggtgaccgcttgggttctaccctctatgatgnccttactccgcaagaccatttggtgctagcacaacgagcaaaccgcagangacccctgattgccactctaaccttccccattgtccaagactactagtagacaacgtgttggggcacgggtaaagaattcatgcgagtggcccaatgctacacggatggacctgacgcggcgcagggagactgtgtcccaagagcaaacgctctcctaacgaggacctctcgagacgaatcaagagcgttacccttagcgtaggcctcacgatccgcggaggtgccctttggcaagcccaggttcgagataacaagaaggcgcaaagcgggctttccatctcagagcccaacattgaatgtgctctccaatcaagccccttggtctttacttaacggaggtagggcaatggtggagtcccttacggttacacggggagggttggttggcccccccaacataaattaaaaatcctttctaagggaaaagcggacacccccagggggttggatagaacacggcaatatacacttcccaccccatatggacaaaccttccattaatccacgaaacaccaacttaaatttcctacagttgacgacccccaagaaggaaaagcccgcttaaacactatgatcgtggaaacacccttccccacatagggggagcgtctctacatcgaacaagttttccggagaagcagaggcagcactaagcccacactcatggaattattgcccggacgagaggggaggcccaaacattcaaataacaggagcgttcccctaatggtaaatatagagcgtgtccgtgaagcgaggatgaccgcactaaggacaagcgcacgggctcacttctggaaggcaggaacacccgcgtacgcccgggtgggagacacctccgaggagagggtgccagcccccgttaacaaaacgcagtgtgaggagggcagcaacatactagcggaggcgaaacaagcacacacaaacccgcagcaactgacaagccaccgagcggggggcgtgacaaacacaaaccaccccgaagtagcgcgaccaggagggtgagaaagaacaaccagaacatgggcggcg

SEQ ID NO: 482423 - DNA, 391 bp, Homo sapiens
cgtggggcctggatgcgtggggcacctggatggtcatgttgaaatatagaaatagaaggaatgggagaagatatttagtactgactatgggtaggagatggataaaggtctcttctgattgctttagttgtctcagtaaaataggaaacaagattagctgagggtgaggatgggaaagatgctggaggttagaagacagggaaaaaggcacctgcagagtggaaagtgaatggactagggaaacacagtaggactgccacacagtactaaagacccactggaggttggtggtcatgaatttaaagcaagaccactcagcatggttgtgtgatcttctgtagccaagttcagctgcacgaataaaagctcaaagtagacagagaacacaatt

SEQ ID NO: 482424 - DNA, 419 bp, Homo sapiens
tcttctcccctgacatctggaatacaacaaatatgcctagcatttaccactgttattctgccatactatggaaatactagcgagagcaatcacgtgaagagagaaagaaataaagggcatccagagtaggaaatgaagaagacaaactctcctttattgcagatggtatgatcttatatttggaaaaatctaaagattccacaccacaaaaactattagaactgataaacaaaaataagatctgttattagcaagaacgtggaactcgaggtcatcatgctaaatgaaataagccaggcacagaaagaaaaccattgcatgttctcacttattggtgggattagaaaatcaaaacaatggaatccatgaagatggagagtagaaggatggttgtcaggagagaagagggtaccgaggct

SEQ ID NO: 482425 - DNA, 169 bp, Homo sapiens
ccaaatggaatccccaaatggaatccctacgagttgatcgttgaaggcttttcggcagactatgtctggggtggcatggagccgggtttcgtattattgggtaaagcgttattgtctgtttcagactcaggcgtcatcgcagtgagggtgctcagctttctgatttttg

SEQ ID NO: 482426 - DNA, 247 bp, Homo sapiens
tttttttttttgacttaacagaattaagggttctgcacacttttagtctaagggaagccagcacaaaattgcaaaggagagacacatctgcacagctctgggcacattcccaagagagggcatccaaagcgcaagtctgagagcacttgtgaggtctacagtgctggtgatatgtctatgtgcacgcacaggttcctaaacacagtggcacgtgtcacaggaacacttaaggagcaggcgctctctc

SEQ ID NO: 482427 - DNA, 1101 bp, Homo sapiens
agcggagtcgtcgccgcagcggcgatgggagcggtggggacgaggcggcgtgcggcggcaggagggggagcaggtgctggcacaagagcagcggcttgtggggagcctggcagcatgcagtaacagcatgcagcagccgccgccgcctgccgccagtaaacgcggactggtaccccaggggactacccagcctggccgtgcctggaagccgcgctcgggtcccgccgcagtcggcggtgggggatgggcaggcagttggctggtcccgcctgccgagggttaaccgcccgtctgggtcccggtcctgagctgggaccaggagcccctccgtccagaaaaccccactgctgtccggccacgggcacagggttaaattgtgaaaggcaacccccttggggaacttggattgcctggtgtagcttgtttctaccattatcagtgtatctgcgaatgacagtgggcggggaggcagagcaaggccggatattcctggaagtggttgggaaatcccttaagtgaaacggcaacacggatggggaacagtgttgcggagaacaagcggatttgggagagagactggggcggcggaccttattgggcgaacgagaagacatttttaacgtgaagtggcacctttgtgtcaagaattgagagttcaaacagtagatgtgaaacacaatgggtttgcgccacttgggaaccaggtttgtggaacaattacagtcgtttcgaacgtccaacgcgatcataatgatagttttcattggaaaacacttgtgggaccagaattgggatatggttgtcatgcgaagaaaaaacttgagcttgcgaaagaggggggcacatagttacccgcaagtggattagccgtccgacgacccatcctcaatcttggggcacttagtatgggagcaaacgccaaactccaacgctccgcactttcgccacagtcacgatgtcgggcgctccccttggcgaacacatgtcaccaggctgcttcggatgacacatcctgggggcgccaaaacactttccgccccggaatcaccccgcgatctcaccggcacggcaaccaattgcgcccaatcgcgcagccacccc

SEQ ID NO: 482428 - DNA, 272 bp, Homo sapiens
acggcttctgtgcttgtggctatcgcaactctctgttgccttcatgggcctgtgacgtcgccctcgcctgcagaggacaggcccaggctctcccccgtgagtacccagagtatgcggtggtcctcttaggacaaatccctctaccagccacgccctctgcaccaggcctgtcactggtgctgatgtccggttgtgacctagtgaggaagggggttcttgacagccctccctgtggctcatgcacaccctgcctgcgaactccccccgacact

SEQ ID NO: 482429 - DNA, 1751 bp, Homo sapiens
  misc_feature (318)..(318): n is a, c, g, or t
ccatacgtacaactatcacactcctgatgccaactacctgaagtctagactaagtctttaatagaactagcttacataagtagacattattaccgtcttaaacggatacctcctatttcagtgactcccttataatggactactgcttgaaagccccacgatcgaagggtccaatcagttaggtgtgccagcagtactcgtctggaaagctagtgctgggatatgtagatcaatactagtcgcttcataactacagtcctcaacacctccactgaactcacagagacaccactgaagcacataaccaccattacgctncgtataccactattcccctagtgtaggacaataaactatatgtacgcgacagtaaatctcatacatgacacgtactcgcacatacagcacgataccgtaacacaatgcaggcatcactatagacattacgctctctcattcaaggtacatagccctcacttcattaaagtcccacgtccgcatacagtaagagcacgctccaatatgctacagtacgcacacagtctcctccatgtacacgacattcaccccgggaccggcacgttttcattcgcgtcagtaagtcgttcccagcaggtaactttcggcactacccgtgcagtttatactagttccctgactctaagggtaattaacgtgcacacatacgtacacggaaacgtcggaccagacttccaccgggaatccggcagtttacatacagttctcgttcatttctcccatggcgtgacgctttctcacataacacattgcgtaacctttcccacaacatttaacatacacgcctctcctcacgtgaatatgaacgtgttcgttgatgcgataagcactttccgtctagaccacctgcccgtgctgtttaaaacacctgcgggaactttatatcaagccctaaacttggatggaagacacttcattctgggtgagcgtaaacgttcatactccggagggtgtacatgctcatgcaatacgataattatccttagattctcacgataataggtttaacatgtgtacccttacaatgtcaataagcgtaaaggtttcagaacagagtcccgtaaagtatcatccggatccgtaaaatatagttttcactccatcacaaataatctaaatgcggggcctccacatacaacgcggggcccacaatattaagccacagcaataaatataacccctctactattcacagcaggacggcaaatatcagacccggttaatagtgtacacaatccgtacctgagttccaccaaaactgaatgttcccagaatagattgcaaaagccacaggaagcattaataacccggggggggttatcccacccgggaggggagaaacaccatctagagagacgaagcaacgaagacagcgaagacacagccagcaaaacaaacaacagacacaaaacaaacagggcgcggctcgcaataaaggactgccccactaacgaacacacgcacgaggagacacaacaaaaagctgaactcaacgccggccaccaccgcagccaacaagacgaacaagtacggactgacagccaacagaaagaaagaagagacagagttgaggacccaaaggaagcgatctgagacaccgaaccaacaccaccaccagaatgaataggagtcggttcagcagcagacagacgagcaaacacacacaaacaaccccgcctaggaagtaagaaaacagcagcagacgagacgac

SEQ ID NO: 482430 - DNA, 101 bp, Homo sapiens
attcatttctgccccttcccttctccttctccttcaggaagcagaaagcgggaatcaggaaagcttaaaattaaacctaccagagaggagaggagagggag

SEQ ID NO: 482431 - DNA, 135 bp, Homo sapiens
acggcctgcgggcggagagtcgctacctacgtgcgtcttaggcaatcgagactggactggctcgcttgctgagccggtctgagcggcgtggtgactgcgtgctgcaccactctcgctcttctaggatgacctcgt

SEQ ID NO: 482432 - DNA, 360 bp, Homo sapiens
ggacccgaccagtttcaggttgtcggtgtatacagaagtcgctaccagctccaggccacgcaagctgatttccccgatctggctagagacgatgttctgggagacagaaacgttttgctggagcagatcaaacacaccagcggtcagcagggttttgatacctaccggatgatacttcacgcccacttcagtttgtttaccttgggtcggtttgaacgactcggtggcactggcactggcgccagccgttggctggaacgactcggtgtaggagatgtacggggtaatgcccgaatcaaacacgtagctcaggccagcgttaccgctgaaggctttatcgcgcgggtgttgggtcgacgc

SEQ ID NO: 482433 - DNA, 642 bp, Homo sapiens
ccccccccaaaatcataaaaatgttttttggggttaaaaaaaatcacggttgggggaacctttaaccaataggtccccaagaaatgcccctgggggctttcattagaaaaaacagactcttgtttgtttttttccaggggctttgtttggggataataaagggttgggaaatgggggaaatttgttccgggaaagggcattagccggggaaccccgtttgtttttagagtccgggccattcgggggggcttaccccccctggggggggttttggggctgaaaacccctaaaaatgcctgttttccttggggtaagggtttgtaattttgccccttttgtaaagcctttaaagcaaaagttttttgagggattttttttttaaaaaacaccataccctttatgggcctaaaaggggccccctgggttttggtgaattgtttttgcgccctcccttgatgatgaaggaggccccaataatggtgccccccaaacccaaatgtgggcccggggcacccccccagttttttttatttttggggaagggctttgggaaataaacctccagtgttgggaagagggttacacaaccccaggtgtcccccttgaggggaaacgttctcatttggggccgaaagggaattt

SEQ ID NO: 482434 - DNA, 333 bp, Homo sapiens
  misc_feature (2)..(2): n is a, c, g, or t
  misc_feature (15)..(15): n is a, c, g, or t
  misc_feature (74)..(74): n is a, c, g, or t
  misc_feature (115)..(115): n is a, c, g, or t
  misc_feature (239)..(239): n is a, c, g, or t
  misc_feature (296)..(296): n is a, c, g, or t
gnattcggacgaggnagagccatgtcaattttagtaaaagcatacaatgacaatcatttatcttgtggcttgtnattagtggtaactgactgatttaagaagagaaaggccagtnttgttgtaggaagaataatttagtaataaccgactgatttaagaagagaaaggccagtgttgttgtaggaagaataatttagtaataaccgactgatttaagaagagaaaggccagtgtagttntaggaagaataatttagtggaatctaaagttaagtttgttgttttctgttacaagangtctgatacaacccgacagggttgctttccgattgtg

SEQ ID NO: 482435 - DNA, 854 bp, Homo sapiens
  misc_feature (429)..(429): n is a, c, g, or t
gcggccgcaatcgccgctctctcaacccagatggccccggcgccccactagccatccgtatccccagtgcagctgcggcggcggcggcgaaagccgacgggacgagggcgccaggaaagaagcagcagacggaggcggcaccacggctctgagaagcaatgacattccctctctagcccgccgcccgcccagccgaaaggagcagggggaggagccccctggagtccgggcggagctcaagcaacctctgactccgcctccggcccgacaggaactggcccctccgcctgtcacaaagcgacaggtccgttagggggcgggcccagaaccgctgcgcccaccaataggggcgcgagctggggcggagcttgacccaaccgtctccccctcccccccaccatcccggcctcgcgccgattcgcccggagnggccgagctgcgcggctacggcttcattgtcagttgaaagacgcggtttcgcgcgcctgtgcggtcggcgagaaagggtactaggcggctccgctaggttcatggagctgagctgggccgaggggcgggaactgcggagcggcctcggtcaaactcgtcttaaaggacgcggaaagcgccgcaccgaccagcaggacgctcgcgggctctccgcggtcgtgacttttaacccgctttgcgcggagccctcaccacgtgacggccgcgcaggcgcattatcctagccctcggcgcgtgggtcgggccgaggggttcagcagcccgtggcgctcctcggctggcgctgcgagtgagcccgcggcggcagtgacacagcctaccttgctcattgcccttcacgtcccgcctccggcttctcgcgtcgc

SEQ ID NO: 482436 - DNA, 797 bp, Homo sapiens
ggagcagcggcgccgagctctgcttcggcttcggccttcggctccggtccgctgttggtgccgacagacctagagccgcccgacgatagggcatcagccggtgccttggctccttcaatccgcatcggtcctcagaccgggcgtgtgcttgcctccggtcgtcggcgggcagtaggtccggagtggtgtcgaaggtgccgcaagccgtttgctccctcggtcgcgcgggtgacatgggtgctgctcagcctcctggcgtttcctctggctgctgtggtggtcaccgaatttgcagagtatgatcgtgaggggatagccgcactatggtacgaatcgtgcgattcccatgtggaaatgttcccttatatggagaaatgaagtgctagtatcgacatctgggacttcaagtacaggtgtgcgtaagcgtgggtaacttaacgggagtgctaggcaggatggtcctgtcgttgatcgcccagtctgactgcaaggtaaccgggatgttgtcacatgagaaactccctttctgtgacgaccaggtcccatgatacgcatggcataactgacgttgtacgatctagctctaatcgactgcttggtcgcctcatacgaaagccccaagtgagcaacttaggtatctagtaactcagatgcgcaacagtctggtttgtgcacgtcaaccggggtgtggtcagatcgttggatccccctccgattggccggttccaagaacccctacaggaggcccccgaacaatctctttggaccgtccgcaaccgttgcggcaggaacttggc

SEQ ID NO: 482437 - DNA, 212 bp, Homo sapiens
tttagcagtgttgttcaagtgattttctctttgactgaacactactctgttactcgccatggtatcctaagcgtaagttaatgactacagcttctccattcacataggaggtcacagtgactagtgatggatgcaagacacaattatctatgacaattacagctaccgatgtgtgtgagattggtactcgaggctcgatatctcgtaaatct

SEQ ID NO: 482438 - DNA, 165 bp, Homo sapiens
taaattcaacagactgggcaccgtggctcacacctgtaatctcagcactttgggaggccgaggtgggcgaaatcctaagtgtcgagaaatatgagaaaccatctggcttacaccagatggaaaccccgtgttttactaaaaattcaaaaaaaaaacaaaaggggg

SEQ ID NO: 482439 - DNA, 2069 bp, Homo sapiens
aaatgaaaatgtcacccgtaagggatgtgcaatgcgcagttggatccacgctgcgttgagcgctctggactgcatcctaccaccaaatcgtccaacatgataaagccacttgcgaccttgcgtctccagggatgtctcactacaattggggggatatttggatacttgtatccgtgttgccagagtgaaagcacttggctgttctcaaagcaggttgatgggtggtcaccgtattgtctcccagtcgaactgttcagcaacacgtgaccaggtcaatcgtctgtccgaaattgcaccaatgaaatgtttttgcgctgaagcttcttccgtgggggaccaatgtagggctatcaatgtcaatgcactgtgtactagtctacgggggatggtacagtcggtgggcgaaccgttaggcatggttgaccatgcaaccatttgaccccacccaaatgggacagccagctagggcttacaactgctccaggtgatacatcctgagaaccaattccagggacaaataaagcaggccggataatgcccactgatcattgggacttggccaccaccggcagtcacaaagtttgcgagtggcaacggtattgcatcgaacccatgagaaagggaccaaagactttgactctgcccgcccatggtacaaccagccttggaagattggcccttaaaatttcttgaccgtcttggtagaacagcatgccaatttgcttgattctgggtcccctgggcaacgccccattgtgttgtcgaggacgtcctcaaggagtatcaaccctttggggtcacgcattaggacggacgtgtcattcatacacaaccaacagatgtgtggcggtggcgtgtcacacagcagcgggtgccacacaaggtgggtgcactggcagttcaacaggttgtcacaaagttcaagggtaaaggataatatccctagacgtcgcaccccgctataaggggtgaaacctcacccgtagtcatgactatacctaccaagctgaccatcactacacacatgagtgttgtttgtcgtatgtctattcttcacatctactacctatatctcggtaagcgtagatacaacatcgatagcattgagatacacgatcaactgtacacacccagcgcaactatacgcacacagagacacagcaaaggcaaagagcagcaagcaagaagccgagacaccaagacagaggcaggatgacagacagaagacagacacacaaccgaaggcagacgaaagaacgaagaccacaacgagacagcaaaaactgaacgacaagagaacaacacgacgaaacacaagacagacgcagacaaaaacgaaaagaagagcagaaaacacacagaacaacacagacagcacaacagcacacacaacacagacgaaacgaagagcacaaacagaacggcgacaagcaagagagaaagaacagacgaagaacagaacacgaagcagaaaacagacataaggagcagaagagaaccgaccaggaaaaacccagtagaaaagaaaccagcagactagagaagacacgatcgatgaagaatgacagaacacagagcacacgagacaagaagagaacgacatcgcacaacatacacgaaaataactaataacactgagcgacacagcactaacataaacacgaagaatcgaaacgagagatctggtcggacagacagcatcaacgataagcgagaaaacacagagcaaaagcagagcaagaccaacgacgaacgaagacgcactgcacgccaggaagaagagagagggagacagcgaagaagaacgagagagcagacagcgcacacagagagagaaacagaagccaacagagacgcgccgaggcgaaaacagcaagcaaaaaggagaacaacaggaaagcagaacggaggagagaggaagaagcagaaagcgagaagaagagagaagcagaagaacaaagcaggagaggagacagcaagaggaagcacgcaggcgccaacgagaacagagacagaggcagacaaggagcacacgaggcacagagagcgagcaacaacgaaggaacaag

SEQ ID NO: 482440 - DNA, 211 bp, Homo sapiens
aattgtagtccacgcttcaaactaatttctggatacgaaattttcccatatgaaaataaggagagaacactgtgcctctgttgaacaatggcagttctgaaataatagtattactcaaactagcactgaagtgtatacacataccagcaggtctattatccagtgacccggatgtagtagcattagccaagccagtgacactaaaattcca

SEQ ID NO: 482441 - DNA, 100 bp, Homo sapiens
cgagtgaatgacggcagtatagctgttctgagtgtacacggacggcagtgtacgctgtttcttgattgtacacggagggccagtatcgctgtttcctgga

SEQ ID NO: 482442 - DNA, 102 bp, Homo sapiens
tgagctggcccggttatcttatgctccaaggctatggatcgcaacactaaaggatcctcattaggaaccccagtaaatcttgcagtattgaaactcagtgag

SEQ ID NO: 482443 - DNA, 234 bp, Homo sapiens
  misc_feature (15)..(15): n is a, c, g, or t
  misc_feature (234)..(234): n is a, c, g, or t
atgactctgcgccgnataatttaccggggctaagcatgacaccgaagctatggacaggaatgtggtaggggagcattgcatgcagcggagaagcatgaccgagagggcatgtggagcgcatggaagagagaatgccggcgtgagtagcggcacgtgggtgagaatcccacgcaccgatggcccaaggtctccagaggaaggctcgtcctctctgggatagtcgggacctaaggn

SEQ ID NO: 482444 - DNA, 740 bp, Homo sapiens
tgctgtctcaagagtgacagaggcaaaataaaattcatctaaaaatggactcatgatgttccaactcatgttgttcaagcatcaacagtaccttgtttcatataactgataaggcttttcagaaacatgggttatttgtagatttcaataatccatggacagtacacagaatagattacagtatgttcaaagtcaaatataaccacaattcacattgaatcagagattttctctcgttttaaattagatgttttagaaagttgtattaatttttatactcaagctaatttttattagtcaagctactatttagtaactttagtgttcttacagaaaataaagtgttaatgtaactcccaggttttcctgattttcaaataattacagcttaagactgtatataataagtgatagctacaagtgatggctaaaattttaaatttgaaacaaagaaacagatttctctgtgtttcttaacaagaagcataacattattttcttttaaaaatgtacacttagaaggcattctgcagttgggcatgggtgtctcataccctgtaatcccagccacttggaggctgaagtggggaggatagttgaacccaggagttcaggaccagctgggaaacatagtgacgacacatcttacaaaacctaaagattagccacgcatggatgggcctatctggggtcccagtacctcggggccagggacaaatgctgcccaggagtaggctctg

SEQ ID NO: 482445 - DNA, 146 bp, Homo sapiens
ggcagtgtgcagtattagaaatcccaactgtctctgatacaccgctgctgtagaactaattttccaagctctgaatgtatattgacaattattcgggccagtgtgaaatgcctgaatatttcagagacagccactagcagtcgggt

SEQ ID NO: 482446 - DNA, 879 bp, Homo sapiens
  misc_feature (552)..(552): n is a, c, g, or t
atgaagtgcaaacagcaaaagaatttataaagatgtacgaagctgcacgaaaatgaataccagactgccatcagtgagaattatcagacaatgtcggacactactttcaaagccttacgtcgacagttgccagttacacgcactaagattgatgggaacaagatccttagctacaagatgtggcagagagagatgcagaatgcttaagatgaacatgtgcatgaccggatcattgtgtagtgtctttgcgttataaaaatcattgcaaaagtattctgaacgtgtcaagctgcccagtcagatgggctgttgccatttaaaagtcactgtaattaattaagttctgatgagagcacaagagcttagctaatcaaccattattttgcatcttgttggttctaagaggatgaaaagtcagttccagtttaaatgtctttctgttaggcctttctttcttacaaatgaagagatgattcttctagtggactggttaaccagttttgaagtgtctcaaaaatattttactaactgtaaccctaaaatgatgtctgnggcttatgaaatcagtgaattcggatcatctccccagctgcttttgacgtgggggtcattctggccattctagtttacggtggttgatggcttagccatatatgctggttacagaaattgctacccttttcttcctcccctgttccttgttgtgcacgtgcgcatgagggggaaccctttcttgtcactgggtgtaccctgcagaaggtttcgccgtagggggactacactttttcacaggccgcggatgccggggaccggacaacggaaccccttcgaacggtggggcttcgtgagacgcccgggccttccggttttaagccgctg

SEQ ID NO: 482447 - DNA, 192 bp, Homo sapiens
agacttatgcatactcctcaaccgataatgagtgtgtctgtggctgagcacttctctgtagaacactttcttactgtgcatcctctgaagacttatggtatgctccatcttcatggcggtcataaccatgagggaatctcccgctttcactttgtctccagctttgacgaacacctttttcaatggttccag

SEQ ID NO: 482448 - DNA, 807 bp, Homo sapiens
cacgccccccccccgcccgtagccggcctcagccccagcctcgctagcccaagcatgcatgatagccgtggttgagaaccgtagagctcgagatgcatcatacacaaagtattccgttttgctcttgaagcggctgcagctgtgttatggcatctgttcccgcctggccggcactagctgcgctccctgaggaggagcggacgcccactcccgtgcactataggcctcatggggccaagttcaagatcaacccgaagagaacgggcagcgggaggctgtgtgtaggacgtgcccattcccagtcgtactttccccccgaatcccagcgtcggttgaggggcggcgagggctggatcctgggcagatatatgccaacaacgacaagctctccaagaggctgaagaaagtgtggaagccacagcgtgtttgaggcgagagattctacagtgagtatcctggacaagaagttcacagtagactgtgaccatgcggaccctgtgacctcatcgatgaggcttagcgggctcgacttttacatcctcaatgaccccgaaggaggacctgtgctccaagtttgggatggacctgaagcgatgggatgctgctgcggctaagcccggataggagcccctcagcgtgcacccccgagggatccctgagcggggtgcagccatctacgacagagtacaaggaattttgccatccccagagggaggaggcagagtgggtgggcctcacgcttggaggaggacattgataagcaggagactttggaagaaaaagacctttagccctgtcaggatctat

SEQ ID NO: 482449 - DNA, 106 bp, Homo sapiens
gcgccatttcatctgtcctcattctcttctcctttcgcagagcttccagcagcggtatcttgggccagagcatccggaggttcacaacctcgtttgctccatagag

SEQ ID NO: 482450 - DNA, 266 bp, Homo sapiens
ctcccggatttaactccggcccaccccaaatgcaagcatgctatttcagaaatatcaggcagatggacagcatgataaaatatgaccggtataataggataaggagcccctttttattttctctcccccaattcctggccaggtggctcaaaataacctgataagaatcacggataaataatcacaaaaaataccaggttaaaataccattggtgcggctgggtgcagcggctcaggcctgtaatcccagcacggggctcgtgcgg

SEQ ID NO: 482451 - DNA, 788 bp, Homo sapiens
  misc_feature (233)..(233): n is a, c, g, or t
ggcgcactctggccgtggctgcccgcgaagaatgctggatgggagagctggaggagctgataggctcagatggcctctgcctggcctagggcaaggaggaggcggtgaagcagcttcgcaagatgcacggcccaggatgaaggagcctatggctgggacggtggaggcagacacggcacctgtcccggtgaggagtatcgttctcccagcaagtcggcgaaaggtgaagagcngcctcaaggagcctgagaggtctgagtgctgctgcggtctgcagtgaggaactgggccgttctcggagccgtcctcgtgcgtgcaggctccgcagcacggaccgtggatgagcatggctagatgaaggtggtcacaatgagtaagccttagacagaggcatgccacttcttggatcgagaaagcgtcaggctggaggggcgcctggggctagttgggaggggaacgagcctggaggaggacgacatgagcgaaactcatgaactgcgtcagtgtaccgtgtacctgcttgacttggtccatgcgcgttagagtcatcgtgatgcaactgagctgtcagactgagcgcagtttctcagccaaggcagatgagcgggctggcaggcagctggaatcggcagatccatggagctacggggacgcctgggtgaggaggatgcgtggggcccgtgcccgacactaagatgagccattgctgtcccttgagatctaagttggaccaggctgaaggagacagtctagagcaagagtaccagatagcgcatcctctctggaaa

SEQ ID NO: 482452 - DNA, 390 bp, Homo sapiens
gaaggtctgactgggcgtaccggatcagcatggtcatttacagctcatggcatatgcgtgataagagaatgggcgcacaggcccgattccagtatcccacggtagtagaaggaacgtgtagatgagatgcgtgggcccatctcaggggtcacacattccggggccaaggagtagctctcataagagcttaaaataaatgcactggcggtcgtctgggaagaacacacaggcacagaactcttgtaccgcttctcaaagctgcccaaagctgcgaccttccccctcagacacccacaattaattgtttccattcagctttggttttgttttctctgcaatttacatgcaaacaccatctatctattcatccatacatccattcagcctctt

SEQ ID NO: 482453 - DNA, 160 bp, Homo sapiens
gtcgtctctgacggatccccggtggtgggccctagtatccctagctagttacggcatcgctgaggcgggagaattgcttgctatccgggtatgtggcgattgcccgtgcgccgagattgtgccattgtagtctagcctgtcccaccgcgtgggtaccgag

SEQ ID NO: 482454 - DNA, 835 bp, Homo sapiens
  misc_feature (293)..(293): n is a, c, g, or t
tggaagcatagggcgcctcccaggccgtctccccgcgtccagttatagaaccgtaattcccaagtgacccgggaccgggcccagtcctgggctcttactgtccgcttctgctgggacctgtaccactaagatgggcgtcttctgccttgggtcgtgggggtagggccggaagcgtgcggacgcctgggaaggggccgttgaagtatcttatgagccgtctctggggggaccactatgcagggccagtccctagcctagaggaatggctcgcctggcttgtggtcaggagggangccgtgtgggactgctcgtccttctctcgtcgctgcgtgatggtgccgagctagttggaccaggactccagaggaagcaaggcacgtggcccatgctcagacatcgcggacccgcatatcgtgcccgtgggctttggagagagctggaacgaagcaccgtcagcgtgggatgttcgggaaaccgtatttatcaagctaatgggatttgttgcagaagaaagaaagcattacactgtttatccacccccacaccaagtcttcacctggacccagatgtgtgacataaaagatgtgaaggttgtcatcctggggacaggatccatatcatggacctaatcaagctcacgggctctgctttagtgttcaaaggcctgttccgcctccgcccagtttggagaacatttataaagagttgtctacagacatagaggattcagttcatcctggccatggagattatctgggtgggccaagcaaggtgtactccattctcaacgctgtcctcacggttcgtgcccatcaaggccaactctcatacagga

SEQ ID NO: 482455 - DNA, 689 bp, Homo sapiens
  misc_feature (236)..(236): n is a, c, g, or t
tgtgagatggtatctcatcgttgatttgatttgcatttctctaataatcaatgatgctgagcttttttttgatatgtttgttggctgcatgaatgtcttcttttgagtgtctgttcatgtcctttgcccacttttatttttttaattttaattttattttattatgttttttgaagacagagtcacactcagtcacccaggctggagtgcagtggtgcgatctcggctcactgcangctccacctcctgggttcatgccattctcctgcctcagcctcctgagtagctgggactacaggcacctgccactacatccagctaattcttttgtatctctaacagagactgtactttcaccgccttagccagcggtcttgatctcctgacctccgcatccgcccatctcgcccttccatttgctgctccttctcccccctgacccttctcgatccttccctccctgcctacctttctcatccccttcctcccccatccttctctccttctccgtcctctcccccctcctgtcgctctctcccctctcttctcccctctccccccatcacctcccccttcttcctcccttccctcttcctctcctcctcctccccaccctttctcccccgtctccgctccttcacctctctcccctcccctttctcttccccctctcccccatcctcttccct

SEQ ID NO: 482456 - DNA, 279 bp, Homo sapiens
gctgctcagagtatccccagtgatgacatgctcgagtcctttcactctgtctcctcagttaatagaaaggaaacatagcccatctatctggacctgtgtagaagaatttggaggggaaaaaaaaaaaaccaggcaagaattgtccccttatttggtgagctccctttatcctgtcccatggtcctacagcaaagggcttatttaaaattatttcagtttccctcatctaatagggcatattgaataaattaatttagagcgggaaaaagctggggtacc

SEQ ID NO: 482457 - DNA, 1420 bp, Homo sapiens
  misc_feature (1262)..(1262): n is a, c, g, or t
ctttttcgttgggtatgtcgccatgctacgtcgcggtttcttgctatcgtcacgtgtgttgtcggtcttcagttctgtgttcgattttttcaactgtgtttaggtgtcctcctacgtattgggcttcctctgttggtatcgctcgttgtgtaattgttgccacctgttgcaaggtcaatcagttgtggtgccccctcttttgcgcgcaatttttacttgtttctgtggcctgcaagtgactggtccaccgtcgtgggtgttcccccctacccctggggggtcgttttgccccccctgtgtttgccgggggtgtcgcctcgacagtttcgcgtggcgccggacctgttactagtggtgtgcgctgctttgcgggtttttttgcttcagcttggtctctcgcccaccccgcgatatcacgttgggagctgtgtgttttctccttgtgtggtcccacccgcgtttgtgttttgtttggcccctgttacaccgcgtctccttggttgcgacacacagggggtggaggggtgcccctcccctgtgggacacccagacctggtgtgaatcgcccctgtcctcccccccctgcatggtgcccaccaacacgccctttctggtgaaccaacttgcgttttcccgtgtcgcccgcagtgtcgaccttcagtccgtgcctgcttttaggagaagcaccgttcttgtgtgggcttttttggctgtggacgccagtccaccccctgggacctcctgtcttaggtggtctttctgagggacccacttgatggaccctggaggttaagtggattaccagaccctttggccaggacccttgattgagtgaccccttctctggagacttgcgcccaggtctcctctgtgcaacgcccaggccagaaccccaatcgcaatccctgtgagacacctgcgcctcactggccacccacgaggtgaaccacgggccacggccacgcgtatttatggcccacagcctggggaaaatgggaagagttcctcgtccccgctcgccaccactatgtccctaccagtgaaaatattgggaaaagttgcgtggctatttgaattcccgggtctcgttctctggacggccacgaggacccctctggtggaatatagttggtcacgctgccctggagaaaccctcgttcccacgctttattcacggaaccgccacggccctcgtgggagccccccaacgctggccgcgggaacacgggccacgatttcactgttgacaccctcggggatgnctgtgaaattttctcctcgcacggagagacactcacttgaattttttcaacctgtatcacgtacgcaccacgtatttttgtatgaaaagtgggagaactttctgacccgtaattccatttaattcccaagccttttgaaattaaaaaaatccaactta

SEQ ID NO: 482458 - DNA, 105 bp, Homo sapiens
ctcaagcttatacttcattctttccaagctattggaaacgctatagattcttgtgttaaaagaagttctgaaataataatgtcacagcgcgaatcatgcaagaga

SEQ ID NO: 482459 - DNA, 139 bp, Homo sapiens
caagtcgttagtgcctggatcaggacatggcgctgatcaccccagagacaacaagctccccggcgagatgcgtggacctcggcttgaccttgcttgcagatgttcagctgtctggcagtagacgggcgactgcgttgca

SEQ ID NO: 482460 - DNA, 540 bp, Homo sapiens
ctccgtgtgggtgcaagtggaacacacagagctcgaggtttcagtgacgtgaagggggccgacgtgaggttaagacgtccccgttgacctgcctcttcgtatttcttgaaagaccctggtgcacgcttagcgacgtagcgagcgccaggatttatggatccccgagccctgtgacaagggttcctgtcgcagttgccccctcccaggatttcgactcagttcagcgaagtcggccgccccgtctgagaaatgaggacaccaaggtcttagagcacaggccccgaggcgccgtctaccgaggaccccgtgcccctcccgccggctcctgtcggtcagcactgaaaccgccgtggctgctccaggcgctccttctctggggtccagagggtcccagtacaggcgcgtctgctcttcggccgtaggcccgttcagtcggccggtcgcctcgtctccctgagcttgtcctgcatggccatggtgcaggcatggccggtattccggtcgggtctcctgtgtgctgacgacgccagttggacctcc

SEQ ID NO: 482461 - DNA, 674 bp, Homo sapiens
  misc_feature (2)..(2): n is a, c, g, or t
  misc_feature (163)..(163): n is a, c, g, or t
  misc_feature (295)..(295): n is a, c, g, or t
  misc_feature (337)..(337): n is a, c, g, or t
  misc_feature (409)..(409): n is a, c, g, or t
  misc_feature (430)..(430): n is a, c, g, or t
  misc_feature (501)..(501): n is a, c, g, or t
  misc_feature (550)..(550): n is a, c, g, or t
  misc_feature (602)..(602): n is a, c, g, or t
  misc_feature (614)..(614): n is a, c, g, or t
  misc_feature (641)..(641): n is a, c, g, or t
ancaattctgttttatggaagttgtataaaactacatttggtattttccctcagtcctctggtattcttgaagcttgaaaaatttagaacactttaatggtaacttgttgaacagcaatagaaaggagaagatgttcttagaagttagttttttaaaaaaaanaaattatatccgagttctgttaaagccccagcaagcaaggcccataaaggaattaagaaataggataaatttatggtagttaactgttccagtttagcacaaagtcgaaggaagaaggctaatttaagttanaatgcaataaggtaccaggctttttttttaatattgttttanccatgttgagggttaaagccagatttacaccgcccagccattttcacaattagcaggacaagaaggatagtntcaaatatccagaatggaatnaatattaggaaccagttccaaggtgctcttctcatccagtttcaacaccaacatgatcaagaagagttgtnttataagccaggggagttgtacttttttagccaaggacatttttatttnaacagtttaaagaggctgttgcagggtcggaaaaaaggaaaaataccctggnagccctgccggncggaaagcggagagggaagcgaagatnagcaaattcgccagtttggattcttgttctttt

SEQ ID NO: 482462 - DNA, 1480 bp, Homo sapiens
ggcctttgaccggcagctctgtgtctttggtggatagatgcagaaacaaggaagacatggcgtctgctcctgagaaccttcaacattacaggccaggagagaagtcttcagaccaacgagctcccagcagttcacacattcatatcaaccagacacaacaaggcgatggcagcccaaactccggcagatataacacagaggagacgtgacgctggtgcggctgcggcacaatcagggcacggttcccatggcgggaggatgatcccttgcaactggctcaccacggggcaaccactcaagacgccatgcatctggacgcacacgcaacgcggctgcaacgcagagacgacacacaaccggagaagctaccagtcgcaccccagtgacaacagaacggcggccactcgacgcgaccctgaccctagcagacacctgcagcgcgagtcacaagccaccctcccatatcccccccagacatagcgcgcacatacacattgactcaccgcagagccctacgtcgcacgacattactacgcgcgctccatgagaccacccatacccatactatcacaacgtcgcgccttcccaaacactgccctaccacagcttcacgcccagactacccacactgcttacctcgccatggcaatacgccttgagcactcgatcgccacgcccacgcggcaacgactccgcaccaaacgcgcatcacgcctcacacccatggaaggaaatactacacaggccaactgacaacgcaccacaaacaaccatacacaacccaccacacacacgaagcgacacccggccgccgcgccccgccaacaaaacccacacggaaaaccataacacacaaaactgggaccacaaacgccagcactaacgcaagccctgctagcccccaaacacggcgcgccactccagaacgacacacacacacgcaacacaacaccagcacaaaacaacaccaccagacattacagtccacgacacacacagaaaaacggtcaggaaacacagctacgaaacacacgaaagaccacactggagacaatacgagagcaggcgcacaccacacgagatcaagaaggcaaacctgagaacccgtcaccacaaggcaccgaaccaccgccgaggacaggcaccagcacgagacacacatgacagacccacacacacacaacagtgaaggacaggacgcaggcgaccacaataaaacgggacggagctgacacggacagtacgccgaaacgaacgacagaaacaacacaccaaagcaccgacagcaacatacaagctctaaaagaagcagaagacatcatggagacggacagcacccaggactagacacacaacgaggggacgacaaaagaagaaagacacggacgacgactgacggaccaacagcagagcgtcggaggacaggagacaaaccgagagacgaaaacaaacagcactaaagagagaacgcgacgaaaaa

SEQ ID NO: 482463 - DNA, 175 bp, Homo sapiens
ggtccaacagaaaataacggagaagaaaggaggtcaaggatcagggaactaagcgtctgtacatctggctggtgaattcacataatgcttagttccccagcaagatgtacagaacgcctgttgtttacattgtttttaatggaactagcagaataaaacatctattttaaaaatg

SEQ ID NO: 482464 - DNA, 253 bp, Homo sapiens
gctagccatcggttaaatagccgacgcaggaggtgctatgaagttagcacagtacgttctgcagtgaatttgcgcggttatgatttagcactgcatctttacatttgtttacatttctctcagctgtgaatgcctccccataaggcctgtgtgtgtatgtatatattttgataaactgtaactttgtaataatagatttgtgcatattttgtggttgtaaatgataaaatagaccagtatctatatatattta

SEQ ID NO: 482465 - DNA, 301 bp, Homo sapiens
ttcgtttgggccagaggatccacacacatcttcccctaaagcggacaaaccaggcaggtgcctggcacccgcagctgatggctgaagaggagcctggggtcagagaaagcccgttcatcacctggaaatcctgcggtttgtctgacagcagctttctagatgtaggcgcacttcgctttcttttgatcccggggtagtggggcggaggacgtgaaggtagtttccttggggtggtgggagcccccgggcctccgctttgatccaggaatggctccgcctcatctccagtgagtccctggtc

SEQ ID NO: 482466 - DNA, 115 bp, Homo sapiens
gccctgatgctcctattgttacctgactaaagaaggaccataaggtaaaaggcaccattacctatatggagtgagcccagaccccaaggagaaaagcttgggatagaacaagtcc

SEQ ID NO: 482467 - DNA, 591 bp, Homo sapiens
actaatcctatagatcagttatttttcgactttttagaaaggctttagactagtgtgagatggtgtctcattgtagttttaatttgcatgtctctaacgatcagtgatattgagcttttaaaacatgcttgttggccgcatgtgtatcttcttttggaaagtgtcttttcatccgggcatggtggctgatgcctgtaatcccagcactttgggaggccgaggtgggtggatcacctgaggttgggagttcaagaccagcctgaccaatgtggagaaaccccgtctctactaaaatacaaaatcagtcaggtggtgcatgcctgtaatcccagccacctgggaggctgaggcaggagaattgcttgaacccgggaggcagaggttgtggtgagccaagatcacgccattgcactctggcctgggcaacaagagtgaaactccatcttaaaaaagaagtgtctttcatgtcctttgcccactttttaatggggttgtttctttttgtcttgtaaatttgtccaagttccctatagaagctggctattagacgtttgtcagatgcatagtgtgcaaatatctctcccataggta

SEQ ID NO: 482468 - DNA, 727 bp, Homo sapiens
gggggcagaggttgcagtgagccaagatggcaccactgcactcgccagcctgggcaaaaaaaaaaaaaaaaaaaaaaaaaaaaatttgggggcgggcttgggccttagagaaaaggttttcaagagccacattcgcggtggggcgcgcgggggccccagagaggggaacgggagacactgggcgccaaaggcgggtgcccaaaaggagagaaccgcggggcacatggagacaaaggggcgcgggagttcttctccaccacatataaaaaaaatcgcgccggggggggacaccccgcgagggcgggtcccggagaaccaaatctcccacaagaggggagaggtccaggggggagagcccaaaaacggggggagatcttatccccaccaggggggagtgcccaaaggacgaggcctcgcgagaatattcccaaaaatctaaaggccgcccgagtctcgggggggggtgccacacacaaagcgaacagagaacacaacaggagcaaaaaaaagatagacaaaaaacaacataaagacgaagacaaaaggaggaggaaaacaaaggagagcacgcagcgaggaagatgggagaggcgagacaaaagcccggacgacacagagcaggagagagacagacaacgacacaaagcaacaagcgagaaagagggaacgcagaccacacgacagcgcaggaagagaggaacacaagagaggagcgaaagaaggacga

SEQ ID NO: 482469 - DNA, 287 bp, Homo sapiens
  misc_feature (272)..(272): n is a, c, g, or t
tacagagtgaatgtttccttttgcgtggatgctgtcgatgaatactccgtcacctcttgaagcttacgctggtcattgccagcgtcatcctctgttgggcgtattcccccatcggcgtgcacatggggctgcactgttacagccccggccaattggcgctgctgcggtttttgatcgcgtcggtattcatgggcggcgtggcctcggtgttggaaattggacggccaccattgcgcgacctgccgtggttgtttgtgctgggctttttcggngtgttcctgcaccac

SEQ ID NO: 482470 - DNA, 132 bp, Homo sapiens
ccttaagtttgaagttggaatgctccagggtcgacttttctaggtagctcgctagacgggtcatttaggttctgcatggccattttctcattgccaacaaacaggtccccgccgacttgtgagcatcgctcc

SEQ ID NO: 482471 - DNA, 294 bp, Homo sapiens
aacccctggactagcaatcatgaaagacaaatagatctaaatatctctaaattgagcgtggattttgacaagattttaaacctgatcatcctagaaattttcgaaattcaaaccataattttgcagccgttttggaattcttattcttcaaacttgagattatgagctttaaccccagcgtgtaaatcagctgtgtttgtagcaaagtttatctgtaaaacaaattttggtaagtagattttaaatggatagacagggtgtttcagtttcctcccatggtcctcccacgggatc

SEQ ID NO: 482472 - DNA, 249 bp, Homo sapiens
tcagtttttggaaagcagggttcctctgcctgctagcaagcccgcgtggcacagtgtgaatgtctgtcctttacgcctatgtttttaagtagtccaacttcaagaaacaatctaaacgagtttctgttgcatatgtgtgttgtgaacttgtatttgtatttagtaggcgtctatagtgcatttaacgtgtttttgtaactcctgattcgtccttttcggatactattgatgaataaagcaattaaagtg

SEQ ID NO: 482473 - DNA, 460 bp, Homo sapiens
actagttctttcatttcttatagggacggggtctcgtcatgtagcccaggatggtcttgaactcctggactcaagtgctcctcctacctttaagtgctgagattacaggcatgagccagcagacctgaccttggcgttctcttactttgccttcgagccccttcagacagttcttcttggaggttaggggaaggcttctgtacagacaacttccttatacctgtatgatgatggtcaaaggtcccggtggcgaccgacttcccaggcagcaggaaaaggaagtgcaaagcaatgtagcctctacaagagcacatgtgtagtaaacgggtggcttgataggaccctgggaagagagctgggtgatgcagggcacatgactggcaggtactgacaggacttatggggtatgctaaggagtatggaaaatggggagtatccaaatttagagcccaggaacagt

SEQ ID NO: 482474 - DNA, 284 bp, Homo sapiens
cagagaacagtttcgcgtaagaggacttataggtacatccggaaataaataacctatctatgatcatagagctccattgggcaacttgtgtgaacagtgagaaagcagaacattttatgcgaaatctgataatcagactaacgtggatttacatcatatgcattggtcattcaagatgcccaagcatcctctgtctagctacacttcgtttccataatcttgtagaagaaagagactttatgaccatgtagcattccattcttttagtcctgaatcttcctctt

SEQ ID NO: 482475 - DNA, 916 bp, Homo sapiens
ggcgcattgggcactatgggaccagttcatccccaaacgtagattcccgcccataccgcgtaacgccatgccagtgtcgactcagcccctgactcaacgctctgttgccaccttgcttcggctgatcagactgtgcaagatctggagaccgtccaacttctccctgatgacggagctgagctatcaagagcggcaaccccggggaagtcctcccgcggaccggatgatgggcctgcgccttctcgggggactgcccacgtacagtcgtcactgtcttcctcggacaacctggcccggctctggatgtgtggagactggagagatctaagagagagtatggcggcacacctagaaggctgtcgtccttgcaatggccttcaaagtgacagtgtgctgtggctagcctgtgtacccactctgggacatgcctggtgcaggtggtggcagctgtgagggacccatgcagcacccaggtcagagcagaccctcccctgccggcctgcgccagctggacctgatggacacccatgtggcgccttgaccatgcatgggcacaggcatgcccatgggactctcagcccccagttgcattatccagatgtgacagagctcgacgccaagccaggctgcacactgcctggacatggggctagccatgcactcgcctagggaaacgtcaggaccgagggcactcaaagctcgctgaggggtctgaggctggtgcccaccccgcaagctagtgcgttctgctgcccctacactgctccgcgtttcagggcaatcggtccatagagaacaccaccacgatggcaaggtggaagggtttattagtacctgccagcagactgtcctcgtggtgcaggtggcatggccagcccactggattgggacgggtatacgctggggagatcggggg

SEQ ID NO: 482476 - DNA, 194 bp, Homo sapiens
caaccgactctttcatgctgctcggctatccaggatcaaaaacgcctcctggatttcagagaaggccagcgacccgaccgggctatcttggcgttggcactgcacgggtcagtccttgacgcgcaaacgggtgtccgcaccttcgagtacagaggcaaggcgacgcccgaaaaatggaacccggcggtgacaaa

SEQ ID NO: 482477 - DNA, 281 bp, Homo sapiens
gagaacttactccttgctattccgaacactttgagccacggccagtgtggaggattgcttgaggctcatagttcaagactagccagggcaacataggaagaccctttctctccaaaaaaattttaaaagaaattagctggccgtggtggctcatgcctataatcccagctactcaggaggctgaggcacaagaattgcttgaactcaggagatggaggttgcagtgagctgagatcgcgccactgcgctccaacctgggcgacagagcgagaccctgtctc

SEQ ID NO: 482478 - DNA, 432 bp, Homo sapiens
gggtctcgatccaccattgccttacaaaacaaagcccttaatctctgggaagggtttttgtgcaaaacgtcaccgattttaagggttgaaaggttcgatttccaggtgccttggacacaacagctgaaagaagcactcctccttcccttgccgggcagggcattttaagggtttccgcacggtcatccgccccttttacctgaccaactcctcaggtgtggattaaacggggtggcccaagggtggtaaaaaccgaaaaaccccaggacgccctcattgcaggttcccctcctgggtttctttcctttttgcaatgaccttcaacaaccggccaccaaatttcgccctattcacctgagcggtaagtttcaaaaaattattggaaggtttcccttagggtcccccaggagttttccccccccctccccagtt

SEQ ID NO: 482479 - DNA, 164 bp, Homo sapiens
tggaaatgggagtttggctcgtggcccaggcgggagtgcaagggcacgatctcagctcatggaaaccaccaccttccgggttcaagtgattctcgggcctcagcctcccaaatagcggggatttactcgatgtgtgccaccaggcgggcctctatgtcatttcg

SEQ ID NO: 482480 - DNA, 154 bp, Homo sapiens
gagagagagagagagagagaactagttctctctctctggaccccaactgctcctgtgccgctgcaggtgtctcctgcacctgcgccacgtcctgcaagtgcaaagagtgcaaatgcacctcctgcaagaagagctgctgctcctgctgccctgt

SEQ ID NO: 482481 - DNA, 438 bp, Homo sapiens
attcgcggccgcgtcgacccggcgctccgcagcctcggggtggagtaaggttgcattgttccaatactcaatcaactgcctgcgggcttctgtggtcagcgggttaccgcgcgataaatgtgacgttgttgacgcggatgactgcctcggcctcctcgggcggcgggttgactcgggactcgggcaactgcgtgatacggttctcggtcaggtcaacggtgtccaacgcctgatgtggccccaggccctgcggccactcggtgatcccggtgtttctcaaattcaccccgcgcaggttcggcagggtaccgaagttgggagtacgcgccagggggttgcggctcaggtcgaccgtcttgagtgaggtgagcccctccagcagatccacgtccgcctcggtcagagacaaccggttgcccctgaggtccaggcgggtga

SEQ ID NO: 482482 - DNA, 267 bp, Homo sapiens
gactcatcagtccagcagagtgacagttagatgtcttcttatcctatattgtcttgtcaggaagtagagaataaacatgcagaagaggataaatggatttgatttgctattctggctctctaacttctctatagttggctgtagtctgctggattgtttgttggcccagtagaagcaaccctctttgctgctagagtttggaaccgattgaggcatagatgcaagtcaggtaggtggagattgaaatggtaactctaagaactgaaa

SEQ ID NO: 482483 - DNA, 154 bp, Homo sapiens
ctggtatcaagagcacagtttataagaatgatccccgtagaaaaggatctttacgacatcaaagcagcacagatctctgcacagggaaactgggatctcttttccgaaaataagtcattttatgcatcacaggttgtcattcagtcggcgaatg

SEQ ID NO: 482484 - DNA, 1105 bp, Homo sapiens
gggaccatccgcaacctgcccctgtgaccacgcatctctggtcaagagttggcccgaggaggtgtcccgaggaggccggagccgggtctggaggccgaggccgcctcaccgaggaagaggaggctgagccaggacagagtgtggacctggcggtcctggcctgacactggccctgacccctgccctggcagcgggctgcctgcccatgcctgctgttgaagactcagaggccacagagacatcggacgaggccggagcgccctaggcccctgctcagccaccatcctcctggagcacaactatgccctggccgtcaagcccaagcccccatgggcacagacccttgaggaaccccggagccagtgccccgcggcctacggagccacgcagtgagtttgaacagattgaccatcctgtatgacatttttggaaactcgggcctggaactcagaggacatagagttaccgtggggcttaccggtacgaagcggctgctgcagcaagaccaagcgggggcttggactggctcagacgaggactcactgggtaccatcacacaatacaaccaagctgagccagccgcaagaaccgcataggcgtgtgggcccccagggactggggcccccgggagcaaccagacgagcgctcagccgcgcagcgaagggctactaagcccaaatgagggcacgacagggaggaaggacaagtacatggacgtgtgcgcagtcgtcgggcccggacagcttggaaggcgcgtttggaacaccttcaggggaacgaaacccggggttgcttgtacccgagcgcccgcggcccgaagccacaggggcggcttgctgaagcacgccaattcgggtacatgccggcaaagtcgattggcagaaggatgaacgctggttgaaaagctccaaacccaggcctccagttacccgggaaggaaaggaaggccgcgaaatatgggcccgggaccgggagtccaacgaagtgggggcgccttgtatggccattgtgataccccattgcgtcgctggcggaaagctgggtcagatggcaattacgtgagattcaaaaaccattcggacagacatggtgtggcgaacatatg

SEQ ID NO: 482485 - DNA, 582 bp, Homo sapiens
ggtctatctacttgaactcgcgtctttgctccacacaccttggtgcagaggacggagccactgggagtcatccctgttgtcaccaagaggagtgagaagggccccccagccagggccccaggaccggctgattctctcgtgggcttgctgaggccacatgtcaagcaagactgcctggacatccctctgcctctcctgtcaagtgaccccaaggacaggtcattcctgagagacggtccatggtgccaaggatggagcggtgtcagccccctgactgggataccgccaagcagggaagcgcacctgattaagacaccgcagagatggacggcctcatccggggggcctggggtctctggactctgatgatcacctgaggcatggtgacagcgacagacgggatctggacggacttgactgtcctaagtggtggactcaaccttgctgggtcatagaggagctgtaccagaaggtttggaacctggcagttgaggatgtgacaatgtcagctcagtggaaaaaccctctttcagacagaatgggctgggagaggggatgagcatgaggcaatgtaagggtgtc

SEQ ID NO: 482486 - DNA, 1432 bp, Homo sapiens
  misc_feature (103)..(103): n is a, c, g, or t
  misc_feature (194)..(194): n is a, c, g, or t
  misc_feature (246)..(246): n is a, c, g, or t
  misc_feature (255)..(255): n is a, c, g, or t
  misc_feature (258)..(261): n is a, c, g, or t
  misc_feature (263)..(264): n is a, c, g, or t
  misc_feature (268)..(268): n is a, c, g, or t
  misc_feature (270)..(270): n is a, c, g, or t
  misc_feature (412)..(412): n is a, c, g, or t
  misc_feature (418)..(418): n is a, c, g, or t
  misc_feature (598)..(598): n is a, c, g, or t
  misc_feature (946)..(946): n is a, c, g, or t
  misc_feature (1097)..(1097): n is a, c, g, or t
  misc_feature (1124)..(1124): n is a, c, g, or t
  misc_feature (1149)..(1150): n is a, c, g, or t
  misc_feature (1164)..(1164): n is a, c, g, or t
  misc_feature (1184)..(1184): n is a, c, g, or t
  misc_feature (1204)..(1204): n is a, c, g, or t
  misc_feature (1213)..(1214): n is a, c, g, or t
  misc_feature (1218)..(1218): n is a, c, g, or t
  misc_feature (1229)..(1229): n is a, c, g, or t
  misc_feature (1231)..(1231): n is a, c, g, or t
  misc_feature (1238)..(1239): n is a, c, g, or t
  misc_feature (1244)..(1244): n is a, c, g, or t
  misc_feature (1247)..(1247): n is a, c, g, or t
  misc_feature (1253)..(1253): n is a, c, g, or t
  misc_feature (1268)..(1268): n is a, c, g, or t
  misc_feature (1277)..(1277): n is a, c, g, or t
  misc_feature (1279)..(1279): n is a, c, g, or t
  misc_feature (1281)..(1281): n is a, c, g, or t
gggacttcctgccacccaagaagataaaggatcctgatgcttcaaaaccggaagactgggatgagcgggccaagatcgatgatcccacagactccaagcctgnggactgggacaagcccgagcatatccctgaccctgatgctaagaagcccgaggactgggatgaagagatggacggagagtgggaacccccngtgattcagaaccctgagtacaagggtgagtggaagccccggcagatcgacnacccagatnacnnnngnncttngntccacccagaaattggaccaaccccggagtattcttccggttccagaggatcttattggctaatgtagtatacatcttgtgcgtgtggcgtgggctgtgagactctgtggcgtgtcgatgtgtggcaaacatcttatgacancttccntcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacnaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccacccccgtccccggcccttttttttgtttttttgttaaaacggggtatttaaatcttggattctccttcaagcccttcaaccccgtggttcctcatctttctgngatcaacaatcttttctgtgcctctgtgttcccctttctctcaatctctatagctcccctccaaccggggggggcaggtggtgtggagaagccacaggcctgagatttcatctgctcctccttccgtggagcccagaggagggcagcaaanggggggtggtgtctccaaccccccagncactgaggaagaacggggggctctnnctcatttcaccctnccttttttcccttgcccccnggactggggccacttctggngtggggcanngggntccccagatgngnctcaccnntgagnatngtgganctacaaacaaaattnctattaaantnantttggtgtctcccaaaaatatataataatataacaaatataaatcgcgcggcttttttttcgcgtgggacaaggttaaaatgtggccatggtcattgttccgcaccattttttaaaagggtaagcggggccaatgggatatcgaacgcaga

SEQ ID NO: 482487 - DNA, 409 bp, Homo sapiens
ctaaaacacagcatacagataccaaatgctcaaggatcaaaacctgtcggcgcatgtcacgaaggatgcgacgatgcgcttgaatgatcacaatgagtcaaccccagaaatgtgcactaaaatagtctgctaatggtgacttctgagttgcatctcccggcaaatattgtttcttatcataacacttcgggtcgggggaaggggtgttaacggtaaaaagaggaacgagcaaatagataaagagaaaaattcatgcctccaggaaacataagcagaaaaactatagacttgtgtctctgcttattttcttaagtacagtgtacttaataaaccaaagagaatctctataacttaatatgtatgtgaataatgttcataaaaggggtataatgtgttagtcataatggaa

SEQ ID NO: 482488 - DNA, 822 bp, Homo sapiens
  misc_feature (552)..(552): n is a, c, g, or t
  misc_feature (599)..(599): n is a, c, g, or t
  misc_feature (625)..(625): n is a, c, g, or t
  misc_feature (630)..(630): n is a, c, g, or t
  misc_feature (639)..(639): n is a, c, g, or t
  misc_feature (699)..(699): n is a, c, g, or t
  misc_feature (709)..(709): n is a, c, g, or t
  misc_feature (747)..(747): n is a, c, g, or t
cgtgaccatcccccttcgtcttcagcagtgagggtagggaaggaagaattggatgctgaagacgaagtggagggtgtctggaagagaacagtgggagaaaatgggtggatgagtgatgcaaggttttaatgtgaatcctgaggagaaaaagagagacgtgggagtggggcagccatttgaggtggcatatgggatgcatgttgggtcacgtaagtgaataggaaaagaaagggactgaaagcatttaacaggagacaacctcacaaatctgtgggggtgatgaatgctggtcaaggggccaaggtggaaaagtgaggggaatgcagagttctcaaactggggcactgacagatctcatgtgaaaagttggtttcatgaccgtcatcaaggccagactgtaggatcagagcagatgcaagagcccaggaatatgcggaactaggtccacaggagaatgtgggggatggggacaaatgactcaggttaaatgaaggaaatagcatcactgcatggtaagatggcactgggcatggtaacctcagggacttggcnatggactcgtggtttgagtctattgtgtgggtagaaagatgcttgcnaatagtggaggagtagttaggaaccnatgcngaggaagcnattcagaatgatcactgaatctgagcttctgctgtcacggaaggctaaaaggatagaganatagcttacngctgaaagtatgtacatagagatgaaataaagtaggcnagggagagtctcctaccccgtgggtctcgtacttgtaatgtgagtttagatccgtatcagctgatacccccgagt

SEQ ID NO: 482489 - DNA, 1399 bp, Homo sapiens
  misc_feature (565)..(565): n is a, c, g, or t
  misc_feature (913)..(913): n is a, c, g, or t
  misc_feature (1064)..(1064): n is a, c, g, or t
  misc_feature (1091)..(1091): n is a, c, g, or t
  misc_feature (1116)..(1117): n is a, c, g, or t
  misc_feature (1131)..(1131): n is a, c, g, or t
  misc_feature (1151)..(1151): n is a, c, g, or t
  misc_feature (1171)..(1171): n is a, c, g, or t
  misc_feature (1180)..(1181): n is a, c, g, or t
  misc_feature (1185)..(1185): n is a, c, g, or t
  misc_feature (1196)..(1196): n is a, c, g, or t
  misc_feature (1198)..(1198): n is a, c, g, or t
  misc_feature (1205)..(1206): n is a, c, g, or t
  misc_feature (1211)..(1211): n is a, c, g, or t
  misc_feature (1214)..(1214): n is a, c, g, or t
  misc_feature (1220)..(1220): n is a, c, g, or t
  misc_feature (1235)..(1235): n is a, c, g, or t
  misc_feature (1244)..(1244): n is a, c, g, or t
  misc_feature (1246)..(1246): n is a, c, g, or t
  misc_feature (1248)..(1248): n is a, c, g, or t
cgtgaccatcccccttcgtcttcagcagtgagggtagggaaggaagaattggatgctgaagacgaagtggagggtgtctggaagagaacagtgggagaaaatgggtggatgagtgatgcaaggttttaatgtgaatcctgaggagaaaaagagagacgtgggagtggggcagccatttgaggtggcatatgggatgcatgttgggtcacgtaagtgaataggaaaagaaagggactgaaagcatttaacaggagacaacctcacaaatctgtgggggtgatgaatgctggtcaaggggccaaggtggaaaagtgaggggaatgcagagttctcaaactggggcactgacagatctcatgtgaaaagttggtttcatgaccgtcatcaaggccagactgtaggatcagagcagaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacnaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccacccccgtccccggcccttttttttgtttttttgttaaaacggggtatttaaatcttggattctccttcaagcccttcaaccccgtggttcctcatctttctgngatcaacaatcttttctgtgcctctgtgttcccctttctctcaatctctatagctcccctccaaccggggggggcaggtggtgtggagaagccacaggcctgagatttcatctgctcctccttccgtggagcccagaggagggcagcaaanggggggtggtgtctccaaccccccagncactgaggaagaacggggggctctnnctcatttcaccctnccttttttcccttgcccccnggactggggccacttctggngtggggcanngggntccccagatgngnctcaccnntgagnatngtgganctacaaacaaaattnctattaaantnantttggtgtctcccaaaaatatataataatataacaaatataaatcgcgcggcttttttttcgcgtgggacaaggttaaaatgtggccatggtcattgttccgcaccattttttaaaagggtaagcggggccaatgggatatcgaacgcaga

SEQ ID NO: 482490 - DNA, 127 bp, Homo sapiens
atccattgacatcccctttctcaaagagctggaaattagggactcacataggatctctgagttctctcctgtctgcaacagacctgaatgtgtgcaatgctcttccctgtagtagcattccagttca

SEQ ID NO: 482491 - DNA, 517 bp, Homo sapiens
ctgattctgcgaatttcggcttgtgctggaaatatccaaacccaagtcagatatgggcacattctgttctcagttccggcaagttctacggtgacgagtgagaaacgataaaggtttgcagacaagccaggtgtgcacgcttttatgctctgtcggccagtttcgagcctttcagcaacaaaggccagacgctggtggtgcagttcacggtgaaacttgagcagaacatcgactgtggggagcggctatatgaagctgcttcctaatagttgggaccatacagacatgcacggagactcagaatacaacatcatgtttggtcccgacatctgtggccctggcaccaagaaggttcatgtcatcttcaactgcaagggcaagaacgtgctgatcaacaaggacatccgttgcaaggatcatgagtttacacacctgtacacactgatagtgcggccagacaacacctatgaggtgaagattgacaacagccaggtgaagtccggctccttggaagacg

SEQ ID NO: 482492 - DNA, 1492 bp, Homo sapiens
  misc_feature (658)..(658): n is a, c, g, or t
  misc_feature (1006)..(1006): n is a, c, g, or t
  misc_feature (1157)..(1157): n is a, c, g, or t
  misc_feature (1184)..(1184): n is a, c, g, or t
  misc_feature (1209)..(1210): n is a, c, g, or t
  misc_feature (1224)..(1224): n is a, c, g, or t
  misc_feature (1244)..(1244): n is a, c, g, or t
  misc_feature (1264)..(1264): n is a, c, g, or t
  misc_feature (1273)..(1274): n is a, c, g, or t
  misc_feature (1278)..(1278): n is a, c, g, or t
  misc_feature (1289)..(1289): n is a, c, g, or t
  misc_feature (1291)..(1291): n is a, c, g, or t
  misc_feature (1298)..(1299): n is a, c, g, or t
  misc_feature (1304)..(1304): n is a, c, g, or t
  misc_feature (1307)..(1307): n is a, c, g, or t
  misc_feature (1313)..(1313): n is a, c, g, or t
  misc_feature (1328)..(1328): n is a, c, g, or t
  misc_feature (1337)..(1337): n is a, c, g, or t
  misc_feature (1339)..(1339): n is a, c, g, or t
  misc_feature (1341)..(1341): n is a, c, g, or t
ctcggctctaccttgtctgtgtccgacatggtggaacagacaaggtaggatggtttcatacagcagatggacgcagtacagcatgctggggataaagagactgtggcaatggtggcagcagtgagggtagggaaggaagaattggatgctgaagacgaagtggagggtgtctggaagagaacagtgggagaaaatgggtggatgagtgatgcaaggttttaatgtgaatcctgaggagaaaaagagagacgtgggagtggggcagccatttgaggtggcatatgggatgcatgttgggtcacgtaagtgaataggaaaagaaagggactgaaagcatttaacaggagacaacctcacaaatctgtgggggtgatgaatgctggtcaaggggccaaggtggaaaagtgaggggaatgcagagttctcaaactggggcactgacagatctcatgtgaaaagttggtttcatgaccgtcatcaaggccagactgtaggatcagagcagaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacnaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccacccccgtccccggcccttttttttgtttttttgttaaaacggggtatttaaatcttggattctccttcaagcccttcaaccccgtggttcctcatctttctgngatcaacaatcttttctgtgcctctgtgttcccctttctctcaatctctatagctcccctccaaccggggggggcaggtggtgtggagaagccacaggcctgagatttcatctgctcctccttccgtggagcccagaggagggcagcaaanggggggtggtgtctccaaccccccagncactgaggaagaacggggggctctnnctcatttcaccctnccttttttcccttgcccccnggactggggccacttctggngtggggcanngggntccccagatgngnctcaccnntgagnatngtgganctacaaacaaaattnctattaaantnantttggtgtctcccaaaaatatataataatataacaaatataaatcgcgcggcttttttttcgcgtgggacaaggttaaaatgtggccatggtcattgttccgcaccattttttaaaagggtaagcggggccaatgggatatcgaacgcaga

SEQ ID NO: 482493 - DNA, 552 bp, Homo sapiens
cggactgacgagtctcaacactagtatcatagtcaaaaataaaccaaggccctgagtcctaataactcttctaacaaggatgttttggtgagtattcgcaagggaaggggagcctaggtgctcatgaaaactagttaaagactgggcatggtggctcacgcctagaattccagcacttggggaggccaaggtaggtggatcgcttgatcccaggagtttgagaacagcctgggcagtgtgataaaacctcgtctctactaaaaatacaaaaattagccaggcgtggtggcaggtgcctgtagcccagctactctggaggctgagttaggagaatggcgtgagcccgggaggcggagcctgcagtgagccgagatcgcgccaccacactccagcctgggcgagagagcgagactccggctaaaaaaaaaacaaaaaaagacggcagggccacggccgggcttgggaggatgggggatgggaacggttccatgacccactacagagcaagacccctgggtgcgtgaccccgggacagcagacctggagtatgcg

SEQ ID NO: 482494 - DNA, 545 bp, Homo sapiens
  misc_feature (538)..(538): n is a, c, g, or t
cgtgaccatcccccttcgtcttcagcagtgagggtagggaaggaagaattggatgctgaagacgaagtggagggtgtctggaagagaacagtgggagaaaatgggtggatgagtgatgcaaggttttaatgtgaatcctgaggagaaaaagagagacgtgggagtggggcagccatttgaggtggcatatgggatgcatgttgggtcacgtaagtgaataggaaaagaaagggactgaaagcatttaacaggagacaacctcacaaatctgtgggggtgatgaatgctggtcaaggggccaaggtggaaaagtgaggggaatgcagagttctcaaactggggcactgacagatctcatgtgaaaagttggtttcatgaccgtcatcaaggccagactgtaggatcagagcagatgcaagagcccaggaatatgcggaactaggtccacaggagaatgtgggggatggggacaaatgcctgtgggaatgctagttatgggcaatgcaaagaggcagtgaatccgggcagggagataggntacccag

SEQ ID NO: 482495 - DNA, 525 bp, Homo sapiens
  misc_feature (478)..(478): n is a, c, g, or t
  misc_feature (482)..(485): n is a, c, g, or t
cgtgaccatcccccttcgtcttcagcagtgagggtagggaaggaagaattggatgctgaagacgaagtggagggtgtctggaagagaacagtgggagaaaatgggtggatgagtgatgcaaggttttaatgtgaatcctgaggagaaaaagagagacgtgggagtggggcagccatttgaggtggcatatgggatgcatgttgggtcacgtaagtgaataggaaaagaaagggactgaaagcatttaacaggagacaacctcacaaatctgtgggggtgatgaatgctggtcaaggggccaaggtggaaaagtgaggggaatgcagagttctcaaactggggcactgacagatctcatgtgaaaagttggtttcatgaccgtcatcaaggccagactgtaggatcagagcagatgcaagagcccaggaatatgcggaactaggtccacaggagaatgtgggggatggggacaaatgtncagnnnnggtcgacgcggccgcgaatttagtagtagtaggcggccgc

SEQ ID NO: 482496 - DNA, 283 bp, Homo sapiens
cttgaggatccgtgcgcacatttacaccacaccgcccagctgcccattgtctacaccacacagcccagctgctccactgtctacaccacacagcccagctgctccactgtctacaccacacagcccagctgctccactgtctacaccacacagcccagctgctccactgtctacaccacacagcccagctgctccacatgtctacaccacacagcccagctgctccacatgtctacaccacacagcccaagctgctccacgtgtctacaccacacatgcccaa

SEQ ID NO: 482497 - DNA, 527 bp, Homo sapiens
  misc_feature (480)..(480): n is a, c, g, or t
  misc_feature (484)..(487): n is a, c, g, or t
cgtgaccatcccccttcgtcttcagcagtgagggtagggaaggaagaattggatgctgaagacgaagtggagggtgtctggaagagaacagtgggagaaaatgggtggatgagtgatgcaaggttttaatgtgaatcctgaggagaaaaagagagacgtgggagtggggcagccatttgaggtggcatatgggatgcatgttgggtcacgtaagtgaataggaaaagaaagggactgaaagcatttaacaggagacaacctcacaaatctgtgggggtgatgaatgctggtcaaggggccaaggtggaaaagtgaggggaatgcagagttctcaaactggggcactgacagatctcatgtgaaaagttggtttcatgaccgtcatcaaggccagactgtaggatcagagcagaggagtttggcaacgagacgtggggcgtaacaaaggcagcagagaaacaaatgaaggacaaacaggtncagnnnnggtcgacgcggccgcgaatttagtagtagtaggcggccgc

SEQ ID NO: 482498 - DNA, 343 bp, Homo sapiens
  misc_feature (103)..(103): n is a, c, g, or t
  misc_feature (194)..(194): n is a, c, g, or t
gggacttcctgccacccaagaagataaaggatcctgatgcttcaaaaccggaagactgggatgagcgggccaagatcgatgatcccacagactccaagcctgnggactgggacaagcccgagcatatccctgaccctgatgctaagaagcccgaggactgggatgaagagatggacggagagtgggaacccccngtgattcagaaccctgtaattcagtggtgcattggcatagtcctccgctagattgactaccctagatgatctaagggcactcggtatcctacccgagcatagttgtactaccctcgtgtattctctcgatcccagtatctatgcgctat

SEQ ID NO: 482499 - DNA, 642 bp, Homo sapiens
agcggggcggctccggcggctcctcctcctcctttggtggcggcggcggcccgggaccgatgacccggccccggctcccttcgtactgcctgctcgcgtgtagtgggcttcgattatctggtcactcggaaacgattactcgaaagaaccgaaccaggaggacatcccacagatgcaccagaacacagaatgccagactatatcacagcataggcaccagaagacacagaccagacagactatacggcacaagatttactacacctctgagctaggatcgtcacacaaaaccggaccagcctccatcggagaccgacggtgaagagacccaaggctatgacaaaccaacaagagacagcccacgaaatcaatcatctcaaggaatgtaccgaccaaggcggagacagaccccaggacggacacatcagacacacacgccgtaacacaacaaacaccaccggagacagggacaatccttagcgaggacacacaaggacaggcagcccattggcccattatcaagcaacagagacaacagagacggattcagcaatacccgtccagaagacagggatagaccaacggaaccagaaacagccggaccagcccaccatgacatggcaacgggcaggaaagggaacc

SEQ ID NO: 482500 - DNA, 168 bp, Homo sapiens
  misc_feature (86)..(86): n is a, c, g, or t
  misc_feature (152)..(152): n is a, c, g, or t
gggcactgtgttcagtatgtacaaagggagacggcactgtcacagaggctggggcaggtggggctgctggaggcgaggcctgctgnggcagatagctcacacagtagatcctccgcagctctccgggcgctgtgatcgtgttgcactgaggncagagcttcttggcac

SEQ ID NO: 482501 - DNA, 439 bp, Homo sapiens
aggcagggggtttacaggtagaggcgtagaaagcgttagcgttttcccaaggcttgcggaagtgtaggagtttgtcttagaacgctttttctagacacttgaagaacgtttaagaagattcaaacttatgacccaaatttcctgtaggcttagtttagtcagttgttgcttctgtctggccggggaggcctgacacctcgcggtcttccaggtagaatgagcttcccgtgggtacatcttaccagaaagatatttaccctaacttgttacacaaactattgccacagtacctgtggattgttaagttaactaacatgggtatttctctttaaaggttttgtgcacagaccaaacatatcaccctcagtcttcccagcagtcagatgtggtaactgagactaggacggataatataggttgtgaggtggcaatcaagctt

SEQ ID NO: 482502 - DNA, 472 bp, Homo sapiens
gggtctccgagaagcgtctgggagcattccccccagctcccagctccccactgtgtgccacccctcctggtctcctgcggactgccttcccccagaagctggtctgaaacgtggcgctcagaccttcccctgaacgggaggagaagcccaaagagagcgaggacccagcatcagcctgggaaggcgggctgggagccccatatgctctgaaagcagccaggaagcaagggcttctgccaaaagctatcggaggacaggacccaaggtgacccggcagtgcgggctgttgggctgtcctttggtaggcccaggggaaaggggcatgaggcaggcagacggtgtggcccacgaacggtggggaatacccaggggcccagaaagccctttttcaacagaaggggtgccagggcccttaatgccctcctggtggccctgtcatcctggtgctggctctaatctgcagcatgccaca

SEQ ID NO: 482503 - DNA, 294 bp, Homo sapiens
  misc_feature (15)..(15): n is a, c, g, or t
  misc_feature (60)..(60): n is a, c, g, or t
  misc_feature (107)..(107): n is a, c, g, or t
tgctagaattactgnagttggctataatcaatttgtttaaataattgttgatgttgatgntgttcattgattctataacccagctgttagcagaactcctgaggcgntctgtgtgtgcaatgatgctgttattagaaacaatactctaatggggaagccaacataaggggccttaattgctcttgcaatgaagatgggtcttgatggacttcaacaagactacatcagaaaagctgaatacccttttagctcttagcaaaagtgtatggctgttaagtgtgtacaccgaacact

SEQ ID NO: 482504 - DNA, 299 bp, Homo sapiens
ctgaccggtccgaaacttatagtgcattgtgatgtggagaataaggtgcatacgatgaaaaaggtgatttgtcatttacaagaggtaggtcgaaacagaacatgaaagttggtcggtaggtggcatgcagaggtagtttcaaggtgacaggttatgaagatatggtgcaaaagacaaatggatggtggcaagcatagtaaaatgatggtgtggaagacatagatggtatttgttttgcatttacggcaccggatgcgggcgataatgacggaacactataagtttcggaccggctcgat

SEQ ID NO: 482505 - DNA, 119 bp, Homo sapiens
ctagagggtgttgagggaatagaagtgactgccagtgggtatcttttgggggtgataagttgttctacaattagtgttgtggtggccaggcactgtggctcacacctgtaatcccagca

SEQ ID NO: 482506 - DNA, 1432 bp, Homo sapiens
  misc_feature (1432)..(1432): n is a, c, g, or t
gggcggcgccagcggccagcgaaggaggctgctgcgccagcccgcccgcggcgccggggctcaggcgccgtgacgtgttgcacgcgcttgcccccgaactctgagggccttcattagctcgctccccggcgccgagggcttgggggccgggcagcacggcttcgggaaacttctgggatccgtgtttctccaatactttttctccccccttcatactccgacaagtgctcagggggctcattgttccagaggagttgcggggggggaacttacaagcccctgggcgggcccggagaggaatttcggcaaagggcgcccggggggaaagcacggggcctgggtgtgagcccccgaagggagaccggggggagaacagagggcacttcggggcttcattctttcgggccccgtttgtcccccggttcgttcactcgcacccggggttcacagtggcccttccggggcctccggggagtggccccattcccgtggggccaaaggttgtgtgttgtttgccaacactaagggttgtgaccagcacctgggacacgacattccgggggggaaccaataattaaccctttccatcaaaggcggtgaacttgaccataagtggcgtgggacattgtacccgggagagctcatcattcctgggcaaggtcgttctggcaaggaaaccttcccccattaagggacacggtacgcccaaacccaagcggtgtgggttaacttttttcacaaccaggacaagaacaggacacatttttttcttctctgagcgaaacaacctgtgagcctttcactttttcccacaacacaaggcggtttttggggaacaactccgggcatcggttcccctctcagaacagttgtggcggcgcagcaaccagcactatccacatatatcattaataggaagcagggggggcctccgcaggaagaaagccccaacacgagagaaagcggcttatacacaacataggccagcagcgagtcacgacggggataacccgtggcgaaaacagggaggtttgtcaccagaggagcagacgagagctcgtcctctggggagcaaacaacaagcacctccgtcaggcaacaacattagacaggcaggcgaggcggaagaaaataacaaacgaaaagatgacaatcgaggcgaggcgcgagtactatgagatgcggtcgccccacatacagacagaaggtgacgatcctaccaaaccgacaaaagacagcaacacggaccagatctaccttcgtgatcacgaagattccaaggggaacacagtacaagccaccaagaaacgacaaagacgcaagctagatgagtactgcgcgaatatagctaccttcccccgctccctttttctgtatgttcgcctcctctcttcttttttctccaatctatttcgtgcgaaaggggggagan

SEQ ID NO: 482507 - DNA, 386 bp, Homo sapiens
atcagatccaaactccttagtttctcacgttttggcctttaagatgcggagatcacggggaggccgcatcaaaagtaaggattacacatcaaaggtaaaactttcaaagaactcgccaagtatttcatagcaggccacttggaccactttcatcattttctgtagatctttatattcttgacacaacaacatcctattttggccgatgttaaaatcgaggactcccagagcctctcctgttctctcacgaagtggaactactatatgcgtttctccacaggcagaagccagaacaacttctgaactgtcagtacatttaaagaggaaatctctgaaatcaaaaccaaataagcacaaggatattaaacatctgtctgttcacatca

SEQ ID NO: 482508 - DNA, 237 bp, Homo sapiens
ccgctcatggcatccggactctggtggcggcgcgactctggctccacagcaatccgtcggtgtcggcagccttggtaaagattgcgctcagtatcaggattcctccaccttctctggaccttgattcagtctcctaactgccacagaagggatgaaggttgaactccagctgggatgtcctgatgtggatgggacaaggtgggtttcttctttcttcagccgaggccgccgccgcct

SEQ ID NO: 482509 - DNA, 310 bp, Homo sapiens
gggcgcgcggggctgaccgctcaccgacgccgcgcgcggggctccccctcggtctccgcctcgaacacgatgcgcctctccgccctcagcctcctcctcacgctggaaactcgaggacggcgcggcagccgctgcgacccccgcggcggagccgtagaaggcggcggcggccaagccgagcccgccgggtgcccgcagccgcccgcatctcccgccgccgcggctcctggcgccccgccctacccgcccccgcacgcggcagcggcggcgcgggtcttggggccgctacacgccgggcgcgcgcgttcgg

SEQ ID NO: 482510 - DNA, 619 bp, Homo sapiens
tgtccagaactgaatttcgatggcgaggatggcacgaaaagctgccatcttctatgtactgcagaaccccaattggcgttggtcatcagatccagaggtatcaatggagtagccccaaaggttcgaaaggtgtcccagcttcttcgccttcgtcaatctctcaatggaacctttgtgaagctcaaccaggcttcgattaacatgctgaggattgtagagccatatattgcatgggggtcccccaatttgaagtcagtaaatgaacttatttcccagcgtggttatggccaaatccataagaagcgaattgctttgacagataacgctttgattgctcgatctcttggtaaatacggcatcatttgcatggaggatttgattcatgagatttatactgttggaaaacgcttcaaagaggcaaaaaacttcctgtggcccttcaaattgttttctccccgaggtggaatgaagaaaaagccccccccttttgtagaaggtggagatgctggcaacagggaggaccagatccacaggcttattagaagaatgaactaaggggtctcccatgattatttttttaagctggttggttaataaaccggccctgctttccaattga

SEQ ID NO: 482511 - DNA, 1541 bp, Homo sapiens
  misc_feature (1223)..(1223): n is a, c, g, or t
  misc_feature (1229)..(1229): n is a, c, g, or t
cggtgttgtttttctccggggcacccccccttcgtagatgatttaatatatatttctcttgtagtattcccacgacccaccacggacgtcttctccgagcaaagtatatagatgtctcctgcccccgcccaacagtagatgttgtggtaaacgcacgtgttagtctttagttctctccttcgcggggctagtatatactaggagaccgcacacacacgctttgaggggagaaaaaacccacaataacagggggtaatatttgggttttcctttcgagagtccttattattagaagttatcgtcgtacagctttgggtggccttttcctccatcaaaggggggttattatatatattcctgcgttgggtgtgaggcgccgaccaccccgccccaccaaaaagatagtgtgttcgccaccgctaatggagggtattttattagacccgtgttatgaaatcaccccccccgaggcgccacataattgttgtcgaacgccccctcccccggcgtttccccaactgagtgtttccactttccggtatattttccccccccaccccccggggggcggtttccacaaaacgttaatttttttatagcccttgaagacttctgcccccacccacacttgtcccacccggggagaagcccacataatttgtaagattgggttttttcgcctcgcccaccgctgggctcttctggagggccccccttcttggggagttttccactccctctgtttctctgtggtggcaccgcccgcttatagggttggggccccctttgaagacttcgggcccacctctggttaatatttatgcgcccacaacacgtgcacgtctcaccgcttatggagcacatcctttcgctatactaatcacacccggacacacactggtatgacttaaaacgctttttgtattagcctcacacacttcttcccaccacatatatgggtgtccctatatgccacatatagggagagctctgtgatatttttcgcccacatcacaaatataggagaggcgttttcacatttcacactctgaattttgcccccccatatttctccacaggcgtaccacccccttataggccccacaactctatacccccccagaatcccactcttctacactcatttcaataatttatatcccggcggtaaaatatttataactctttcttttccgcaccacacacacactctttctcgcgcnctattntccggagaattgccccgcacacgcttatactccgcgagactataccccgcagatgcacataacacccaccactgtgaaacactccctcatttcaattctcgttatggctcacattcacattttttttaacacgcacgtaatattaaataattttcactgagatttgagaagccttcgcttcgagaagcggaaaagtcctataatatagtatagaagaaccctccactataaacctggaggtgagctaatatatggagatgcccccccccctaccacacatttgaagaacccgtatacattaaatttagacca

SEQ ID NO: 482512 - DNA, 384 bp, Homo sapiens
ttcctggaccccgtggtttgctgagcacctaggttctgctgacggggaagccctgcaggaacttcagggtgctggtggcctacagcatgctgcagatggtgcgggagcaggtgctgcaggaaagcatgggcggggatgacatcctcctggcctgcaacaacctcatcgaccttgatgctgatgagctgatctctgccgcctgcgtggtttatgctgagctcatccagaaggatgttcctcagacattaaaggatttcttcctctgaggacaccaaagcccgcagtggactgatgccttcgatgggcaggatgaaggccaggggcactggagtgagggagtagataaaacagctgcaatataaacagtcctctggaataaaaaaa

SEQ ID NO: 482513 - DNA, 480 bp, Homo sapiens
ctctaggtgtcctaacggcggccacggcctgccaattgttacttcatatacacaaatcagtgaccacagcctgccacatgggtcgccttaactactagatgctccagtctgcgctccttgcatgaagtgcttcaagataacgacaaggtgtggctgttgcgggatcacaagcgctggaatgaaaccccgcaagtcggtgtcagctgccttcggaataactacccgtgcagcatgccgggcctcagcgtgctacatccatgacaatcagcactggtcgacggcgccttcctggacacctgaatggaatgcagggaacacactgaacggggatgtcctcaaccagctacacgtacagctcatggagcagaggagctgcaaggggttacaagcagtgtaacccccggactcgaaacatgtaccctgggacttaaagatggaggaagctactgagcaatacaggggaccaactgtgggaaggct

SEQ ID NO: 482514 - DNA, 114 bp, Homo sapiens
cgagacattgctctcaaaaaatgtacatcatttttaggtggataaattaaacatagaaattgggtccggctaaatacagttagatgggtaacttagatttatattagctagcat

SEQ ID NO: 482515 - DNA, 492 bp, Homo sapiens
ctaggttgagcgacgtgaagataataagaaaggtatcatctacagcctttacgagggctacgctgaggactttgaccctgccgtcactgaggtacatccatcaggtaggaagttcccccgcagataattcaggctccctatggggcccggatatttggcgctccatggatggcttgatagtacatcgcagctctggctctacggtagggatatttctgttaccccgtctaacaagaatgagccccaatggaagagctgagaactgctgtacgatatgcaaccccattggctctacgctcatggagttaggctgggaagaatggccaccactgggaaggatgccgtgtaagacgtcattcccaccgacattcaccagagggcgccggtgatctgggggtcccccgactatctgctcgagttcctgaatgtgtgtgagaagcactctgtccagtgagcatctgccctgcctgcatccggagaattggctctagc

SEQ ID NO: 482516 - DNA, 404 bp, Homo sapiens
  misc_feature (332)..(332): n is a, c, g, or t
  misc_feature (394)..(394): n is a, c, g, or t
atttttagtagagatggtgttttaccatgttgtctaggctggtcttgaactcctggcctcaaaggatcgcccaccttggcctcccagaatgctagaattacaggcatgagccaccgtgctcggcctgattttttaaattatctgtaagatgaggtcttgctatgtttcccagggcaggtctccaactcctgggattcaagtgattctaccacctcagcctcccgagtagctgcgattacaggcgcccgccaccatgcgcgactaatttttttatatttttaggcagagacgggtcttcgctgtattgggccagggctgttctcaaactcctnaacccttcaggtgatcccaccccaccttgggcctcccaaagtttttgggaatttaaaggggntgaggccacc

SEQ ID NO: 482517 - DNA, 106 bp, Homo sapiens
actgcgccttctaccgcatgagcacagcatggccatcagcactgagcccatcaaccacagctgcactggtttgcgagcacgggcttgcgggatgaaaaaccctgcg

SEQ ID NO: 482518 - DNA, 298 bp, Homo sapiens
tctatgttatgtgcgtgtgcctgttggtgtatctgtatgtccgtgtgtgtgcccatctgtgcatgtctgcgtctgtatgtgcctgtcactgtatgtatgtccatgtgtgtgtgtgtccagctgtgcatgtctgcgtctgtgtgcgtgcctgtctgttggtgtatctgtgtagtccgtgcgtagtatgtactgtgcccatctgtagcatgtctgcgtacagtgtgtagcctgatagctgtgaaatgtctgagtctgtgtgtgcctgtcgctatatactgtatgtccatgtgtgtgtgcc

SEQ ID NO: 482519 - DNA, 107 bp, Homo sapiens
acgtgtaactggcggcatgtgtccccggctcgccagtcgttgcgcgtctgtctctgtaccaagccggccagtgatataccgactgcactgttcatagcgccttgcat

SEQ ID NO: 482520 - DNA, 486 bp, Homo sapiens
gtcatttttttcaaccatgaactcctcttttcttaacatagctcagtcattacagctatcccctttacgttcattaagctgttgagtaccatcttctctaaaatcctcaaactctctgatggaagttgatgatattttaagttctatatcctgaggttccgtatcctgtttttctcagagagaacatttataaagggactagttggggttttatgaggggacaggagagactctgttttggtatctcttggcggatacccaggaaaactccgatccttccttcttacgtatttttaaaatgatgtgtatgttttggggtggctctcggcatgtgagtgcgagtgcccaaggaggatgtacacacgcctggagtggaagctccagcgggctgggggctgatcctctacaagagcaatgtgtgctctttgcagctgagccatctctccagcccaaatcatgtttcctaacagcacatctggtcgacgc

SEQ ID NO: 482521 - DNA, 203 bp, Homo sapiens
gtgcacgtagaggcttactagaagtgtgcaaacgtatgcttggattaaggcgacagcgatttctaggatagtcagttgaattacaattgtgacgatgataagcgtcgacggaaggttaacggttgatattgctagggtggcgcttccaattaggcgcatgagctggagtcctaggcgcagctctaagcctacttattcgagcc

SEQ ID NO: 482522 - DNA, 700 bp, Homo sapiens
ggggggtcattactgcaggaaaaggttttggagagctgagcagtcaagatgtgtgacttcaccgatgaccagaccgtagcaggatcaaagttgaatgggcatcagagctcatgaggtaggcgatggattaaccctcaaatcctgagttggcattcatttgaatccttacagttcaaggaggccttccagctgtttgaccgaacagagatgaatgtgaaggagcaggactttgagcactttttgcccatgctgaagacagtggccacgaacatggaccagggcacctatgaggattatgtcgaaggactttgggtgtttgacaaggaaggaaatggtaccgtcatgggtgctgaaattcggcatgatcttgtcacactgggtgagatgatgacatatgaagaagtacagatgctggaggtacggcatgatgacagcaatggttgtgttaactctgaagagctcgtccgtatggtgctgaatggctgaagacctttctagtctcctcagatgacgggccttatcctgtgagaattggaatttagcctaaagttccctaggctttcttgactgagaaactatcccatcttgtctttttaggatgatgtttgcctgtagcgtttaccaaaatcttgcacctctggggacacaatacggttccctttatataaccatggtgagtcgccttggactcggttatttt

SEQ ID NO: 482523 - DNA, 662 bp, Homo sapiens
gactagttctagatcgcgagcggcagcccggcaaaaaaaaaaaaaaaaaaaaaaaaaaaaaaaaaaaaaaaaaaaaaaaaaaaaaaaccaaaaaaaggaacaaaaaaaaaaaaaagaacacagaaaaacaagaacaaagaggagaccccatatagagaagccgtataaaaaactaacgcaagcgacacggcgtacaaagagttcgggagacagggggaaaaacgcgggcaacccgtggggacaccatgtgtgataaagggaacaccttatactttcgtgggaggtgggaacaaataatgtgggaccaaacattaccataacagcagaatttaaagaactcatagggaaaaaattctaaactttttaaaacggtggtaaaagtgggtgtaaaccacataccctcggaatatctggcaaggcaaggttaggagaagttttcgcggctacactggagatattggattttagtcgaaacattttttattacacccagggggagcctaggggagaataaacagggtgaaaggaacagagcgatgcctccccccgccgtgaacgagagggggggcacctaggaagcaacgaggggaaggagggcggggcggagggggaggagagcactcgcaccccaccaagccgagcggaccggcaacgggaagaaa

SEQ ID NO: 482524 - DNA, 577 bp, Homo sapiens
ctcgcgaacgttatccagaaaacctaacagggaccatcaatgaaagtggctacaataaacaacagattctcaatgtagacaaaacagccttctattggaagaagatgccatctaggactttcaaagcccaagagaagtcaacgcttggcttcaaagcttcaagggctgactctcattgacaatttgaaaaatgctagggcccttaaaaattatgctaaatctacttgcctgtgctctataaatgaaacaacaaagcctacatgacagcacatctgtttacagcttggtttactgaatattttaatcccgtcatggagacccactgcttgaaaaaaaagattcctttcaaaatactgctgacaatgcatcgggttatcacgagctctgacagagatgtacaaggagatgaatgttgttttcaggcctatcaacacactatccattctggagcaaatggttcaaggagtaattctgaccttcaaggcttattcaagaaatacatttcaaggccaggtgtggtggctcatacctgtaaccccagcactttgggataacacgttcgcgaggggtaccgagc

SEQ ID NO: 482525 - DNA, 946 bp, Homo sapiens
gtctgctccagcctgcttaggtgggaaggggctcgtatgtaggcatatgataagtttgacagcccgatgtgccagtgtgaagcatataatatatataactaggttacttccctgaagtgctgcccctgctgattatcctttccaggacttcgatgatggaataggcctgtcaggccgtcaaggaacagatgctgccatccatggatatagtcgtcaagactagggtctcgaaaccagacactgttaatgcagattcccagatgatgttgtgaacttattgaccctagacttactcgctctaggatcatgcatccaaggagtaggagaccggttgtgatgtgggaggattgaagagaaggaagggaatgttggggtaggcaagaggactttttaaactagaaaatactagggaggattatggggagggaaagttctagagtgtgtgtcgcggagtggactgtgcgaggggaacttgagttagcacggtctaactgatgtgttgggttggttaccgtagattgggtcgggtcccatggtaaattccgtatgcacgtttagatgaagaagtctgaagagcaggaggattccatgctggacagtcaggaagtgttgagcacgcgacgggctcgtcaaaacattgagttggatagacccccttggtttgactcgaaaaggtggcgcctgatttgctcagggacggcggtgggcgcgtggtgtagctcccatggctaactttgggcgacggcgtcgagtgcgggtgagaactcgtcttgtagcgctgggagggtcggcagggttcgcagttgaggtgctgccactggcggtcctttggcacgtccaagacctggcgcactggaggcgggtaatcctttcgggaaaaaaggcggtcggatccattcacactgtgttgcccggctcacccacagggagggtatagagcgccgag

SEQ ID NO: 482526 - DNA, 201 bp, Homo sapiens
  misc_feature (22)..(22): n is a, c, g, or t
  misc_feature (57)..(57): n is a, c, g, or t
  misc_feature (151)..(151): n is a, c, g, or t
  misc_feature (164)..(164): n is a, c, g, or t
tcggtcgactggagttgttctncacacaatctacgcaaccattcctagtagtggtgnctaatgaggtgtctgggacagggcggcgtattctgtgaaatgttaggatataatgaataactgatgaatggagtcgcgcctgtatcaatcactnaggtcatctctgncaccttgatttttccggctgatcacagagcagcttat

SEQ ID NO: 482527 - DNA, 131 bp, Homo sapiens
  misc_feature (23)..(23): n is a, c, g, or t
  misc_feature (53)..(54): n is a, c, g, or t
gccggctggtggcgacggcgccnataatgtgtgcccaggccaagaatcccagnntctttccattcagctctgttcccatgaacttcttccgctcccatttgccgtccttcatcgaagccgtcgcctacgca

SEQ ID NO: 482528 - DNA, 220 bp, Homo sapiens
tattaacaatacaagagacaggggacggtcggcataccatagggaaatcttatgaataaatatatgtaaataaaataagaaagagtattgtctccaccgttgtccccaaaagcaacagcaagacatatgtggttagatattttatgtgtaagtgtttgctatagatttaaagagatgtatagccgtgcgcagatgtgtgttttcatagaccatggatagt

SEQ ID NO: 482529 - DNA, 433 bp, Homo sapiens
atgctccgccagatcatcggtcaggccaagaagcattcgagcttgatccccctctttgtatttattggaactggagctactggagcaaccctggatctcttgcgtctggcactgttcaaacccaaaggttttgttgggccagaaaataacccagagccctggaacaaactgggtcccaatgatcaaaacaagttttactcagtgaatgtggattacagccagctgaagaaggaacgtccagatttttaaatgaaatgtttccctataacgctgctttagaatgaaggttttccagaagccccatccgcccaattttccccttaaccaggaaaaatttttcctctaaaagcatgaaatcatgttggagatttcctattgtaatttcttattgggggattccaagtgattaaatcaataaataactgaaacttga

SEQ ID NO: 482530 - DNA, 299 bp, Homo sapiens
ggcttcttgacaggaatattcctggtggtctagaaggagctatgtgcttgtatggagattgggaccacagaatggtgccgactgttgagaccaccttctcctcactctactgtctcacgagggaggctgccagtgctctctacgcatcgactgatcagctgacactctattatctatatataggaggctgatggaagcctatgcctccttacagctttcaggacttgctgagcctggttctgatgatgccactgaccataccactcacctactactttcgactacatagccttgacttc

SEQ ID NO: 482531 - DNA, 864 bp, Homo sapiens
  misc_feature (685)..(685): n is a, c, g, or t
  misc_feature (725)..(725): n is a, c, g, or t
gacagtggctcatgcctgtaatctcagcacttgtgaggccaaggcaggcggatcacgaggtcaggagttcaagaccagtctggccaacatggtgaaaccctgtctctactaaaactacaaaaaaaaagtccaggcacggtggatcacacctgtaatcccagcactttgggaggctgaggcgggcggatcacgaggtcaggagatcgagaccatcccggctaacatggtgaaaccccgtctctactaaaaatattaaaaaattagccgggcatggtggcgagcacctgtagtcccagctactcgggaggctgagacaggagaatggcgtgaacccaggaggtggagcttgcagtgagccaagattgagccactgcactccagcttgggcaacagagcaagactctgtctcaaaaaaaaaaaaaaaaggaaaaaaaaacttttgggccgcttgggcccttggaaaaagttttttaaaccttccgtttgggcgcggggcccgtgggtagtgtgacccttggccatagcggttcccaaggaaatccgggctggatggggttggagtttctccccaattaaaaagcgcgggggaaccggggttcttgaaccaatcccgatggggtccgaggtcatgatggactcttaaccaggagtccaggaccggaaaattatgaccccccgggggganatgaatgagcaaaacacagatagaacacacaaacagacanaaggacgatgacacaaaggcttacaacacaaacacacaaaaaaaggacaacaacaaaaccaaatgaagctagagagggacaaggagaaaaaacaaacacggcaaaaagagagaaagaacagcccttgccactcactcga

SEQ ID NO: 482532 - DNA, 148 bp, Homo sapiens
tcttgattcttctcctccaactgtgcttccatctgtcgtaacctttcttcaatgacgccgtgtctctcttcagcctcggaaagcgctgccaccctctgggccagctccgcctgcacctccgcgagcgtctctgccttcctcagagact

SEQ ID NO: 482533 - DNA, 81 bp, Homo sapiens
gccgaggacacggctgtgtattattgtgcgaatgtgggtgactaccattttcattccgaaaatggccactggggccaggga

SEQ ID NO: 482534 - DNA, 159 bp, Homo sapiens
tagtggacatacttctggtgggacactgtgcgagaaacttgaggatgaaatcagtgagctagcatgcacttgaaaggcatggccatgtctcctcatctatgagtgcaaggtccatcagaccaacagccctgttctagatcaatactcgatgtcacagcc

SEQ ID NO: 482535 - DNA, 371 bp, Homo sapiens
gatgtggacagagtcatatactatatgtttatcacattttttatagtagaagaaaattggaagcaacttaaaatgtgaaaaagaggggccaggcgcggtggctcacacatgtaatcccagcactttcagaggctgaggccggcagatctcttgagcccaggagttcaagaccagcctgggcaacagtgcaaggcccagtgtctacaactatacaaaaattagctgggcatggtggtgcacgcccagctattcaggaggctgagctgggaggatcactcaaacccaggaggcagaggctgcagtgagctgagatcacgacactacactccagcctgggggaccgggcaagactctgtctgtctttaaaaaaa

SEQ ID NO: 482536 - DNA, 148 bp, Homo sapiens
cccgactagccgacaggtgcccgactagcccgacagcagcagagtcttcatcatgcctccaatatctggagtctttgcacgcctcggtcagcggcaccctgtgcccgcgcgctcatacctggcgacgccgccctgtcgggctagtcgg

SEQ ID NO: 482537 - DNA, 1013 bp, Homo sapiens
gtccttgctggtggaagcccaccacgtttctctgaagtctcccccatttagttgataagacggaggtcgtccagcgagcactgatcgccaccaggggccgagcttgtatgatagcagatcactgcgttgtgaggatgctggccgcacctcgtccatacttgcatttggtccccagcgttctttctcgctagcagtcacattgaaggggacatcgtgggacctccgctgggggcggtgcaccaaggacgaagcgactcattttatgtccaacacctgtcttgtcccccatcttctcggtcctcttgtcgcccaccagttcattccgtgggggcccactttctaataggacttactatgcacggagattggaccgtacttgtttcctacgaacttgtgtgggatccgaatggtgcgttgttatctcgctcttttttcttcgttcgggaatttgctgtaagcgctcagtgatttacgatgtgctgtcccaactgtggcgcctacgctcaccaatctctagtcgcgatgtcttcttgcggtgtatgtcgtcctcgaggagatgattggtctgcggagcgcaccattatctcgtcatttcacaccggcgctggggagcggcggctgtccgttcctcatactcctagcctccgatcgctaggcctgaggagacacacacacacacacacacacacacacacagcacacgcacgcacagcgcacaacatcttacctctcatgcgtcgtctttacctctcttgacgtctcagacgtggctcactcgagctgggagtccttaccatcggggagagggggaggttggttccttggggaggccaaagtaaggcagggaagtgcctggagggtaactggggggccaccatgaccccttctctctccagaaacagctgcttctcacctcgatcccagggtctccacccccaacccccagaggtggcccttgtttacagtgagactcggccactgtgtctcatgattcctggaatataaactgtagc

SEQ ID NO: 482538 - DNA, 362 bp, Homo sapiens
ggggggactggttttttatttcaaaaagacacttgtcaattttcattataaaaacagttgcactattgatttttttttttcccaattggccccaaatagacccctttaaaggggagttcattttaagccaataagctgcaggatgtacacctaacagaccttcttaaaaccttaccaaaaaatggggactgggtggggaaggaaacttaaaagatcaacaaactgccaccccacggactgtagaggttgtcacagcctaatggggtggcctgggtgccacaaacccaaaaaaaagtttcaaaataatttaaaatttaaaaagttttttccataagctttttaagattttttcagcactgact

SEQ ID NO: 482539 - DNA, 632 bp, Homo sapiens
  misc_feature (113)..(113): n is a, c, g, or t
  misc_feature (150)..(150): n is a, c, g, or t
agcggggagtctcgcggtgctgccgggctcagccccgtctcctcctcttgctccctcggccgggcggcggtgactgtgcaccgacgtcggcgcgggctgcaccgccgcgtccncccgcccgccagcatggccaccaccgccacctgcacncgtttcaccgacgactaccagctcttcgaggagcttggcaagggtgctttctctgtggtccgcaggctgtgtgacgaaaacccccacgcaggagctacgcagcagaaatcatcactaccaagaaacttgtctgccccgcggatcaccagaaacctagaaccgctgagcgctcgcgcatatgtcgcacttctgaaacatccaacacatcgtgcgcctccgatgaccagtatccctgcaagcaccgggctcccactacctcgctgtctcgacctctgttaccgcgcgcggacctgctttgcagcacctcgctggccagagcagctactacactctcgaagccagcatgccagcccactgctactacgatcacgacttctggcacgagtgttaaccgagcatccaccagccatgacgatcgtccacagtggaccctgaagcctgcagaacctgctgctggcgacgtaaatgcacgggtgccgccc

SEQ ID NO: 482540 - DNA, 239 bp, Homo sapiens
taaaattgggaatcacaagagggtattaaacgggctctgagaaggacaataacaagatacaagcctacatttggagaaacatctgttggctgaggaaggaagattatcccaaataacagcaaaacgtgggttctgggaataccagttcatatctagcatactaggcttaggatgggtaaccaggatctagtggcctcgtgccgggggatccctctagaagtcagacctgcgaggcattg

SEQ ID NO: 482541 - DNA, 840 bp, Homo sapiens
ggctctcgccaggcgtcctcgtgcaagtgacatcgtcttggaagccctgcgtggcaatccctgacgcgccgccgtggatgcccagcggaagacaagggcgacctggaagtccaaggcatactgtccattgaacgcagcatccatctattagggatgatgtatccgacaagtgtttcatgtgtgggagcagataatgtgagctccaagcagatgcagtcatgatccgtcattgtcccttcggcgggaaggctgtggtgctgatgggctaagaacacactatgtatgcgacacaggccatccgaggggcaccatggaaatacaaacccaggctctgcgtagaagaactggtcgtgtgctcatcattctgtggggggtgtggcgctgttgttgtgcaccaatgggggacctcgctgcgatcatggcacgtgtcgctgggctgttgaggtgccctatgctgtccgtgcgggttgccattgcttccactcgtgggagttcctgtgtcctgcccaggatctattggtcgtcgggccctgagagaggaagctctgtttgggcatccgctgtagggtagtcatccaacatgaaactctcccgggggcgaccaccagttgactgtcctggaggtgattgtggcaaggttgagatccagatggggagacgcaagagtgggaagcccagactgaaagtcgacagcttgcgtgaacagtggtcaaaatctcccccattcttccgtggggactgggtcgtgccagccacggcgttcaacgaggggaaggaattcaagaacctgaaaggggtgaatatacaggggaatcctggcatcggggacctggaagggcc

SEQ ID NO: 482542 - DNA, 135 bp, Homo sapiens
gtaatagaattctggacaatggtgatatgctgtggtacttgccagggacaatgttgtgtctgtggagcctggtgctgctgtggagaagctgtagattcctgactgacgcctggcatggtggtactgccagtggaa

SEQ ID NO: 482543 - DNA, 439 bp, Homo sapiens
  misc_feature (430)..(430): n is a, c, g, or t
ccccccttgggggttgcccccttttttcccggggtgttttttttttttcccaaattttttttcccccccggggggttttttttcccccctttgggaccctttaaaaacccattttttggggtttttcccccccccggtttttaagggcccccttccacttttcccccttttttcccaaaaccctttttcccgggggggcccttttctttcccccccccccccccccttttgggcccccaaaaggggacccccccagggggtttcccccttccccttccccccttttaagttttcccccccccccccctttgttttctggggttaaagggacccttttttgggtaaaaaccttttaaaccttttcccccccccccttttttttaaatttttaaaaaaaaaaaaaaaaattttttttttttaaatttttttncccccccca

SEQ ID NO: 482544 - DNA, 115 bp, Homo sapiens
caaagagatggatctacgaaggcgcctctgatgggacgagtgggcacgcacactgatttgaaatacatgtgtgagtggctataagacctgatggcatgagccccctatgaggacg

SEQ ID NO: 482545 - DNA, 240 bp, Homo sapiens
gccttagtggaactgctcggatccacgttgactctggttagtgtcagaattgaataggaatgcgggacagtcagccggcgtcagccgcttgctgtggataacccacgcgcctggggtcggaagtcttgtgtgagagcaaaagaaaacacagtgagttttttcttaggcatacactccacacacacacacacacacacacacacacacacacacacatatccggaggcagttccatttagg

SEQ ID NO: 482546 - DNA, 235 bp, Homo sapiens
  misc_feature (48)..(48): n is a, c, g, or t
acggcagtgaatcgagctcgtgtgacccggatcgtggacgtctcccangcctaagtacagagcgagactccatctcataaaaaaaaaggaaaaattaggtataatatttggtgtaggttctgtaaggttggctttgctttatttaagtggttaacactagacctgtaaggtaggtactgttttcttcccccttctaaacacttaggaggtttagagactccagagactccacgtt

SEQ ID NO: 482547 - DNA, 117 bp, Homo sapiens
cacgaggcctacgactacttgtgccgccgcctcacggctgaggacctgtccgaggctcggatcatctctctcagagacctagaatctgttccgggagggtaccaggatccatccgtg

SEQ ID NO: 482548 - DNA, 378 bp, Homo sapiens
ttttttttttttgagacggaatcttgctctgtcacccaggctggagtgcaatggtgcggtctcagctgactgtaacctccgcctcctgggttcgagattctcctgcctcagcctcccaagtagctgggactacaggcacccaccaccacacctggctaatttttttgtatttttagtaaagacggggtttcactatgttggccaggctggtctcgaactcctgacttcgtgatccacccaccttggcctcccaatcttattttgcttacaagtcctgcttcagggttaccttcctgaccactgctgcctcctcccagcattgccagggacggcattgcatagtttattttctgttttgttttttttgcgttttgtttt

SEQ ID NO: 482549 - DNA, 698 bp, Homo sapiens
gatcgtttctagactcgccagtgcttcccagaacccgatgtggttcagtagaggcttcttccatggaagctgccaatatgtgtcccacctgccggcattagacctggggcacctgattgcttctgcccgccccaggatgcttgccccaggcctctcccatccatccaggtcacctcctccctagaccttctcagcagcccctggcttgtctctgagctgcgggctttctgttcctggactgcccttcaccctgtccccagagcctcctcagcactgatctgattttgtcactgcattcctgtgcttgtaagcctgtgaccagcaatactgtcacttcttagaaaacattttggcctcgacacggttcacacaggcaatgccccgccatcattgcttccaattgtgttcgacgggaagcagacagtggcagcgacggctcttggtgctcacccagacctcccttgctgggaggttgccccaagaccctgcagcctgttactgatggaggcaggtacacacatagccatccccttgccctccctcagggaccagctgtgaagtacagtgcgtgcgtgcacttccagatggcattcgactgcagctggtctcagttgggacacatcagtgcctctcgtctccctaccccaggcacttcctcctcctctattacctcatgcccccataatcccacgcccgcc

SEQ ID NO: 482550 - DNA, 334 bp, Homo sapiens
aagggtcccgcatacgtctctctcttctacaaaggtgtggcagagccaggaccagtgagggctgctgtgcaggagtggcctgagacaatgcgctgtccgccgtgagagatgggctccgaagaaacgggcccagaggccctgaactcaagcgcgtggtgagaggcgtggacatgtgcatgtgaggggtcctcacggccaggaggagaatttgagggccactgtgctctagttagcgttggcatgaatgcaaggacgctttacttccagagcaaaagaggatttgacctcagcttgtcaaaagtgccacgtttgtactcccagcatgtaagccatc

SEQ ID NO: 482551 - DNA, 398 bp, Homo sapiens
tacgtatctagagaaagtggtagctaggctgtacaaggaagggctctgtgagaaaggggatggttggctgggtgtggtggttcacgcctcatatcccagcactttgggaggttgggagtttgagaccagcctgaccagcatggagaaaccccgtctctactaaaaatacaaaattagcccggcatggtggcacatgcctgtaatccaggctacctgggaggctgaggcgggagaattgcttgaacccgggaggcagaggttgtagtgagccgaaatcatgccactgcactccagcctgggcaacagagcaagaccccatctctaaaagtaataataataataaagttgtatgtttcaatgccttgatatgtttatttcactaggatacagtagggaga

SEQ ID NO: 482552 - DNA, 534 bp, Homo sapiens
  misc_feature (77)..(77): n is a, c, g, or t
  misc_feature (279)..(279): n is a, c, g, or t
  misc_feature (288)..(288): n is a, c, g, or t
  misc_feature (290)..(290): n is a, c, g, or t
  misc_feature (302)..(302): n is a, c, g, or t
  misc_feature (318)..(318): n is a, c, g, or t
  misc_feature (323)..(323): n is a, c, g, or t
  misc_feature (327)..(328): n is a, c, g, or t
  misc_feature (343)..(343): n is a, c, g, or t
  misc_feature (350)..(352): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (370)..(370): n is a, c, g, or t
  misc_feature (374)..(374): n is a, c, g, or t
  misc_feature (378)..(378): n is a, c, g, or t
  misc_feature (380)..(380): n is a, c, g, or t
  misc_feature (387)..(387): n is a, c, g, or t
  misc_feature (394)..(394): n is a, c, g, or t
  misc_feature (400)..(400): n is a, c, g, or t
  misc_feature (410)..(410): n is a, c, g, or t
  misc_feature (412)..(412): n is a, c, g, or t
  misc_feature (418)..(418): n is a, c, g, or t
  misc_feature (425)..(425): n is a, c, g, or t
  misc_feature (452)..(452): n is a, c, g, or t
  misc_feature (455)..(455): n is a, c, g, or t
  misc_feature (457)..(457): n is a, c, g, or t
  misc_feature (460)..(460): n is a, c, g, or t
  misc_feature (466)..(466): n is a, c, g, or t
  misc_feature (470)..(470): n is a, c, g, or t
  misc_feature (492)..(492): n is a, c, g, or t
tcgccggggccggggacccgcggtccgggcgccatgcgggcatcgctgctgctgtcggtgctgcggcccgcaggccngtggccgtgggcatctccctgggcttcaccctgagcctgctcagcgtcacctgggtggaggagccgtgcggcccaggcccgccccaacctggagactctgagctgccgccgcgcggcaacaccaacgcggcgcgccggcccaactcggtgcagcccggagcggagcgctgagaagcccggggccggcgaaggcgccgggganaatttttancngcgcgtctttcnctaccacccttcacancccgnccannccgccaaaaaagccnttattannntntanatnatcacttatntttncatnangcatatncttcttnttgcgntgcttacctntntatatnactcttnccactctttttttttctctttaacttntantnttnttttantttntgggagcgtgtgggtgttcctngacgtggcgcacgggggccgccgcggccccacctgggcatgg

SEQ ID NO: 482553 - DNA, 314 bp, Homo sapiens
agccatcaccagcatgaatgtgttcgtagggcctttgagtgtggcgattgtcatattctgttggataacaatgtattggggtggtcgattgtcatgggggcagggggagaggggcagtacacctggagggaccattttggtccacatcgacaccatcagtcttctcttagaggatgcccttgagtattcggcgttgatttcgggcacccaaatcagactttccacctcggactgtcgaggtgcagacccttggagcaccacttgcccatctcttacacaggctgacccatttcttctcgggggttcagaggctc

SEQ ID NO: 482554 - DNA, 235 bp, Homo sapiens
tatgtgcagaagatcacctccaactgcttcattcctcacgtcgtctcctttcatgggtacgtgtctcctgggctatggacggggctgcagccactcccgagcccaagatggagcaccccagtggcctgcatgcccacacatttgcctaccaaacgtctgcccaagggagggagggcgcggaacccacccatgggcaggggtgatcttctacacgataaggtgatcttctgcacga

SEQ ID NO: 482555 - DNA, 911 bp, Homo sapiens
gtgccagcgtctgcattggtgggcagcgacggcctggtcgctttttaaaacgcgttcttggcagtgttgtttcgcccccttgtgcccccgcggtccccgacgttatgatgtgatttaacccccctttgtggtgtaattctgtgggggagaaaaaaccacggctgcgcgggtgtgttttatatataatctgtccgccgctggtatataacctctcgggggtcccccaccacccacattgatgggtggggtcgcctccctccgttgttggttaatccccgcgggtgatttgtgcgcctctccccgcccgccccgccctgtgtgttgagagccttttcttcttgttttggaggaatatctcttttttattggttttcgcccccccacatgtggggagtgatgaatgctctcctccccccgtctgggtcctccccctgtctttttttttagaacggcccccctgctgtttgtttatgataattatcgccccccctctctggtgttgttttaattgagaagagagggtgatcatcttttgtgtcacaagaaacccccccccccctcctgttggtgctgagggcgcccccgccctctctttttttaaatagatcacctcttgaataccacaaccctctcttttttcacgaaacccgcccgccagctcatttaagcgggctgctctgtatagggtcacccccccaatgataatttatttgttgtattggtgggttgataaacaagagccgaggggggggtggggtagaccacgcgagcaaacaaccacaacccgcagtgtgtgtgtgttaaaaaaatatattctttagaaagggttttttttttaagggggcccccccttttttttttccccccgggcccgggccgccctttttttttttataaacttgcccccccca

SEQ ID NO: 482556 - DNA, 556 bp, Homo sapiens
ccttcatcatacctaccaagactaagtcatgatgaaatagagaatctgcagagacaacttgcaaggagactgaatcagcaatcagaaatctcccaaaaaagagaagtcctggtcctgatggcttcactggtgaattctactaaaacgtttaaagaactgaaccaacactaatcctcctcaatcttttccaaaaactgaagagaagggaacaccttctaactcattctatgatgccagcattaccctaatcctaagacagacagacactgcaagtaaagaatattataaaccaatatcaccttatgaacacagatgcataaatccttaggaaaatactagcaaaccaaattcagcagcatatgaaaaagattatataccatgaccaactgggacttattcatgaatgtaatgtgctcaaaattaaaaaatgcaaatggtagttcactgtgggtgattttttttctttgtatttttctgttgcataaatgtccacaaaatagaatattttattttttacatttattataaagggtaggtatgatgaaggacgggtacc

SEQ ID NO: 482557 - DNA, 243 bp, Homo sapiens
  misc_feature (221)..(221): n is a, c, g, or t
ggcgaaggttactatgcggcggatcatttacgtcacgcattaaacctgctctgttacccgtgctctcttatatgggccccgcatttgtcggcattattaccggttctatggttatcgaaaccattttggtttgccggggattggacaacgttcgttaatggcgcattgaaccgtgactattccttagtgttaagcctgaccatcctgggtggtgctttaancattttgtttaatgcattgtcg

SEQ ID NO: 482558 - DNA, 220 bp, Homo sapiens
aggatccccaatgatgcgtcctcagtctgcatgtcttgtggatgaatacatcattgtctcctgccatggtcatctgactgacaccaatatcacacggacgtgctgtttgtgagacatgatggctcgatagctctcaaggcagcgagctgctcttcatgaagaagaaccacgacgaggaagtataaggcctacaagcccagattggcgagggacttggttg

SEQ ID NO: 482559 - DNA, 847 bp, Homo sapiens
atccggtgaggagaaagaaagacgtgccgttattgcccccgaatatgcgggtgacatagccatagaagggtgtgggccagccccgttccccgtggataatcttcgcgttgaaacgggcacccacaattggggcccttgccctcttaactctgcacctttctcttggcgggttccagaactcacaccatgtagtgcgcaagcgcacagctgtttgtagacaccaaattacatgtgagaagtcggttgctccgcgtctcggtcaacaaggtatgtccgagcagctaggtctctaagcttgaccgctccagcggtgggcatgagaccgtttggatcgcgccgccactttcccccgcggttgctgaggtctacattgtgcagacagatcatagagcccatgctgccacaagagactgttgtggagaaaaatacgtgacaggggaagccccccacagggcttgtcaaattgcgcgtcagtatacatgagcactgttcactgctagactaacaccacaggggttttatgttctatgggtcaggttcacgagatctagaataagggagattctttataagacaatttgtatgtacagttagctcaaagatattgtgtacatcgaagttcttgtcgagagatagacacaacaggcgtttactgttgaacagcactaatcaggaacatgggtgttacaccattgaggaacacttctccgagtcatagcctgctggatacagtgacacgcatatttggcaagacagccctgctgtctcccctctccggctatgggatagatggaatcaccaggcgtgctggtcatgacaacccataaaccctgccttgggaaagcgg

SEQ ID NO: 482560 - DNA, 237 bp, Homo sapiens
agtccattaaaactcattatcctttataaatcacccagtctcaagtatgtcttatattagcagagtgagagcagactaatacacatactcaacctagggggatttaagcccccacacacattggcaatgtctggcacacacttttctggttgtgaacactaaaggagtggacagggggtgcatattggcatcaagtacatagagctcagcgcatgctgctcccacacccatacaatg

SEQ ID NO: 482561 - DNA, 270 bp, Homo sapiens
ctccttgcggccgcttacagcgttttgttactgattttgaacaacaaaccggaatggaaatttattagcccggtactaaaacgctcggcaaagtcgcgattattggcgcaggtcctgccggattgcaggccagtgtgacactgacaaaccagggttatgacgtcacgatttatgagaaagaagcgcaccccggcggctggttgcgtaacggtattccgtaattccggataccgcaatcagtgctggatgcagagatcgtccgtattgaaa

SEQ ID NO: 482562 - DNA, 176 bp, Homo sapiens
cccgcactcagtcagctcatgtataacgaggtatactccttaaggcaacgtttctcctccgtcagtgcaatttatggctgatctctcttacgttagttttctcatgttataatgagcactgacatttgtggctacggctttgctcacattgaggtaccgcggctcgtaattctgta

SEQ ID NO: 482563 - DNA, 472 bp, Homo sapiens
cagcagaatgctggttagaactccagtactacattgaatagaagtggtgagaatgggctttcttgctcttattccagttctcagggggaactgcttttaactttctcctgtttagtattatgttcggctgtgggtttgtcatatgatggcttttattacgtttaggtatgttccatctatgttgactttggtgagggttttaattctaaagggatgtttgattttgtcaaatgctttttctacatctattgagatgatcatgtgattttagtttttaattttgtttatgtggtgtatcacatcaactgacttgcgtatgttaaaccatccctgttatgaaacccacttgatcatggtggattatctttctgatatgctgatagattcagttagctagtattttgttaagaattttcgcatctgtattcatcaggactattggagtgtagttttctttttctcttcttgtttt

SEQ ID NO: 482564 - DNA, 128 bp, Homo sapiens
cctgcaactgaaaatcccagaaatcaacagcagtgctatgtcggccacgtcacagcccctctggcctgtgtgcctagaggcagcagcattgtgcccactggggcacgaactcacaactgcgtcctggt

SEQ ID NO: 482565 - DNA, 302 bp, Homo sapiens
  misc_feature (21)..(21): n is a, c, g, or t
  misc_feature (28)..(28): n is a, c, g, or t
ggcgctagttggaatccccangcgttgnggtagtgtattgaaggtattcaatcctgtaggagaccggaatatgctgattacatttcactccaaggtcgtggccgaagtcctgatgcttacctgaccatgctggtgccctgctcccaggccgtgggcaatgtccttcggcgacaagattcccgaacgcggcgtgttcaccgtcgaccagctcggtcctggccatccagtggcatcgaacgggccatcgaagaggcccagggcacccacgaagaggacgaggaagacgaggacaagccgccggt

SEQ ID NO: 482566 - DNA, 187 bp, Homo sapiens
ctatctcatgcaacagcttcggcttcatcctcctcgagacgctcaaggtgggccttcagacagggcgtgcaggagcggagttcactgttctcctcctccagtgctgtagccgggtctgcaggttctcgatctcaatgctcttctccctacggtatcctacacctctcatagacaaggtagagccgag

SEQ ID NO: 482567 - DNA, 498 bp, Homo sapiens
ctatcttcaaaatctggaagtgaccgggcacaatggctctttcctataatcccagcaccttaggaggccgaggcgggtggatcacttgagctcaggagtttgagaccagcctaggcaacatggcaaaaccctgtctctacgaaatatacaaaaattagccggatatagtggcgcaagcctgtgatcccagctacttgggaggctgaggcgggggtatcacttgagcccaggaggcggagtttgcagtgagccaagatcacaccactgcactcagcctgggtgacagagcgagactctgcctcaaaaatagaataaaataaaaataataaagtctattaatttttaaaatatattaattgagccgggcgcggtggctcacgcctgtaatcccagcactttgggaggccgaggcaggtggatcacctgaggtcaggagttcaagaccagtttgaccaatatggtgaaacctcgtctctacttactaaaaatacaaaaatt

SEQ ID NO: 482568 - DNA, 749 bp, Homo sapiens
ctagttaccattaatttagggacctggtatgatatggctccacgacgtggttctcgctgtctcttacttttaaccagatgaacattttgatctggccctgatgccaatcatgtgcagtggcatgacacagccaagatgacaagaccctatggtgctttaagtatattgaatgcggaaacttagtacctaacttaaacccactaggtcctaaactatctaaacctgctatttagaaatttcggttgtggcgacctgcggagacaggatagccctgtctccgatctgttacatgctacgacttcacctagctcacaagtcgtatctacatatatcgtcaaattgattctcgaaatacacccttgtaccaacggaacatacggattattcctagtggataagcaagtcgactacattcctatatctgatagtcgcatatcgaacgaatagggtttacgatctcgatgttggcatccaggacatcccgatggtgtagccgctattacgacggttcgttctgttcaaccgtattacacgtcctacgctgaatcttgatttgccgaccgtagtaactccaatgtcggtaggctatctacttcaaatgtcctgcctgttcgaaaggactcgagaagcttaggcctagttcacaaagctggcttcccccggtatgatgattatcatctttcaacttagttattttacctaagccaaccaagaacggggttgtcatgatacgccttatataacgggtg

SEQ ID NO: 482569 - DNA, 160 bp, Homo sapiens
gttcaaggacaactttgatgagatggacacatccagggagattgtgcagcagctcatcgatgagtaccatgcggccacacggcagactacatcttctggggcacccgggtcagtgtggtccccaggtcagggtccctcatctgtcttgctggttggtcca

SEQ ID NO: 482570 - DNA, 514 bp, Homo sapiens
cgctggtggcagggtctgcctgtgcaacccttcctgcgtgtatttaggccccggctccttcatggagggtgaatatcccctctcagctcagtggtaaggtctgtccccctccagctccattccatgattcctctttcccaggctgtagctgccgctgtttgtgggggaagggccagtgatgggtctggagcgaaggccaagagtggggcacctgggggaaggtatgaggtccctcccaggatcagactgtctcgaaatgtcatctgccttgggaggccaaggcgggtggaacatctaaggtcaggagttcgagaccagcctggtccacatggtgaaactctgtctgtactaaaaatacaaacattagctgggcgtggtggtgggtgcctgtaatcccagtgactcaggaggctgaggcaggagaattgcttgaactcaggaggcggaggttgcagtgagctgagatcgtgccattgcactccagcctgggtgacagagcgaaactccatctcaa

SEQ ID NO: 482571 - DNA, 163 bp, Homo sapiens
ttatctagtgttgttctaattttgggtctgctatgtgatccaatgagcccaaaagagtaacatgccctcaaaggatagagaacaaaaaaaggaaacagcaacacaaaggaaaacataaccttcccaattgagaccttactcagcgtgatttcttgtcctaaaa

SEQ ID NO: 482572 - DNA, 465 bp, Homo sapiens
tactgtgattgttgacaagatgcagattgaagcacgaggaggcatcatggcgatgaagactaacgacaagactaagcgagaaggggatgtccacttcgactatgatgagacctggactatcggagatgagcaggacacagacctgctgcaggtggcagcccatgaattaggacaggatgctggggctgcagcacaacaacagcagccaaggacctgaatgtctgcttctacacctttcgatacccactgaatctcagcccagattactgcaggtgctgtcaacacctatatggccagccctggcccactgtcacctccaggaccccagcccttggcccccaggctgtgatagacaccactgagattgcaccgcttgcgccatacgccccgcctgattcctgtgaggcctcctttgacgcggtctccaccatccgatgcgagctctttttcttcaaagcgggcctt

SEQ ID NO: 482573 - DNA, 520 bp, Homo sapiens
  misc_feature (183)..(183): n is a, c, g, or t
  misc_feature (266)..(266): n is a, c, g, or t
  misc_feature (288)..(288): n is a, c, g, or t
acatgctgtgtgcggggaacacgggaaggactattccagggcgattcggaagggcccctggtgtgaaaggtgaatggcacctggcttcaggggggcgtggtcaactggggcaagggctgtgcccagcccaaccggcttggtatttacacccgtgtcacctaatacttggagtggatccaccantatgtccccaaaaaaccgtgagtcaggcctggggtgtccacttgggtcattggagagccagcccctcttgttcaaaaaaccantggttcctacccaggtggggantgcgcccccacacctttcttgccccgtcctgagggccccttcctgtcctaagccccctgtttttttttgagccccttcccctgttttgaggacccttccccatcttaagcccccttccctgttttaagcctgaagcctggaccgggccctccggccctcccctgcccaggcaattggtggtgggggctaatcctcctgaggggtggccctcattaaagggcatggaaatcca

SEQ ID NO: 482574 - DNA, 138 bp, Homo sapiens
gccgtgagctgagattgcgccattgcactccagcctgggatgcagcgcgagactcacaaaaaataaataaaataagttaactaatagttgaacagacacaactttgactaagaatacacggtcaacttgtctggagta

SEQ ID NO: 482575 - DNA, 409 bp, Homo sapiens
ctagcattagaaatgagagaaatcagccagacacggtggcgtacacctgtaatcccagcacttcgggaggccgaggcgggaagattgcttgaggccaggagctcgagaccaaccctgggcaacatggtgataccccatctctaaaaaaaaaaaaaaatttaccctggcttggtggtgtgccccttattgttcccagctgcccaggaggctgaggcgggaggattaccacctttaaaaccaggaggttgagactgcagtgagccattgattgcaccacgtgcaccccagcctgagcgacagagtgagactctattctcaaaaaaaagaaacgaaagtgaagaacgctttctgcccactgatgctctaagactcctggcagcaggtttgagtgaatgggataccgacctcg

SEQ ID NO: 482576 - DNA, 123 bp, Homo sapiens
ctcgctctgagtatccccgacatgtaagccaaccgctggatgggtgggtggtcaaaagggaaggatgaggctccctgtggtgccagcaggtctggtgtagaacatggtgcagaatagactgcg

SEQ ID NO: 482577 - DNA, 749 bp, Homo sapiens
gggatgtcgtgtcccagactttggcaccgtcggggttcgtcgttccccgtaatgtgacagcatcccgcccctgtgctgctgcccaggagtccgccggaccccggtctcgatatgggagacctggaactgctgctgtcccggggaagctgaacgtgctggtgcggggtctgcgtcacgcttcccgctaacgcgagatgggctaccgaagggtggaaccgagttagcatgagaacctgggcagaagctgatcatgcagagcgcatcctcgagtgtccacagtcagctcatggtcgagcccattcaggagctgctggtcacccatggtaaggttccaacagctggtggaggagctgatcgcaggtggaagatgtcggaagccatgcacaggtgttccctgtagtactgccagggctggaggacgttcaaagtcctcgcagataaaccttactcctcagtctaaaatggtgggagcaccaacggagggctcgtccatcgagtcaaaccttcttggagaccacgtgttcttcgcactacaggaggtgtgatgagatcacgcagtaagacactgttctttggacgttggtagtactattgtgcatccggtagaactgacccatgctggtggccccagaatgcgctgtggagagccctcacttgagaatgcaggggaatcccgaggacagtaaacctcatgcaggaagcatgcagaaataggaagagctgatggaatcgaaaaatgcctgaaggtc

SEQ ID NO: 482578 - DNA, 310 bp, Homo sapiens
  misc_feature (180)..(180): n is a, c, g, or t
gctttctacaggagatctgcaagtcagagtgtccatcttcatttccttttccttgtattatttttgccaagtctctgaggccttgtagacagctttactcctgcataccaattaaaaggcaacaggagggtgtaagcggagacatgaaagtaattctcgcttctgtggaatccagccagnagcatcctacgtgctaacgagctaagaatggataactaacaagcatgcctataatgtgtgcggaacgagtaaatgctttctacaagagcctcatgagagcttgtggaaacataattacaagggaaaacgg

SEQ ID NO: 482579 - DNA, 243 bp, Homo sapiens
aggattcgaatcatgcgttcaacagctctagcatctgaggataggaggagctgatatgaacgccgagcctctacctgtgcagcggaatgccatgtcggctgccgatcagaagacaacccgagaagactagcccagtgccccaatcaagcccaccaacacttgacattggaggaaggacaactataattaccccctgatcacagtggactacctctcctcctccccaacctcgtccgagcggag

SEQ ID NO: 482580 - DNA, 217 bp, Homo sapiens
cacgaggaggattgatgatctcaacctccagtcagctgtattgattcaaaggagaaaatatcctatgtgagatatagattcaaatacaaaggatatcgtctctgattcttactaagggcagcctgaaattcctaatgcattattgcataaattatttgaggtcagggattgtttttaaaatccaagaatgagccggatatgatggctcatgcatgta

SEQ ID NO: 482581 - DNA, 202 bp, Homo sapiens
attaccagttactcttgtgaccccccctccccccaatcaaacaagcagttttgcattggacgttggctgggtgtcttccaagctggctcagttgtgaccactctatacttgagcatgctgtcagatgccacaggttggggacctcaggctgtttcatgtgagcttttgaccaagcatcctaagttggcattccagtcgacgc

SEQ ID NO: 482582 - DNA, 716 bp, Homo sapiens
  misc_feature (9)..(9): n is a, c, g, or t
  misc_feature (12)..(12): n is a, c, g, or t
  misc_feature (29)..(29): n is a, c, g, or t
  misc_feature (32)..(32): n is a, c, g, or t
  misc_feature (57)..(57): n is a, c, g, or t
  misc_feature (60)..(60): n is a, c, g, or t
  misc_feature (67)..(67): n is a, c, g, or t
  misc_feature (76)..(76): n is a, c, g, or t
  misc_feature (80)..(80): n is a, c, g, or t
  misc_feature (83)..(83): n is a, c, g, or t
  misc_feature (85)..(85): n is a, c, g, or t
  misc_feature (88)..(88): n is a, c, g, or t
  misc_feature (92)..(92): n is a, c, g, or t
  misc_feature (106)..(106): n is a, c, g, or t
  misc_feature (111)..(111): n is a, c, g, or t
  misc_feature (115)..(115): n is a, c, g, or t
  misc_feature (120)..(120): n is a, c, g, or t
  misc_feature (124)..(124): n is a, c, g, or t
  misc_feature (127)..(128): n is a, c, g, or t
  misc_feature (130)..(130): n is a, c, g, or t
  misc_feature (139)..(139): n is a, c, g, or t
  misc_feature (150)..(150): n is a, c, g, or t
  misc_feature (152)..(152): n is a, c, g, or t
  misc_feature (160)..(160): n is a, c, g, or t
  misc_feature (164)..(165): n is a, c, g, or t
  misc_feature (191)..(191): n is a, c, g, or t
  misc_feature (205)..(205): n is a, c, g, or t
  misc_feature (212)..(212): n is a, c, g, or t
  misc_feature (246)..(246): n is a, c, g, or t
  misc_feature (249)..(249): n is a, c, g, or t
  misc_feature (268)..(268): n is a, c, g, or t
  misc_feature (271)..(271): n is a, c, g, or t
  misc_feature (281)..(281): n is a, c, g, or t
  misc_feature (295)..(295): n is a, c, g, or t
  misc_feature (307)..(307): n is a, c, g, or t
  misc_feature (326)..(326): n is a, c, g, or t
  misc_feature (334)..(334): n is a, c, g, or t
  misc_feature (366)..(366): n is a, c, g, or t
  misc_feature (380)..(380): n is a, c, g, or t
  misc_feature (383)..(383): n is a, c, g, or t
  misc_feature (386)..(386): n is a, c, g, or t
  misc_feature (403)..(403): n is a, c, g, or t
  misc_feature (467)..(467): n is a, c, g, or t
  misc_feature (472)..(472): n is a, c, g, or t
  misc_feature (481)..(481): n is a, c, g, or t
  misc_feature (493)..(493): n is a, c, g, or t
  misc_feature (504)..(504): n is a, c, g, or t
  misc_feature (510)..(510): n is a, c, g, or t
  misc_feature (514)..(514): n is a, c, g, or t
  misc_feature (534)..(534): n is a, c, g, or t
  misc_feature (539)..(539): n is a, c, g, or t
  misc_feature (544)..(544): n is a, c, g, or t
  misc_feature (565)..(565): n is a, c, g, or t
  misc_feature (569)..(569): n is a, c, g, or t
  misc_feature (573)..(573): n is a, c, g, or t
  misc_feature (583)..(583): n is a, c, g, or t
  misc_feature (585)..(585): n is a, c, g, or t
  misc_feature (610)..(610): n is a, c, g, or t
  misc_feature (626)..(626): n is a, c, g, or t
  misc_feature (629)..(629): n is a, c, g, or t
  misc_feature (632)..(632): n is a, c, g, or t
  misc_feature (654)..(654): n is a, c, g, or t
  misc_feature (682)..(682): n is a, c, g, or t
taagggggncanctttattcaagccagcnaangacacgccaggggcccaggggagcnggngggcccngcccagccnggcngcngnggngggncagagcccagagcnccccngggnctggnaganggnncngcctgcacntctttttgggncncagagacnaaannagaaagggggggggggagccccaggngaacccactttcantgtcaancttgagggcaaagaaaaccagagggctgtcttcngcntggggggcagcaagggtcncgnccaggacccngagggggcgggggncttccagcgggngggcactggactcactgcngccgtcanccagctctcgggaggacgagttttcggcatcngagttttccgagcngcngancaccacaacgcgttccnctgcctccccggcgccactggccacgtggttgctgttgggcaggaagacctcacttcctatganggggntcctggggntaggcggtccanccaggtggggnggtganactnccttggaggtgctgggcctnggctnctccngggagctccgagccaaccttncctncttnccctcctcanantccatcttgatgaccttcctggggnactgggtctggctgcnctnccncttctgggctgtcgttgttttngagaaatccaggtcaacgtcaatagggnccctgggagttctggcagcctctgggctggcttt

SEQ ID NO: 482583 - DNA, 282 bp, Homo sapiens
ctattacacgcaatataattgtcaatagtggctgccgataaagattaactacgcagtagtgagagacacgatatgctgtaatgatagccctagaatctcttctcctacagaatcgattcagtaggagcagatattctgcgctatcataatcccatatgtttctctccctccagttgttaatataatgcagcattaattgcaagttattatgcgcgtacacgttcttcccgtataagaatatcgctcatgtgctaataatgcttgtgggagacaagaggcgtg

SEQ ID NO: 482584 - DNA, 781 bp, Homo sapiens
  misc_feature (13)..(13): n is a, c, g, or t
cagcatcccaaanaaagactcaaaattttaagaaatatcaaaatatccagcacccaacaaggtaaaagtcacaatgtctagcagctaatcaaatattaaaggcatgcatggaagtaggaaaacaggacccataatgaggaggatattcagtcaaaccaacccagaaattacatagatgttaaaattggcagagaagggcattaaaacagtcattataactgtattctatatgttcaaaaagtcaagtagaaagatgaaaaatgtaaaaaaaaatacctgaatcaaactcctagagataaaaacttcaaagtatggtgtgaaaaatatacttgatcaaaataatagcagattagactttgctggatggaagattaatataggtgaagccatactagtagatactgtacaaaatgagtcacagagagggaaaaaaagagaaaaatatttgaaaagaccattactgagctgtgggactgtaagtggcccagtaaatgaaaacttggaatccctgaaggagatgtagagaaaaataatggctgaaaactttccaaactaaaaatgataagcccatacccaaaccagttaaggtacatggaaaaaactgtgccaaggaataccataatcaaaattgtcaaaccagtgatacagtgaaaatcttaaaaacaaaaaaaaatttttatatatatactttttattatactttaagttctagggtacatgtgcacaaggtgcatgtttgttacatatgtatacatgtgccatgttggtgtgtaaaaaaaaa

SEQ ID NO: 482585 - DNA, 771 bp, Homo sapiens
  misc_feature (369)..(369): n is a, c, g, or t
atcttggagccacgcagaagagcagattttgggaggtggtaataacaaaatttaatttcttcccaacaacttaattttctcatttattttacagaatagtagtgaaatatttgatgaaactttgtattttggtagcactacatagaaaatgtgttttagatttatgatgatcatatttctcaccaatgtaatttcagtctcagcagtgattttcaaacttagggaaagggacagcattagatttttttttttttccatttttttaaaatgatattcttaccgtgaaactacaaacgacaaaagagaattagaaagtgtttgaatttacaagttgaagaagggtttgggggaagatgggcctgaacccancttccgtgtcctcaactccagtgcataccccaatacactccagggaaaccctctgaagcgtttaactggggtgcacttgtgaaaattctctcttctataggtggtgcttggttgtgattttaaattcacagagaaaacgtgggtttaactcttagagaaccattttcatccagttttttagttggcttcattggacttcctaaatcattttggacgttcacaaggattgggtactttccggttaagcttcctctctctaagctttatctaccttaaaaccaaagtccttttttataatggccagtccaaccaattgatttctcaaactgaagtgcccaggtgtggactcatcaattcccgttagaatagggacatcctatttacaaagtgggtgcagttcca

SEQ ID NO: 482586 - DNA, 236 bp, Homo sapiens
  misc_feature (71)..(71): n is a, c, g, or t
  misc_feature (116)..(116): n is a, c, g, or t
ggggttagtgaatagtctttaaaaaaaatttagaaaaatgagaggttcaggacagacatggaaaccttttntgtacagcagcataactccagtttgctttccaagccctctgattnagaagccaataggcaaagtaagaatgaacctacttttatcagacactatgattcgagccagttggctgttaattctttttgccttgagctatttcggtgaaataataaaattgatcttat

SEQ ID NO: 482587 - DNA, 1517 bp, Homo sapiens
gtgattggtatgaccgtaagatgttgatctcatatcataattacgggaaccattgccaagtctggtactaaagtcattcatggatgcgctctatcagagctggtgcagacgatctccatggaattgaggcatgtatcaggccgttcggcattattattctagcctacttggctgtgctagtagcacaagtgtgttgtcgatcgacaaagcacaaggcatgatgaacagtactgcgttgggaagtctatctagcatagcgagggttccattcacttgatgacagtgcatagagccattggttgaggcccgagtttggacagtggcgtaccgaacacgttgatccgtcacattcgttaaacgaacgatcaagacgacgacgtacacttagcaagaagaggctgggtcaaatagatagtatgtgaacgtaagcagttctgcagattgcataggacatatccgcattacccgtttatttgggaagaatggaagcgagagacaggaagattaggtgatgactgacgagcacgacgcgacagcgacgacaacggtgacgaccacgaacgacgggaacgactaacagactgactgacaccgacagacaccccagagactcgaccgactgctcgggttccgactgacgggacggaatggacccagcgtgctagaggacttacagacaagacagacacaaggctacagaccagacttcaaaggagcaagagtacaattcggaatacacgagagaaaaactagacagacaagaacacaacagaccttaattagcggacacaggagaacccttgagtgaccaatcaagcgcaaaggagggcacgtacatgagcacgaaaaattactcaccaaagaggaaagcacgccaccacgataaaatgggagccctgggcggaacagagaaaccaacactatgagacaagacaccacaggaccacacaggatacactagacaacaccaggggccacaggcaagggacaaaataaacacgggagaacataggctaaataacacatacccagtacgacggaggagcaacccgatagatgaaccgcagaacaggagccgagcacccaacgcacagacaacacagacaacagaacacacgtccaaagacaccccaacggagacgcggcacggagggtagggcccaacaccaaaagtgcgaaccgacgaatgggtgcgctgcgaaggacgggaaacaccacgcagagcagaaccaacgaaaaatgaccagcggagggcggagagcacgaccaacagaagggagtatacgcgcaagaagagcacaaaaggacgagaaaagacacaacagcacaacaaaaaaagagagaagaaagaaagcaacaaagacaggtagaaaacggcgagcagacgacaagaaagaagcgagagaccaagacagccacacacataagtaggagacccaacaaccgcaggaacgacaacgagagccacaacaacagcacagccaagcacagaatccagacaaagaaacaacaagacg

SEQ ID NO: 482588 - DNA, 430 bp, Homo sapiens
  misc_feature (26)..(26): n is a, c, g, or t
  misc_feature (56)..(56): n is a, c, g, or t
  misc_feature (128)..(128): n is a, c, g, or t
  misc_feature (172)..(172): n is a, c, g, or t
  misc_feature (190)..(190): n is a, c, g, or t
  misc_feature (195)..(195): n is a, c, g, or t
aacccgaaaaagaagcgtactagccncgtagacactctaatcttaaaggtgttacngccgggaggagaaactttgataatggggctttttacaaaagccttgttgagattagacccctcgtataatanctttaccttctaataagggactccgtgttgctatgtgcagatcnctctggagcttttttgcnggcantaaggtgtgctatttgtcagtagcctttttttgcagtgatttgagaccaagttgttttacagctgtgttaccgttaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagctagg

SEQ ID NO: 482589 - DNA, 1500 bp, Homo sapiens
  misc_feature (970)..(970): n is a, c, g, or t
  misc_feature (1172)..(1172): n is a, c, g, or t
  misc_feature (1302)..(1302): n is a, c, g, or t
agtttctgtatctgttctattattttttcatcttatgtgtatcatcatattcgtatgtatgttcttcttttttctttttttctcttttttatttatctcttatttttatatttgttcttcaagatcgtcagtacacatcatactagaagacaacactactattgtaaacacccggttggcgccatatataccccgggggacccctatgtttgccacaacaagccgttttgtcttccccccccccctcgtttttttactccgtctctgtaattgcaccgacccccttggtgggcaatctttccgcacccgaggtacactctcgctgtggccgcctgtgagatataaccccccccgggagggtttttcctggggtgtcggccccccaccggcccgggattgtgtgaaatcaccccccgtgccggcgtgtcctctccttgcgccctgggttttcccccgaggagaaaggaaggggggatataaaccccaggctcccccccagtcatcggccagtgccgctgcacattgtccggctgtctaagccctgtgcacagcctgcgctctgttcatcacccaggtgaggagttccacgggtcttccccgccccctgtcgtgttggtgtacccccgggttccggggcctccggttgggtgctcccttgatgcccctcttccccccccccctgtagattcccccggtggggccgaagggaatatttccacgaagggattcccccaatcctttcactcctaacccttattttctatcctccccagtggattccgctcttgaaaaatgtatacacacagagtgaatctataacgcgtgctccaccgcaccccatagatccgcagggatattttcttccaacgcgtcaccagtctcacaggcttctacaccagaacacccccctataccgccatttatacttggcgcgacaccagatggcctgaagtgcgccgcgccacgcacntcttacaatctggaagattctcccgggccggccgcgcgcttgtcccccgaagggggaccacaaagcaccacactttcgccacgattctctctcctgggagattttccctgtataggagccacacctgtcgagagccgagcccacatgttcttcacatttgcgttcccacccacgagactccccgcagggacacacgagagcncccctcctgcttccgcagaccctctcacgcttcttttgtggcctcttgaggagattgtggagagacaccgcgggccattccccctctgttccccacagaggagcccgcaacgccttgctttcactggccntaacacacgctttcgaagaagaagaattcttcgcggaagaaggaaggaaggaatatagggcccccttcggggctgggcacatcccgcccctggggccacaccccttgtcagcccgcggtgggtaggaaccctagactcgctcatttcccctgggtttgtccccctgttgtaatcgtcccaattaaccctccctcccga

SEQ ID NO: 482590 - DNA, 777 bp, Homo sapiens
tcggctgtaaggaggtggcagtaacaaccacaaccacaacggcctggggtgaggagaatgtgcggcacgcgtgcgattctatggcgtgccctaggcggctggtggaggagcgcgaaggaggcagggtggcggccgggcttggcttcgcgctccttgagtgagcttgtgcggcgtgcgcgacccggggaaccggcattggcttctatgctctgtgttatttatcatctcgataaccccgtggggccagatgtccagctcgccgctgtccaagaaacgtcgctgtgtcctgggcctgatccaaagccgggttctaactgctcccctgcccagtccgtgttgtccgaagtgccctcggtgccaaccaactggaatggccaagaacggcagtgaagcagacatagacgagggcctttactcccggcagctgtatgtgtcgggccatgaggcaattgaagcggctccatgacatccatgtgtcctggtatcagtgcctgcggtggccttgggctgtggcgctcgctaagcaacatcatcctttggtggcggtcaaggctgttaccctacatgaccagtgggcactgcccaggtgggctgatctttcctcccagttctaccttgcgggaggaggaacatcgcgtaaaaaacctgggccgagggtaatacaggccccgcctcgctgagctttcaacagctatgtgcctgtcgctggcctacactggacccctcgttcgaggactccttactgcgaccccggtggtggtgtcaccaaagaccccc

SEQ ID NO: 482591 - DNA, 935 bp, Homo sapiens
ggagagagaactagtctcgagttttctgggatttttccaggcggccgggaaaaatgggggacattcaaactgagcgtgcctaccaaaagcagccgacaatctttcaaaacaagaagaagggttccggcgtgggagaaaacgtggcaagtgagaagcttcccgacggaataactcacaagaaccactcggctcgtgggccttcaagaacacccaaggaaggcatattttgagggcaccatacatttgacaacgaaagtgcgccacttatcaaacgtgagaaaatgtgagtggtcacatatctacagaggagcggagactccccctctatctgtgggcagtgtggatgtagaacccaacacaagtgacaagcagtgacacgaagtagaacacatatgggatacaaccttcctgcccggaagacatatacctccgtgacaaaattaacccaactgcggcggcaaacagtattaaagacaaacacggggttttatacgagcagaaaatatgacgaccaccaaacgaagagaaaacagatgttgtgatccgtgatatcacacacccatagtaggaacacccccacctgttgtgccttatcgagacggggggaacaaggagtaccacgaaacaacttcggagtgaacacaacaatcagtatacgagcaagagtaatgtatagaccgacaaatagtagccccaaagcaccaactacagttggaatagccacagaacaccagcaggggtaggagccactatcacaaaaacgtgatggagaacacaaaaagaggagtcacaccacaaaaaggaggctcatgcagcaggggaaaacccaaaagaaaaacagagcaaagagtacacccgaagacaaatagatatcagaaggaggagagggatctgtgagagaaaaaacttgcagggacaacccagcatgtttaccc

SEQ ID NO: 482592 - DNA, 134 bp, Homo sapiens
ccaagatccaggatcaggaacaggaacccatgcagatatccgacatggagaacccggcaatacccatcccaacttttgattaaacaaaattaccaacaattaccaaaattttgacattcctgttaaaatgatga

SEQ ID NO: 482593 - DNA, 89 bp, Homo sapiens
ccctcccggttagcgggcggttgtaagggtgctttgcggcctgcctgcctgtcctccagagggtgtttcctagaaatcgataaatcaga

SEQ ID NO: 482594 - DNA, 636 bp, Homo sapiens
cacaccactgcactccagcctgggcaacagagcgagactgtctccaaaaaaaaagaaaaaaaaagaaaagaagaaaacagttgaaagcttcaatatcttagaccaagtggaagaaataatttcagagcttgaagaccaatcttcttaacccagacaaaaataatatttttttaaatgaacaaaatctttgagaaatatgggataatggtaaagtgatcaaaccttcaaattatggcattcctaagtgagacagagaaaaggtaaacaacctggaaaacatatttgagggaataatcccagaaaaatcccctaaccttgctagagaggtgaatatccagattcaaaaaatctggagaacatctgggagatactatataaaatgaacaccaccaagaactttactcaccaggggatggtctaagggtccaatgctaaagagaaaatgttagaaagaaaaaagcaagatcacatataaagggaacaccattaagctaacagcagatttctcagaagaaaccttacaagccaggagagttgggggcctgttttcaccattcttaaaataaatctcggccaagaatttcatatcccaacaaagataaagcccctcaataacgcccaaaagggagtaataaa

SEQ ID NO: 482595 - DNA, 246 bp, Homo sapiens
cgggggagaaaattggagtctcggacctcaggatgaataaggtgacattgcatggatcaagtatcattggggatggtagagctttttttatgtcgttcacttccatctgcaaccgaagcgggattttcttctcttcatccaactcagacaataagggtttaatctctcgtgtgggcgggtccttcagggtctcgaggatgctcctcagcgcggggaccggtgtccttacctcgtgcggagggtacc

SEQ ID NO: 482596 - DNA, 585 bp, Homo sapiens
ttctatgaagcaggcattgctgccaaggcagttggctgggataacatgcattcatctcctccatcgctttttggacctgaccgatgcaatcgaggaaaggactctagatggccttggcccctttgattttcaggatacagacattccctttgaggggccccttccagctaaacagcatgttccggaggcttaaaaaaaaaaggtttgagactgggtgcttacagtttccatggaccaacgggtggaacaggtttttcctcgggattagcgtggggccttccaggcctccctaatggcaacgagcactggtgtttgagccctgccctgccttattacaggataccccctttttaggaacaaaatttaattttaacggccaaggaagggtgctaacaagggcaactggaattaattccttatggccctcaagacctcccccagcccagtggggcaggacgtgcttaaatttatcagtcaatggggtggaggggtccccagccccagcttttcccttcagtagtcggtaaagcttaggaaaaggtagggcctctccctccttaaagttttataaataatttaaaaaaa

SEQ ID NO: 482597 - DNA, 340 bp, Homo sapiens
cacacctgtcaaagcagggctgaacctaacggctgcccaggtctagtcccttctcaaacatgccacttccgtgtcctgaagcacaggtctgcggcggacctccccaggccaggatgccccgttgttggagtcactgagttctactgatgtggctctcctgctgccgtggctgcagacggagggatgccacagccccccctgcagtgaccaggcacaggagaacatggccccagagccaccacgggagtgtgtcttgtctaaactgactcagaaactctgctccctgagcggctcagtgacacaaacaccctcctctccctgcatttcacaggcagtgagg

SEQ ID NO: 482598 - DNA, 618 bp, Homo sapiens
tgcggagactgcttccggactccaggtaccgcgcttggggcagttgcccccagaattctgtcttttcagctgcagtgaaggctcggggctgcagaatttgcaaaccttgcaagtggaccttgatcggtttggttatgcagccctcgtgaccatttggaagcattttggatataagcggagaggtggtgtccgtctttgatgctgccatatagtgtgggatgtttggccgggatatggagcttaccggtgtctccaatgacaaacgaagatgtacaagtgtcactgttaacaggctttcttcctggctacacaataagtgggtgtgagatttaaggaggtcccagaaaataaattgcccttgatgggtttgggttgcaggtttaaaggcctcattgattgatcctgagactttgtcctgtaggcatgctctgagcattcttgtgaggaacaagaaaaactaagttcatgtccatccgtgcttgtaagtgggccagagccatatttattggggttatttcaaaagattacatttccaatattggaagtggctagaaaacaccaatgtcgcatcttggctcacccttctaatttgaacatttagttcgagggaagtataac

SEQ ID NO: 482599 - DNA, 1961 bp, Homo sapiens
ctccgcagaagatttgttgccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggaagatttggagactggagttcaccttgaccctgccgtcaaagaagttcagtataatcctacctatgagaccatgtttgctcctgagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagaagagcaaaaagaattggatgaaatcacagcaaagaggcagaaaaaaggaaaacaggaagaagagaaacctggggaggagaagacaatcttacatgttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaagggcgtcagtgcagtcagattgtttcctctctctggccatttattgctgtcttgttccatggactgtaaaattaagctatgggaggtttatggagaacggcgctgtctgagaacatttattggtcacagtaaggctgttagggatatctgcttcaatactgcaggaacacagttcctcagtgcagcctatgacaggtatcttaagctctgggacactgagacaggacagtgtatatcaagatttacaaaccgaaaagtaccttattgtgtcaaattcaatcctgatgaagataagcaaaatctctttgtggctgggatgtctgataagaagattgtgcaatgggacattcgaagtggagaaattgtgcaggaatatgatcggcatttgggagctgtcaacaccattgtttttgtggatgagaataggagatttgtgagcacatctgatgataaaagcctaagagtttgggaatgggatatccctgtggatttcaagtacatagcagaacccagtatgcactcaatgcctgcagtgactttgtctccaaatggaaaatggctagcatgccaatcaatggacaaccaaatcttaatttttggagcacagaacagatttagattaaataagaaaaaaatttttaagggccatatggtagcaggctatgcttgtcaggtggacttttcaccagacatgagttatgtgatttcaggagatggaaatggaaaattaaacatttgggactggaagaccacaaaactctacagtcgatttaaagctcatgataaagtgtgtataggtgcagtgtggcatcctcatgaaacttctaaggtcataacatgtggttgggatggtctcattaaattgtgggattaatgagattaatccttaaactagctgggatcatttttgatccattgtcatatttatatttaattattaaatgtatctgatgataacttgatttacagataatgttgatgacattgaccctttgtttaaaaaaagaaactgtaaatttgacataatttcatttgcaacttcattttgttttttataaatgttatttatac

SEQ ID NO: 482600 - DNA, 444 bp, Homo sapiens
cgtatgtgaaggaccctgagcatttcacccttgtagtcctgggtaccacggtaatcaaatagtatagaaaaagaataaaagcggagatatattttttgacacagaggcacccaaagaaatacaaacattgcctagctgctgccatttctgtaactgcccagaagggtgacagatttctgaaggggaaaggattcagatatgaccttttctttagtcccaaccactagttttaacaaatgtgaattattgaaatgtgaagggacaaaaagaatcatacatttaaactgtcttgttcagcataccaatattgtatgttacaaatcatcatttctaaatctggattgattctgttgtgtttttgactgtttctaaagtaagtgtgtataaaagtctcctttttaaaaagatcatatttttaaataaagcattttttgtagaaagtgc

SEQ ID NO: 482601 - DNA, 665 bp, Homo sapiens
aataaatggagagttctcccaacttgtgggaccgcgttttatataaatatttataaaggggctctcataaccttcagacgcgcttgttaaatatttatacgcggttggttcctccctcaacctgcacacagggaggtaaataatatttctgttctcgcgccgcgaaaatttacgttatgcctgtggcacacaccgggaggagaaaatgttggcggaaaattggccgtcgccaccagggttagacttttctcgggcgccacaacctgtgagagaccgctcttgttgaaaatattcaacactacatacttctcacagcgggcccacatcataattgatcaattctctgctcaccaacttctctaaattttctctcaataaagcaccacttagatggtgcccacatcttaaaatgtgcgccacaacaaaataggtaatattgtgttaaaaccgcaatatttctttttaaaatatcgcaccctttggcgacacagggttgtcacacttgtttttcggcgaattcatccctgtttgttggtaatataaaaagtggtggtgttgtgtgaaattttcgcgcacataaagttttaatttccccacggttaagaaggaaaccttgatcactgtgcataatataaaagattaatgttctgggtaatgccacaaat

SEQ ID NO: 482602 - DNA, 293 bp, Homo sapiens
tgttgtatttttttaatggttgttccagaactaagcgagttgcatattcacagggaccaagaacagctgagaaacctatcttgagtaattgggaagagctgagtcctgctaagtacgttcgctgccttcctctgttaatattcaatgtctttaaggtcagctccaatagctaccagtagatgaatcctcctcccactgattccttgtatcactggaagatttttttgttgcctcagcttaaatctgtgtgagacataggcatatgtaaatttttagattgctttaccgtgtag

SEQ ID NO: 482603 - DNA, 3857 bp, Homo sapiens
ctccgcagaagatttgttgccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggaagatttggagactggagttcaccttgaccctgccgtcaaagaagttcagtataatcctacctatgagaccatgtttgctcctgagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagaagagcaaaaagaattggatgaaatcacagcaaagaggcagaaaaaaggaaaacaggaagaagagaaacctggggaggagaagacaatcttacatgttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaagggcgtcagtgcagtcagattgtttcctctctctggccatttattgctgtcttgttccatggactgtaaaattaagctatgggaggtttatggagaacggcgctgtctgagaacatttattggtcacagtaaggctgttagggatatctgcttcaatactgcaggaacacagttcctcagtgcagcctatgacaggtatcttaagctctgggacactgagacaggacagtgtatatcaagatttacaaaccgaaaagtaccttattgtgtcaaattcaatcctgatgaagataagcaaaatctctttgtggctgggatgtctgataagaagattgtgcaatgggacattcgaagtggagaaattgtgcaggaatatgatcggcatttgggagctgtcaacaccattgtttttgtggatgagaataggagatttgtgagcacatctgatgataaaagcctaagagtttgggaatgggatatccctgtggatttcaagtacatagcagaacccagtatgcactcaatgcctgcagtgactttgtctccaaatggaaaatggctagcatgccaatcaatggacaaccaaatcttaatttttggagcacagaacagatttagattaaataagaaaaaaatttttaagggccatatggtagcaggctatgcttgtcaggtggacttttcaccagacatgagttatgtgatttcaggagatggaaatggaaaattaaacatttgggactggaagaccacaaaactctacagtcgatttaaagctcatgataaagtgtgtataggtgcagtgtggcatcctcatgaaacttctaaggtcataacatgtggttgggatggtctcattaaattgtgggattaatgagattaatccttaaactagctgggatcatttttgatccattgtcatatttatatttaattattaaatgtatctgatgataacttgatttacagataatgttgatgacattgaccctttgtttaaaaaaagaaactgtaaatttgacataatttcatttgcaacttcattttgttttttataaatgttatttatacagaaagtggctattgactttctatttgacaagtagttataattggcaagcagtttgagtttatactcatgacatactgaaagcatctctttggggtcaagaaagaatccctagtggatttgggattctagaggaggtgttataattaattattcagaaaaatgcatgtatttacctcttcaaccaaaagggcagtaaagaatagggataatatattttaatgtaaatttggaagaaggataaaatcacccacagttactctccctattattttcactgggtcaagttttaatcttttggcttcatgagttccactccctttgatgatatatgttgtatatttttagttgtaaagcagtaatctttaactgtagcattcctctaattataaacagtgaaaaatcaaaatcagtccagagttcttttgttgacttaattcctgatcagtatagacaggactatatatatttaatcagagaattacattatatctgaagatggagctcaggagaatgcaccaagactttgaattgtatttacattcactgtcagtaaagacctggctacgctttgagaaatcaggatctcctaggtcattgcttcgcagctgtgattactgaaatcctcctcataggagataaagtacgaggggtagagtccaagatgtcaacttgtaatttctttgaagtcatatgttttatctttaaaattattcttattttacctgtgaatatatacaacagaactttttaagattaaaaaatttttaaacctctatgtctgaaaaaaaaaatgacactcctggaagatggctagggttccccagtttgagaagcagtggccatggtgaaaaatagtttttgaaaacatcagattataaaatcaagatagtccggacgcggtggcacatgcctgtaatcccagcactttgggaggctgaggcaggtgaatcacctgaggtcaggagttcaagaccagcctggccaacatagtgaaaccccgtctctactaaaaacacaaaaattagccaggcttggtggctggcgcctgtaattccagctactcagaaggctgaggcagggagaattgcttgaacccaggagtggaggttgcagtgagctgagatcatgccactgcactccagcctgggcgacagagcgagactccacctcaaaaaataaaatcaagataacctcttgaatgtaatagctcatagcactttaatttggcaagccatttttcctgttttattataaatctatattagatgtttgaatatggtttgaaatatttcactaccgtgctgaaaaaggttggttgatagcagcttggagtgctaactggaagatcaaaatcatgtctcttgctgataacctaagagcattaagctctgagtccagtgaggtcatagcagtgtatgctccttgcccttacggagtgtctgtttttagaaatttagattttaaaaggcgtgggacatacgaccaggccctatagccacataaatataaatttcatagaaaaagaataaaagcggagatatattttttgacacagaggcacccaaagaaatacaaacattgcctagctgctgccatttctgtaactgcccagaagggtgacagatttctgaaggggaaaggattcagatatgaccttttctttagtcccaaccactagttttaacaaatgtgaattattgaaatgtgaagggacaaaaagaatcatacatttaaactgtcttgttcagcataccaatattgtatgttacaaatcatcatttctaaatctggattgattctgttgtgtttttgactgtttctaaagtaagtgtgtataaaagtctcctttttaaaaagatcatatttttaaataaagcattttttgtagaaagtgc

SEQ ID NO: 482604 - DNA, 242 bp, Homo sapiens
cgattaaccaggcagcatctaggtgcaggactgctgccaaagcagagaggtgaggtacagcatcagtagctcccagtgcagcctcttcctcatgtgtacagtgcgcgttactcattcatgcctgggagaggtgttggggtagtgtcacaacgtgctcgcgctgattgggcgtgcaacggggagccctacatatggagccccaggtgtgatctggggcctacgtggtcctgcctgtgtcccat

SEQ ID NO: 482605 - DNA, 3712 bp, Homo sapiens
tgttgtatttttttaatggttgttccagaactaagcgagttgcatattcacagggaccaagaacagctgagaaacctatcttgagtaattgggaagagctgagtcctgctaagtacgttcgctgccttcctctgttaatattcaatgtctttaagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagaagagcaaaaagaattggatgaaatcacagcaaagaggcagaaaaaaggaaaacaggaagaagagaaacctggggaggagaagacaatcttacatgttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaagggcgtcagtgcagtcagattgtttcctctctctggccatttattgctgtcttgttccatggactgtaaaattaagctatgggaggtttatggagaacggcgctgtctgagaacatttattggtcacagtaaggctgttagggatatctgcttcaatactgcaggaacacagttcctcagtgcagcctatgacaggtatcttaagctctgggacactgagacaggacagtgtatatcaagatttacaaaccgaaaagtaccttattgtgtcaaattcaatcctgatgaagataagcaaaatctctttgtggctgggatgtctgataagaagattgtgcaatgggacattcgaagtggagaaattgtgcaggaatatgatcggcatttgggagctgtcaacaccattgtttttgtggatgagaataggagatttgtgagcacatctgatgataaaagcctaagagtttgggaatgggatatccctgtggatttcaagtacatagcagaacccagtatgcactcaatgcctgcagtgactttgtctccaaatggaaaatggctagcatgccaatcaatggacaaccaaatcttaatttttggagcacagaacagatttagattaaataagaaaaaaatttttaagggccatatggtagcaggctatgcttgtcaggtggacttttcaccagacatgagttatgtgatttcaggagatggaaatggaaaattaaacatttgggactggaagaccacaaaactctacagtcgatttaaagctcatgataaagtgtgtataggtgcagtgtggcatcctcatgaaacttctaaggtcataacatgtggttgggatggtctcattaaattgtgggattaatgagattaatccttaaactagctgggatcatttttgatccattgtcatatttatatttaattattaaatgtatctgatgataacttgatttacagataatgttgatgacattgaccctttgtttaaaaaaagaaactgtaaatttgacataatttcatttgcaacttcattttgttttttataaatgttatttatacagaaagtggctattgactttctatttgacaagtagttataattggcaagcagtttgagtttatactcatgacatactgaaagcatctctttggggtcaagaaagaatccctagtggatttgggattctagaggaggtgttataattaattattcagaaaaatgcatgtatttacctcttcaaccaaaagggcagtaaagaatagggataatatattttaatgtaaatttggaagaaggataaaatcacccacagttactctccctattattttcactgggtcaagttttaatcttttggcttcatgagttccactccctttgatgatatatgttgtatatttttagttgtaaagcagtaatctttaactgtagcattcctctaattataaacagtgaaaaatcaaaatcagtccagagttcttttgttgacttaattcctgatcagtatagacaggactatatatatttaatcagagaattacattatatctgaagatggagctcaggagaatgcaccaagactttgaattgtatttacattcactgtcagtaaagacctggctacgctttgagaaatcaggatctcctaggtcattgcttcgcagctgtgattactgaaatcctcctcataggagataaagtacgaggggtagagtccaagatgtcaacttgtaatttctttgaagtcatatgttttatctttaaaattattcttattttacctgtgaatatatacaacagaactttttaagattaaaaaatttttaaacctctatgtctgaaaaaaaaaatgacactcctggaagatggctagggttccccagtttgagaagcagtggccatggtgaaaaatagtttttgaaaacatcagattataaaatcaagatagtccggacgcggtggcacatgcctgtaatcccagcactttgggaggctgaggcaggtgaatcacctgaggtcaggagttcaagaccagcctggccaacatagtgaaaccccgtctctactaaaaacacaaaaattagccaggcttggtggctggcgcctgtaattccagctactcagaaggctgaggcagggagaattgcttgaacccaggagtggaggttgcagtgagctgagatcatgccactgcactccagcctgggcgacagagcgagactccacctcaaaaaataaaatcaagataacctcttgaatgtaatagctcatagcactttaatttggcaagccatttttcctgttttattataaatctatattagatgtttgaatatggtttgaaatatttcactaccgtgctgaaaaaggttggttgatagcagcttggagtgctaactggaagatcaaaatcatgtctcttgctgataacctaagagcattaagctctgagtccagtgaggtcatagcagtgtatgctccttgcccttacggagtgtctgtttttagaaatttagattttaaaaggcgtgggacatacgaccaggccctatagccacataaatataaatttcatagaaaaagaataaaagcggagatatattttttgacacagaggcacccaaagaaatacaaacattgcctagctgctgccatttctgtaactgcccagaagggtgacagatttctgaaggggaaaggattcagatatgaccttttctttagtcccaaccactagttttaacaaatgtgaattattgaaatgtgaagggacaaaaagaatcatacatttaaactgtcttgttcagcataccaatattgtatgttacaaatcatcatttctaaatctggattgattctgttgtgtttttgactgtttctaaagtaagtgtgtataaaagtctcctttttaaaaagatcatatttttaaataaagcattttttgtagaaagtgc

SEQ ID NO: 482606 - DNA, 160 bp, Homo sapiens
aattctgcaccacagccataaccaccaccactacggtgaccccaacccgacacccatcgccaccaccactacggtgaccccaagcccaacacccaccggcacacagaccccaaacgacgacacccatacagcaccgaccaccacggtgagcgccaaagcc

SEQ ID NO: 482607 - DNA, 4067 bp, Homo sapiens
ctccgcagaagatttgttgccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggaagatttggagactggagttcaccttgaccctgccgtcaaagaagttcagtataatcctacctatgagaccatgtttgctcctgagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagaagagcaaaaagaattggatgaaatcacagcaaagaggcagaaaaaaggaaaacaggaagaagagaaacctggggaggagaagacaatcttacatgttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaagggcgtcagtgcagtcagattgtttcctctctctggccatttattgctgtcttgttccatggactgtaaaattaagctatgggaggtttatggagaacggcgctgtctgagaacatttattggtcacagtaaggctgttagggatatctgcttcaatactgcaggaacacagttcctcagtgcagcctatgacaggtatcttaagctctgggacactgagacaggacagtgtatatcaagatttacaaaccgaaaagtaccttattgtgtcaaattcaatcctgatgaagataagcaaaatctctttgtggctgggatgtctgataagaagattgtgcaatgggacattcgaagtggagaaattgtgcaggaatatgatcggcatttgggagctgtcaacaccattgtttttgtggatgagaataggagatttgtgagcacatctgatgataaaagcctaagagtttgggaatgggatatccctgtggatttcaagtacatagcagaacccagtatgcactcaatgcctgcagtgactttgtctccaaatggaaaatggctagcatgccaatcaatggacaaccaaatcttaatttttggagcacagaacagatttagattaaataagaaaaaaatttttaagggccatatggtagcaggctatgcttgtcaggtggacttttcaccagacatgagttatgtgatttcaggagatggaaatggaaaattaaacatttgggactggaagaccacaaaactctacagtcgatttaaagctcatgataaagtgtgtataggtgcagtgtggcatcctcatgaaacttctaaggtcataacatgtggttgggatggtctcattaaattgtgggattaatgagattaatccttaaactagctgggatcatttttgatccattgtcatatttatatttaattattaaatgtatctgatgataacttgatttacagataatgttgatgacattgaccctttgtttaaaaaaagaaactgtaaatttgacataatttcatttgcaacttcattttgttttttataaatgttatttatacagaaagtggctattgactttctatttgacaagtagttataattggcaagcagtttgagtttatactcatgacatactgaaagcatctctttggggtcaagaaagaatccctagtggatttgggattctagaggaggtgttataattaattattcagaaaaatgcatgtatttacctcttcaaccaaaagggcagtaaagaatagggataatatattttaatgtaaatttggaagaaggataaaatcacccacagttactctccctattattttcactgggtcaagttttaatcttttggcttcatgagttccactccctttgatgatatatgttgtatatttttagttgtaaagcagtaatctttaactgtagcattcctctaattataaacagtgaaaaatcaaaatcagtccagagttcttttgttgacttaattcctgatcagtatagacaggactatatatatttaatcagagaattacattatatctgaagatggagctcaggagaatgcaccaagactttgaattgtatttacattcactgtcagtaaagacctggctacgctttgagaaatcaggatctcctaggtcattgcttcgcagctgtgattactgaaatcctcctcataggagataaagtacgaggggtagagtccaagatgtcaacttgtaatttctttgaagtcatatgttttatctttaaaattattcttattttacctgtgaatatatacaacagaactttttaagattaaaaaatttttaaacctctatgtctgaaaaaaaaaatgacactcctggaagatggctagggttccccagtttgagaagcagtggccatggtgaaaaatagtttttgaaaacatcagattataaaatcaagatagtccggacgcggtggcacatgcctgtaatcccagcactttgggaggctgaggcaggtgaatcacctgaggtcaggagttcaagaccagcctggccaacatagtgaaaccccgtctctactaaaaacacaaaaattagccaggcttggtggctggcgcctgtaattccagctactcagaaggctgaggcagggagaattgcttgaacccaggagtggaggttgcagtgagctgagatcatgccactgcactccagcctgggcgacagagcgagactccacctcaaaaaataaaatcaagataacctcttgaatgtaatagctcatagcactttaatttggcaagccatttttcctgttttattataaatctatattagatgtttgaatatggtttgaaatatttcactaccgtgctgaaaaaggttggttgatagcagcttggagtgctaactggaagatcaaaatcatgtctcttgctgataacctaagagcattaagctctgagtccagtgaggtcatagcagtgtatgctccttgcccttacggagtgtctgtttttagaaatttagattttaaaaggcgtgggacatacgaccaggccctatagccacataaatataaatttcatagaaaaagaataaaagcggagatatattttttgacacagaggcacccaaagaaatacaaacattgcctagctgctgccatttctgtaactgcccagaagggtgacagatttctgaaggggaaaggattcagatatgaccttttctttagtcccaaccactagttttaacaaatgtgaattattgaaatgtgaagggacaaaaagaatcatacatttaaactgtcttgttcagcataccaatattgtatgttacaaatcatcatttctaaatctggattgattctgttgtgtttttgactgtttctaaagtaagtgtgtataaaagtctcctttttaaaaagatcatatttttaaataaagcattttttgtagaaagtgcaaaaaaacatgttaaaaaaaaacttgtttgcgcggccgtgggcccgcaaaaattttgaagaccattggtatggcgcaccggcgcccataggtacagtgccacgttcccaacctttccaagaaaacctgggcacgacaaggggtggcttcctcccaataaaagcccgtggcaccgggttcgaacaccacggggctcggggccgggcctacg

SEQ ID NO: 482608 - DNA, 3910 bp, Homo sapiens
ctccgcagaagatttgttgccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggaagatttggagactggagttcaccttgaccctgccgtcaaagaagttcagtataatcctacctatgagaccatgtttgctcctgagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagaagagcaaaaagaattggatgaaatcacagcaaagaggcagaaaaaaggaaaacaggaagaagagaaacctggggaggagaagacaatcttacatgttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaagggcgtcagtgcagtcagattgtttcctctctctggccatttattgctgtcttgttccatggactgtaaaattaagctatgggaggtttatggagaacggcgctgtctgagaacatttattggtcacagtaaggctgttagggatatctgcttcaatactgcaggaacacagttcctcagtgcagcctatgacaggtatcttaagctctgggacactgagacaggacagtgtatatcaagatttacaaaccgaaaagtaccttattgtgtcaaattcaatcctgatgaagataagcaaaatctctttgtggctgggatgtctgataagaagattgtgcaatgggacattcgaagtggagaaattgtgcaggaatatgatcggcatttgggagctgtcaacaccattgtttttgtggatgagaataggagatttgtgagcacatctgatgataaaagcctaagagtttgggaatgggatatccctgtggatttcaagtacatagcagaacccagtatgcactcaatgcctgcagtgactttgtctccaaatggaaaatggctagcatgccaatcaatggacaaccaaatcttaatttttggagcacagaacagatttagattaaataagaaaaaaatttttaagggccatatggtagcaggctatgcttgtcaggtggacttttcaccagacatgagttatgtgatttcaggagatggaaatggaaaattaaacatttgggactggaagaccacaaaactctacagtcgatttaaagctcatgataaagtgtgtataggtgcagtgtggcatcctcatgaaacttctaaggtcataacatgtggttgggatggtctcattaaattgtgggattaatgagattaatccttaaactagctgggatcatttttgatccattgtcatatttatatttaattattaaatgtatctgatgataacttgatttacagataatgttgatgacattgaccctttgtttaaaaaaagaaactgtaaatttgacataatttcatttgcaacttcattttgttttttataaatgttatttatacagaaagtggctattgactttctatttgacaagtagttataattggcaagcagtttgagtttatactcatgacatactgaaagcatctctttggggtcaagaaagaatccctagtggatttgggattctagaggaggtgttataattaattattcagaaaaatgcatgtatttacctcttcaaccaaaagggcagtaaagaatagggataatatattttaatgtaaatttggaagaaggataaaatcacccacagttactctccctattattttcactgggtcaagttttaatcttttggcttcatgagttccactccctttgatgatatatgttgtatatttttagttgtaaagcagtaatctttaactgtagcattcctctaattataaacagtgaaaaatcaaaatcagtccagagttcttttgttgacttaattcctgatcagtatagacaggactatatatatttaatcagagaattacattatatctgaagatggagctcaggagaatgcaccaagactttgaattgtatttacattcactgtcagtaaagacctggctacgctttgagaaatcaggatctcctaggtcattgcttcgcagctgtgattactgaaatcctcctcataggagataaagtacgaggggtagagtccaagatgtcaacttgtaatttctttgaagtcatatgttttatctttaaaattattcttattttacctgtgaatatatacaacagaactttttaagattaaaaaatttttaaacctctatgtctgaaaaaaaaaatgacactcctggaagatggctagggttccccagtttgagaagcagtggccatggtgaaaaatagtttttgaaaacatcagattataaaatcaagatagtccggacgcggtggcacatgcctgtaatcccagcactttgggaggctgaggcaggtgaatcacctgaggtcaggagttcaagaccagcctggccaacatagtgaaaccccgtctctactaaaaacacaaaaattagccaggcttggtggctggcgcctgtaattccagctactcagaaggctgaggcagggagaattgcttgaacccaggagtggaggttgcagtgagctgagatcatgccactgcactccagcctgggcgacagagcgagactccacctcaaaaaataaaatcaagataacctcttgaatgtaatagctcatagcactttaatttggcaagccatttttcctgttttattataaatctatattagatgtttgaatatggtttgaaatatttcactaccgtgctgaaaaaggttggttgatagcagcttggagtgctaactggaagatcaaaatcatgtctcttgctgataacctaagagcattaagctctgagtccagtgaggtcatagcagtgtatgctccttgcccttacggagtgtctgtttttagaaatttagattttaaaaggcgtgggacatacgaccaggccctatagccacataaatataaatttcatagaaaaagaataaaagcggagatatattttttgacacagaggcacccaaagaaatacaaacattgcctagctgctgccatttctgtaactgcccagaagggtgacagatttctgaaggggaaaggattcagatatgaccttttctttagtcccaaccactagttttaacaaatgtgaattattgaaatgtgaagggacaaaaagaatcatacatttaaactgtcttgttcagcataccaatattgtatgttacaaatcatcatttctaaatctggattgattctgttgtgtttttgactgtttctaaagtagctatttggttatataactaactttgtttctggaatagtaatctggaaatctagtgtgattataccttctcactattcattccatttgtatgtacatcatttgatgtaatatcgtttctat

SEQ ID NO: 482609 - DNA, 533 bp, Homo sapiens
ccggagataccgttgcgccctgtacagtagttggggttacttgctcccattatatccagacgattgctgacaatatgcaatcacagaaatgaagcatgccatatggtcatccctccactatattatgattcatcgtaatgaaagtactgttcaaaacccttgtagaaatttgaaaggcatacctttcttttctggaagaaacattacaataagacaagccagtcctcctaggcacagaaatgctgataatgttcgcttccgaccaaaccatttttggttaatcaagtagatacagagagggtaagatggaatctctatgaggccagacagggccaggttggcataaatacttccacctagatcacccgcactcagagttaggccataatacaccaagctgcacacaaactttgtaagtatttgcttttgaaagggtagaacctcaaattagcagctcctatgtagtgttgtcaggtttggctttcaacggttttcttaatctccatgcctccaagcctcaacatttattatgc

SEQ ID NO: 482610 - DNA, 647 bp, Homo sapiens
  misc_feature (3)..(3): n is a, c, g, or t
  misc_feature (70)..(70): n is a, c, g, or t
  misc_feature (72)..(72): n is a, c, g, or t
  misc_feature (77)..(77): n is a, c, g, or t
  misc_feature (259)..(259): n is a, c, g, or t
  misc_feature (280)..(280): n is a, c, g, or t
  misc_feature (290)..(290): n is a, c, g, or t
  misc_feature (319)..(319): n is a, c, g, or t
  misc_feature (327)..(327): n is a, c, g, or t
  misc_feature (330)..(330): n is a, c, g, or t
  misc_feature (388)..(388): n is a, c, g, or t
  misc_feature (396)..(396): n is a, c, g, or t
  misc_feature (398)..(399): n is a, c, g, or t
  misc_feature (456)..(456): n is a, c, g, or t
  misc_feature (633)..(633): n is a, c, g, or t
canaagatttaaaaggcaggactgcttttttttagtcaatgttcacattaatgtaataaatttttattantngtgtnttttttgcacgcacactttttacagtgtctattgtgaaaaacatctcagctgagcagttttggtcaagattcagacctcatcaactgtttaactgtaataaatagaaaaataaagcagctggtgattttgtcagagagaatgtgttcagtaagagtagaaccactttctccagggatggcanagagtgtgaaatggttaaaanacctacaganccagtcgattgggcgattaaacactagtnagttatanttntatggtatttgattaaatagtctaatttaaaaaaaaatcttagattttaaattgattnttgaaatntnnataaaaagttgatttagtccttgggtttttcttagaaaaaaagcaaagtaaatatanaacctaaaacagcagaatttgttttggaatagtatcaatggaaactaccaagtattcagggaaaaagttactaaaacaccttgcttggttttacagtcatgtgctttgctttgcaaccattagaattagatagttacaaaaacactttataggtcacagaatgactcaaatgtatgnaaaataatggattc

SEQ ID NO: 482611 - DNA, 3196 bp, Homo sapiens
ctccgcagaagatttgttgccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggaagatttggagactggagttcaccttgaccctgccgtcaaagaagttcagtataatcctacctatgagaccatgtttgctcctgagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagaagagcaaaaagaattggatgaaatcacagcaaagaggcagaaaaaaggaaaacaggaagaagagaaacctggggaggagaagacaatcttacatgttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaagggcgtcagtgcagtcagattgtttcctctctctggccatttattgctgtcttgttccatggactgtaaaattaagctatgggaggtttatggagaacggcgctgtctgagaacatttattggtcacagtaaggctgttagggatatctgcttcaatactgcaggaacacagttcctcagtgcagcctatgacaggtatcttaagctctgggacactgagacaggacagtgtatatcaagatttacaaaccgaaaagtaccttattgtgtcaaattcaatcctgatgaagataagcaaaatctctttgtggctgggatgtctgataagaagattgtgcaatgggacattcgaagtggagaaattgtgcaggaatatgatcggcatttgggagctgtcaacaccattgtttttgtggatgagaataggagatttgtgagcacatctgatgataaaagcctaagagtttgggaatgggatatccctgtggatttcaagtacatagcagaacccagtatgcactcaatgcctgcagtgactttgtctccaaatggaaaatggctagcatgccaatcaatggacaaccaaatcttaatttttggagcacagaacagatttagattaaataagaaaaaaatttttaagggccatatggtagcaggctatgcttgtcaggtggacttttcaccagacatgagttatgtgatttcaggagatggaaatggaaaattaaacatttgggactggaagaccacaaaactctacagtcgatttaaagctcatgataaagtgtgtataggtgcagtgtggcatcctcatgaaacttctaaggtcataacatgtggttgggatggtctcattaaattgtgggattaatgagattaatccttaaactagctgggatcatttttgatccattgtcatatttatatttaattattaaatgtatctgatgataacttgatttacagataatgttgatgacattgaccctttgtttaaaaaaagaaactgtaaatttgacataatttcatttgcaacttcattttgttttttataaatgttatttatacagaaagtggctattgactttctatttgacaagtagttataattggcaagcagtttgagtttatactcatgacatactgaaagcatctctttggggtcaagaaagaatccctagtggatttgggattctagaggaggtgttataattaattattcagaaaaatgcatgtatttacctcttcaaccaaaagggcagtaaagaatagggataatatattttaatgtaaatttggaagaaggataaaatcacccacagttactctccctattattttcactgggtcaagttttaatcttttggcttcatgagttccactccctttgatgatatatgttgtatatttttagttgtaaagcagtaatctttaactgtagcattcctctaattataaacagtgaaaaatcaaaatcagtccagagttcttttgttgacttaattcctgatcagtatagacaggactatatatatttaatcagagaattacattatatctgaagatggagctcaggagaatgcaccaagactttgaattgtatttacattcactgtcagtaaagacctggctacgctttgagaaatcaggatctcctaggtcattgcttcgcagctgtgattactgaaatcctcctcataggagataaagtacgaggggtagagtccaagatgtcaacttgtaatttctttgaagtcatatgttttatctttaaaattattcttattttacctgtgaatatatacaacagaactttttaagattaaaaaatttttaaacctctatgtctgtttttagaaatttagattttaaaaggcgtgggacatacgaccaggccctatagccacataaatataaatttcatagaaaaagaataaaagcggagatatattttttgacacagaggcacccaaagaaatacaaacattgcctagctgctgccatttctgtaactgcccagaagggtgacagatttctgaaggggaaaggattcagatatgaccttttctttagtcccaaccactagttttaacaaatgtgaattattgaaatgtgaagggacaaaaagaatcatacatttaaactgtcttgttcagcataccaatattgtatgttacaaatcatcatttctaaatctggattgattctgttgtgtttttgactgtttctaaagtaagtgtgtataaaagtctcctttttaaaaagatcatatttttaaataaagcattttttgtagaaagtgc

SEQ ID NO: 482612 - DNA, 3406 bp, Homo sapiens
ctccgcagaagatttgttgccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggaagatttggagactggagttcaccttgaccctgccgtcaaagaagttcagtataatcctacctatgagaccatgtttgctcctgagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagaagagcaaaaagaattggatgaaatcacagcaaagaggcagaaaaaaggaaaacaggaagaagagaaacctggggaggagaagacaatcttacatgttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaagggcgtcagtgcagtcagattgtttcctctctctggccatttattgctgtcttgttccatggactgtaaaattaagctatgggaggtttatggagaacggcgctgtctgagaacatttattggtcacagtaaggctgttagggatatctgcttcaatactgcaggaacacagttcctcagtgcagcctatgacaggtatcttaagctctgggacactgagacaggacagtgtatatcaagatttacaaaccgaaaagtaccttattgtgtcaaattcaatcctgatgaagataagcaaaatctctttgtggctgggatgtctgataagaagattgtgcaatgggacattcgaagtggagaaattgtgcaggaatatgatcggcatttgggagctgtcaacaccattgtttttgtggatgagaataggagatttgtgagcacatctgatgataaaagcctaagagtttgggaatgggatatccctgtggatttcaagtacatagcagaacccagtatgcactcaatgcctgcagtgactttgtctccaaatggaaaatggctagcatgccaatcaatggacaaccaaatcttaatttttggagcacagaacagatttagattaaataagaaaaaaatttttaagggccatatggtagcaggctatgcttgtcaggtggacttttcaccagacatgagttatgtgatttcaggagatggaaatggaaaattaaacatttgggactggaagaccacaaaactctacagtcgatttaaagctcatgataaagtgtgtataggtgcagtgtggcatcctcatgaaacttctaaggtcataacatgtggttgggatggtctcattaaattgtgggattaatgagattaatccttaaactagctgggatcatttttgatccattgtcatatttatatttaattattaaatgtatctgatgataacttgatttacagataatgttgatgacattgaccctttgtttaaaaaaagaaactgtaaatttgacataatttcatttgcaacttcattttgttttttataaatgttatttatacagaaagtggctattgactttctatttgacaagtagttataattggcaagcagtttgagtttatactcatgacatactgaaagcatctctttggggtcaagaaagaatccctagtggatttgggattctagaggaggtgttataattaattattcagaaaaatgcatgtatttacctcttcaaccaaaagggcagtaaagaatagggataatatattttaatgtaaatttggaagaaggataaaatcacccacagttactctccctattattttcactgggtcaagttttaatcttttggcttcatgagttccactccctttgatgatatatgttgtatatttttagttgtaaagcagtaatctttaactgtagcattcctctaattataaacagtgaaaaatcaaaatcagtccagagttcttttgttgacttaattcctgatcagtatagacaggactatatatatttaatcagagaattacattatatctgaagatggagctcaggagaatgcaccaagactttgaattgtatttacattcactgtcagtaaagacctggctacgctttgagaaatcaggatctcctaggtcattgcttcgcagctgtgattactgaaatcctcctcataggagataaagtacgaggggtagagtccaagatgtcaacttgtaatttctttgaagtcatatgttttatctttaaaattattcttattttacctgtgaatatatacaacagaactttttaagattaaaaaatttttaaacctctatgtctgtttttagaaatttagattttaaaaggcgtgggacatacgaccaggccctatagccacataaatataaatttcatagaaaaagaataaaagcggagatatattttttgacacagaggcacccaaagaaatacaaacattgcctagctgctgccatttctgtaactgcccagaagggtgacagatttctgaaggggaaaggattcagatatgaccttttctttagtcccaaccactagttttaacaaatgtgaattattgaaatgtgaagggacaaaaagaatcatacatttaaactgtcttgttcagcataccaatattgtatgttacaaatcatcatttctaaatctggattgattctgttgtgtttttgactgtttctaaagtaagtgtgtataaaagtctcctttttaaaaagatcatatttttaaataaagcattttttgtagaaagtgcaaaaaaacatgttaaaaaaaaacttgtttgcgcggccgtgggcccgcaaaaattttgaagaccattggtatggcgcaccggcgcccataggtacagtgccacgttcccaacctttccaagaaaacctgggcacgacaaggggtggcttcctcccaataaaagcccgtggcaccgggttcgaacaccacggggctcggggccgggcctacg

SEQ ID NO: 482613 - DNA, 268 bp, Homo sapiens
aaaacacatcccatccaaatatacgcgcctttacgccgcgccttactgtccgcaacaccaattccgaacgccgctatcgattttccaccgaaaagcacgactacgcgaaccgcgaacgctcgcgccgcgcgtccgccccgcgcgcgacgctaatatctcatctctctctattatctttttccacagttcaaaaatcaattactcatcgaatttctctccgaaactacttcgacaatcttatttcattaaacatctcccaaccaccaaa

SEQ ID NO: 482614 - DNA, 2434 bp, Homo sapiens
ctccgcagaagatttgttgccgtcatgtcggctgcgattgcagctctggccgcttcctatggttcgggttcagggtccgaatcggactcggacagtgagagcagtcggtgtccgctgccagccgccgactccctcatgcacttgactaaatcgccttcatcaaagccgtctctagcagtggcagtggactcggctccggaggtggcagttaaggaagatttggagactggagttcaccttgaccctgccgtcaaagaagttcagtataatcctacctatgagaccatgtttgctcctgagtttggaccagaaaatccctttaggacacagcaaatggctgcccctagaaatatgctttctggatatgccgaaccagctcatatcaatgatttcatgtttgagcagcaaaggagaacttttgcaacatatggttatgcattagacccttcattagataatcatcaagtgtctgctaaatatattggttctgtagaagaagctgaaaaaaatcaaggtttaactgtatttgaaactggtcagaagaaaacagaaaagaggaaaaagtttaaagaaaatgatgcatccaatattgatggttttttgggaccatgggcaaaatatgtggatgaaaaagatgtagccaaaccttcagaagaagagcaaaaagaattggatgaaatcacagcaaagaggcagaaaaaaggaaaacaggaagaagagaaacctggggaggagaagacaatcttacatgttaaagaaatgtatgactatcaaggcaggtcctatcttcacatacctcaggatgttggtgttaatctacggtcaactatgccacctgagaagtgttatcttcccaaaaaacaaattcatgtgtggtctggacacacaaagggcgtcagtgcagtcagattgtttcctctctctggccatttattgctgtcttgttccatggactgtaaaattaagctatgggaggtttatggagaacggcgctgtctgagaacatttattggtcacagtaaggctgttagggatatctgcttcaatactgcaggaacacagttcctcagtgcagcctatgacaggtatcttaagctctgggacactgagacaggacagtgtatatcaagatttacaaaccgaaaagtaccttattgtgtcaaattcaatcctgatgaagataagcaaaatctctttgtggctgggatgtctgataagaagattgtgcaatgggacattcgaagtggagaaattgtgcaggaatatgatcggcatttgggagctgtcaacaccattgtttttgtggatgagaataggagatttgtgagcacatctgatgataaaagcctaagagtttgggaatgggatatccctgtggatttcaagtacatagcagaacccagtatgcactcaatgcctgcagtgactttgtctccaaatggaaaatggctagcatgccaatcaatggacaaccaaatcttaatttttggagcacagaacagatttagattaaataagaaaaaaatttttaagggccatatggtagcaggctatgcttgtcaggtggacttttcaccagacatgagttatgtgatttcaggagatggaaatggaaaattaaacatttgggactggaagaccacaaaactctacagtcgatttaaagctcatgataaagtgtgtataggtgcagtgtggcatcctcatgaaacttctaaggtcataacatgtggttgggatggtctcattaaattgtgggattaatgagattaatccttaaactagctgggatcatttttgatccattgtcatatttatatttaattattaaatgtatctgatgataacttgatttacagataatgttgatgacattgaccctttgtttaaaaaaagaaactgtaaatttgacataatttcatttgcaacttcattttgttttttataaatgttatttatacagaaagtggctattgactttctatttgacaagtagttataattggcaagcagtttgagtttatactcatgacatactgaaagcatctctttggggtcaagaaagaatccctagtggatttgggattctagaggaggtgttataattaattattcagaaaaatgcatgtatttacctcttcaaccaaaagggcagtaaagaatagggataatatattttaatgtaaatttggaagaaggataaaatcacccacagttactctccctattattttcactgggtcaagttttaatcttttggcttcatgagttccactccctttgatgatatatgttgtatatttttagttgtaaagcagtaatctttaactgtagcattcctctaattataaacagtgaaaaatcaaaatcagttttttttttttttttttttttttgatttttacaaatattgtttattttaatgaagctggta

SEQ ID NO: 482615 - DNA, 430 bp, Homo sapiens
tgagacagagtttcgctcttgttgctcaggctggagtgcaatggcgcaatctcagctcaccacaacctccgcctccgcctcccaggttcaagcgattctcctgcctcagcctccggagtagctggcattacaggcatgcgccactacgcccggctaattttgtattttcagtagagacggggtcagggtttccccatgtttgtcaggctggtcttgaactcctgacctcaggtgatccgcccgccttggcctcccaaggtgtacaggcgtgagccaccacacccggccaatagttattttcaagaccaaacgactctaccaaaaatgctgatttttttttaagacagggtctcgctgtgttgcccaggctagagtgcagtgacatgatctcgactcactgcagcctcaacctcctggcctcaggtgatcc

SEQ ID NO: 482616 - DNA, 900 bp, Homo sapiens
  misc_feature (792)..(792): n is a, c, g, or t
caggctgtaccggtcgcgagtcgtatggagagggtgcaggagcagacgggaggatctcaggccaggacgatggcggctctgcaggagaagaagacgtgtggccagcgcatggaggagttccagcgttactgctggaacccggacacggggcagatgctgggccgcaccctgtcccggtgggtgtggatcagcctgtactacgtggccttctacgtggtgatgactgggctcttcgccctgtgcctctatgtgctgatgcagacagtggacccgtacacaccggactaccaagaccagctacggtcaccaggggtaaccttaaggccggatgtttacggggagaaaggcctggaaattgtctacaacgtctctgataacagaacctgggcagacctcacacagactctccacgccttcctagcaggctactctccagcagcccaggaggacagcatcaactgcacctccgagcagtacttcttccaggagagtttccgcgctcccaaccacaccaagttctcctgcaagttcacggcagatatgctgcagaactgctcaggcctggcggatcccaacttcggctttgaagaaggaaagccatgttttattattaaaatgaacaggatcgtcaagttcctccccagcaacggctcggccccagagtggactgcgccttcctggaccagccccgcgagctcggcagccgctgcaggtcaagtactaccctcccaacggcaccttcagtctgcactacttcccttattacgggaagaaagcccagccccatacagnaaccccccttggtggcgagcgaaggctcctcaagattcccaggaaccgctgagggttcgccatccgtgttgcaacggtcatggcagaagccgttgacttcaaaaaatc

SEQ ID NO: 482617 - DNA, 200 bp, Homo sapiens
cagtgtgtaatggttatagaactcccacagcttctgaattatctcaggagacgtctttattgctccattattgaagaatagttttgccagagatactattctttgttggcaatttaaatctcattcagcactttgaatactacttatcccattctcatattgcctccaaagatttctgctattaaaatccatcgacattc

SEQ ID NO: 482618 - DNA, 337 bp, Homo sapiens
caggctgtaccggtcgcgagtcgtatggagagggtgcaggagcagacgggaggatctcaggccaggacgatggcggctctgcaggagaagaagacgtgtggccagcgcatggaggagttccagcgttactgctggaacccggacacggggcagatgctgggccgcaccctgtcccggtgggggaaagcgagggtccccagagcatcctgaaggctgagttgacctggagccccagctgcagaacgccggtggagggcgtccacagactggccccaaatgtcagccgtatgtctgagaacagcattttaaaagtatgtttctaaagtgaatcattttg

SEQ ID NO: 482619 - DNA, 881 bp, Homo sapiens
gaaagaaggtaaaatcatatgatgaaactccctgtttgtcatataagctcaggtgcctgatggatacgtgcacatagctagtgcatgacaaactgtcctggccctaagtgtcagtcagtcttttgttccctgtttcacagttctactacttcttgtgcttgcataacgatgcttctgagagaggccatgtcacgtaataatcgagatgtggaggaatactaggtgttctcaagacgtatacttctgctagtcacatgttgttccttcagcctagaggcagctttttaaataatgcaagtgtatttattagcattaaaattaacatctcagtaatcagcattagcatttctgaggaccattattaattctgagaacagaaattggtgccttgcaaggaagtttactagctctatcaacaagcattcaaggttacatctgctagcagagtagtgttaggaacctggccttactctcctctgacaatcgcaattttttcttattttttataaattcaagaagatacacttggcatcgtgtatcgaggctaagtttttcatgcatttcccagactacttatggagaattgcagtttaagttgctgaaaagtattaacatggtattaagcttaaataatacgtaatgggactagatggcccactaaagccactgttattttccttcctctctggcagggcactttgatccattccaaagtcaaaaaactggactgaagtctaaatttgtacttttcactaatatacattctgcttctgggcttatcttcttggtaacatccatctcttattgtcacaagttattggctagatttaacccgttgaagtcccatttaatgtggcctattttgaaccctgtgaaaggcc

SEQ ID NO: 482620 - DNA, 294 bp, Homo sapiens
tgtgggaccgcagagctacgcagacgcacttgggtgctcatacgctcttcctgctggcggcggaggtggtggtgtccttgatggtggacctgccgcctccaacagagctgaggacacccccaatggctctgccactgctggcactgaagccaccaccaaagccaagaccactgccataagagtagcataattccaccacccatgcctaaaccactgacgacaccactggcaccgccatagccactggagacagtggactgcaccacagagatattgcctttcggagaaaaggaa

SEQ ID NO: 482621 - DNA, 1217 bp, Homo sapiens
ctgcccgggaacatcctcctggacctcaactcactggcttgtggtctggtcgccacgcaaccctgaactctcaacaccctggacgacgtgccttcgacgtgcgacggacgacggatggctcctgaccgctaacgacgcttcgtgctgacacacctgggccaacagtcaccagccacacacacctgtgcctgccacttccacaccctacgcttctaactgtccctacggctgcactgccaaaccacgcatcggttgttgccccaccagaccaaggcactgtgctgagtgcgcactgtggtgagcaccggcagaccagacgtgggcaggctggtccttatcccatctcaccagcccgtgtgcacagctgctatgccatgcagagctgtggcaacttccacccatctcaggccacccacgcgccccacacacattgcaccagctccacacagacgttgccccagccactgggcattcacagcaaattctccaacaggttatccgccccccaacacaggcccccatccacaacccttgggcctagggcaccaaatcgcacaactccacccattgggcccaagccatgcgcacgcgatgccacccatttgcgacacggcattcccacacagtcgcatggatggggcaccagtatagtggcacccataggaaaaacacatcaaacggccccacaggagcgcaacattgggacacccaacacacagaattacacacacgtggcactggccatcgtgccccatccatggacgtacaccccattccgctggacaacacaacaccacccaccagacgaacacaaccacacaaaccacaaccaccaccgaccagaacacacaccccaaaaagcacagccaaaggagcagacggagcacgccgaacgaccaaccacgacgcggcacccaacgagccacaaccatgggacacccccacctgggacaaccacaaaccgagcggaacgaaaccaaccgtgccaccccccgaaagccgacgcgtgatccgactgttgagtcgaaaaaacacagccggtgcgcaaacaccacacacccggcacgcgggagactcccgacaccgcaaacacaacgcgcaggcggccacaacacgacaactgcaaacaagaaagaccagacgccaacccgacccacccgacgcgcactacaaccaaacgcggacgaccaaccaatggaccaactcactgcgcacca

SEQ ID NO: 482622 - DNA, 373 bp, Homo sapiens
  misc_feature (70)..(70): n is a, c, g, or t
  misc_feature (114)..(114): n is a, c, g, or t
  misc_feature (221)..(221): n is a, c, g, or t
  misc_feature (226)..(226): n is a, c, g, or t
  misc_feature (240)..(240): n is a, c, g, or t
  misc_feature (246)..(246): n is a, c, g, or t
  misc_feature (269)..(269): n is a, c, g, or t
  misc_feature (306)..(306): n is a, c, g, or t
  misc_feature (314)..(314): n is a, c, g, or t
  misc_feature (350)..(350): n is a, c, g, or t
  misc_feature (359)..(359): n is a, c, g, or t
ttacctgcatgcaatgtggtctaaggggaaaacaactaaagtcttaccccaactttcactcattcatttnaaatctgctttcagcaaagcaaacagaatgttcaaccttggacntgttttgattttatacaacctcacatttggaaatacaagtcctcaaaaagagacttcaaatttgcttcaagtcacctagaagatctacataatgaaacatactgtgnacacntaaaaacaaaatanttattnatggggggaagagtaccaaaggnaaggtggcaaaatcatgtattctcctaatggagaaangcaggggnctaagactcagacacactcagttctgggaaggactnaaacatacnctacaaaggcgagc

SEQ ID NO: 482623 - DNA, 1635 bp, Homo sapiens
ggtgtgcctgatggcaagaagaatgtggcaccaggtgctgctcccgagattctcagatctgatttccacgcttgctaccaaaatagtctgggcaggccactttaggaagctaggcgattatctagtgagcatggtcggacgctttcgatttcgcatttcccactaaatggctgagacttctcgccaggcgcaggatcagacctgttcctgggagctttccgagagccccgcgcctcgattctcgctctccgccgagctcgcacagctagggtgaggactcgcgcggtaccgcggagcttcatggccctcgaccggtggcgcggagagtcccaggcccggtccgggaccgggacggcgtccgagtgccaatgggctagctcgtaggtgtcccgctccccgagggtgccgctgtctccccggagcttctctcgcatggctggggacagtactgctacttctcgccgactgggtgctgctccggaccgtgctgtccctggcatattcgtccctgctggttgcccaccgcgctgcactgctccgggtctgggcgtgtgggcctgagcctgtgggccgtgctctgtctgggggtctgcggtgtcctcagggacaacggttggctccaagagcgaaaacgcaggtgcccaaggtggctggctgcttttgaacgcattaagttgcggtactgggctgggactatgcgggaattgcttgtacgaaactgactcatggggagcccggaccaggaaagaccaggtatggccgggaacctacgctttatttatattgtaaagatagccagagagtggcaactgacacctaccacagcaaggtagaccaataagataacagaaaaccccattgttgacccaaaacaacacccgtgagacgtcatctcacctgtgccagatctgggaaaaaacagccacaagaaaactgaagacagacagcgagaagcaagaccaagcaacaacaaatagagaacacacaaaacaaacaactcgccgagacagacaccaagaccaaaacgggggcgggacaggaagacgacaaggcgagtcaaaaggaaggcgaaagagaggaactaagacgcgaagggcgacacgggacgcgaggggacgcgggcctgcgaacgactagcacaaggcagaggaacgcgccgcggaagggagagacgagaggacagagccaccgacacacacgaaggccgcagagaaaagagacgaaagccggacagagagaacacgacagaacgaaaacccgagacacgaaaacacaacgcaacgagaaaaaaaaaagaaaaagaaaaagcgacaagagcaacaagagaaaaacaacacaataaaaaacaacaaacagacaagacaaacacaagaaacacaccaacagaggacataccacgacacaccgcacaaaagacagaaaagagcacaagaagcaagacaaaagaacaagacgcacaaagaaacaaccagcgaacaggaacgcaaaaacaagaggagaaaaggagcacaaaaaacgcaggacaaaacagcaaccagcagacacaacgaagacaagcaacacgcgacaaaacaagagatacaggccagaagagagcaaagacaaccgaagccacgaacagagacgaaccaagcg

SEQ ID NO: 482624 - DNA, 732 bp, Homo sapiens
agcggactggggactccggaggcacggggaggaggaaggtgcgggcagcttgcggtgaggatggacgcgtgccaccgacgtatgccagcggctgcagggggccaaacgcctatccacaaaacccaccgcgatcgctggcagccgtggcgggaggcggcagcagttggcagaggtgccagggagggccggctggggcaggtggatcctggcagcagcagcgcaggggtcacgctccaggcctttctccaagccctccccgcgctgggacgcatttacccgcctgcctgttgacttcggctggcacccactcctgggctgctcagagctgctgctccctgttgatgagcactgtaggtggcttcgagatgcacacctcgggacgatctgccttcctcccccgcctgccattcccgcactgacaaacgtctgccctgggtgttaggagcgaggtgcacattgcaccttacatcctcatgggcggctccaggagcctcactgcagctgatgagtacttaacaccatcatccatctgtgtggccgttggggctggcacagaagctctggatgcctctacctggacaaccagggctgttctccctggatggcaggaaggaagcaggtgggaggcgggcggaggtgcttgttccaccggcactcctgggttctgagggacatggcacttcccggctgtggtcttgctttggcataagttctgagcttctgcttctctcg

SEQ ID NO: 482625 - DNA, 185 bp, Homo sapiens
ccaagatcatgccactgcactccagcctgggcaaaagagcaagaatcgtctcaaaatacactgaaagaacacatgctggccaggcaccagtggctcacacctgtaaccctagcactttgcaggccgagccaggcagattgccggagctcaagagtttgagaacaggctgggcaacacggtgaaac

SEQ ID NO: 482626 - DNA, 825 bp, Homo sapiens
gcaccactgcactccagcctggacaacagaataataccctgtctcaaaaaaaaaaaaaaaaaaaaaaaaaaaaaaaaaaaaaaaaaattttgcccttgattcaaaattttaccttttaacccttggttaaaatggttgtaggaagttgacatgtggttacaaaattgcttgcagcagaagcgttgttgttattgttgcgtgaaaaaaggagtttgacttagggcagatgattgtgacattcttcgtgtcccagaattatttggcttataccttctccctgtgtcgtgggcccccttcccttattaggaagcattatattatgtgccctcattcccccttactttacaatatagggtttgggctatattaggagactttgctttgggccaggtggaattattgggtatagagaagggcaaaattattcgcgcccgggccgcaatgggcttcacacctgtgttaatctcccaagcactttgggaagagattgatggcgggttggactcagcttgaggttccagcgaagtttccgaagaaccgagttcgttggcccaagcgttggttgaaaccctctgttctctcactaagggttcacaacatttaagcccgaggcattggttggcccacggggggcccttgttaaatcccccagtgtgcgtggaaaaatgcgcttgaagggcacggaagaaaattcaccttttgaaaccccggggaaaggggagggaggtttgcaatagagccccagaattaatgtccatttgacatcccagcttgggacaaaagttgaaccctccgtcttcaaaaacaaacccataaaaacttgtg

SEQ ID NO: 482627 - DNA, 155 bp, Homo sapiens
  misc_feature (41)..(41): n is a, c, g, or t
  misc_feature (88)..(88): n is a, c, g, or t
  misc_feature (94)..(94): n is a, c, g, or t
  misc_feature (98)..(98): n is a, c, g, or t
agagccggtacctcagtgaaacgcagctgaagatattgtanaggtcatctaaaatgaccactaattgcctggataaaggaattaatanatttantganatactgtctttcggaaatgggattattagacctcctctttgaggggaaaagaccctg

SEQ ID NO: 482628 - DNA, 198 bp, Homo sapiens
tggatgcacctgaatgctgttagccttatttacagttatcaacctcatatgccgcaggttcgagtttaccctggtagtcttaagttgcagtgagccgagattgcgccactgcactccagtccccaggcaacagagtgagactccatcctcaacaaagagaaaaagagaaaatgatgttaagcacacggcattacccct

SEQ ID NO: 482629 - DNA, 487 bp, Homo sapiens
agattctgtgtatatggaggatatgggaaagttgaaagatactagataatactagctagatatcatgatgataagcccaggtgccttgactatttaactgacagattaaaaggcagtctgcgtcatcttacttataaaagcaaaatccagaatacttgtagactacctaaatagcacttcttgctgtgtttacgactggtggtatctattattgtaataaatacacagtatggatgtgatcaaacattatctattatgattatatacgaacacttcatgttatctgaaaatcaagagatccatcctcactacatcctccatcttcactcattcattcttccaacaaatttgagacacatcaaagatctatccacaaaaattagagcttgactaaactagcaggaacttaacagaaagacaaacatcacaaagagatatgaaccatatggaataaacgaatcaaaacacatgatatcacatgaccata

SEQ ID NO: 482630 - DNA, 312 bp, Homo sapiens
tatacacacagtaatatatacatagactacacacaaataaaaaatatgtaatacaaaaacaatataatactcctatacaaaagcaactaaatataaaatgtttggcttacgcactgtcattgctattatgcctttgcatgaaattccactcttacgactccattgtcccgcaacaggccacatatcagcttgtaatctttaatgaatattctgtaacaagttcctgaagttatctaattctttcacacttgtcgaaattcttccaaatgcgttgaataatgatactatttcttgtctggttagatggaattc

SEQ ID NO: 482631 - DNA, 181 bp, Homo sapiens
ctgtggtgtaccgtgggggaaatgtaacttatctagtaggagaataataaaagaaactttgtgtagttcccgtcctggcacagcagaaacgaatccgactaggaaccataggttgcgggttccatctctggcctcgctgagtgggttaaggatccggcgttgcagtgagctgtggtgtagg

SEQ ID NO: 482632 - DNA, 214 bp, Homo sapiens
aaaaaaaaaagaaaagggatggttaaaccgagaagagcagacggttacctctctgagagtgatttctacctggtccatcttatcaggttaataagtgttactatgtttcattttagtaacccacaatatctggattaaaaaaaaaggcggtaatccagtggggatactttaaggcctggtttcccttttacttgcctcctgggaaatctatctg

SEQ ID NO: 482633 - DNA, 140 bp, Homo sapiens
  misc_feature (21)..(21): n is a, c, g, or t
  misc_feature (27)..(27): n is a, c, g, or t
  misc_feature (129)..(129): n is a, c, g, or t
tcccggcattgccaggacagncaccancctggacaagatcaccgtcacggctcgctgatcccgcagacccaggttgagacccagaccccggtcatgaccatcagcgctgaagccatccagtcgcgcggnttcaacagcgt

SEQ ID NO: 482634 - DNA, 344 bp, Homo sapiens
  misc_feature (63)..(63): n is a, c, g, or t
tcacggcagagagcggtctcatcagaactaggctgaagaaggtgcaggaccttgagaatgttntgggtcactcatgtcacccacgctctgttgcgtgcagaggagaggcagtcgttcctctctgaagactattatattcgattggcctctggttatggtgcacatataaatcagagttaatatatgaacgcgtgtgcatgcccagtgtgtgttgtgcctgcgtgcttgtgcgtggcagggttgtgtgtgtgtgtgtctggctgtgcgttccggattgtgtgacgatgctgacctagctgtgtggccttgggcttgttgcttcattactcacctggatggggacg

SEQ ID NO: 482635 - DNA, 155 bp, Homo sapiens
gcacgagtcttaatgcaagcatcaagagccctgaaaatggctaactaggtaaagtataccattttcggggctcccgctgcctgccctaaaaaaaaaatcttttttctttatcttctactctaactcttcctcccctcaccgtccaccccccgacc

SEQ ID NO: 482636 - DNA, 860 bp, Homo sapiens
cctctttgattttcagtttctcttccttgctcatctgtttccgagctctccgtcgtgggctctgaaacagatgagcaaggaagagaaacctggaaaattcaagaggagaatgaaaaatttactggaaagaaatatggatcctggtatcaatgggataaaccaacaaagaagaaggatggcttaaactttcacggaatatgagccttcctgggactttttccggtgggccggcgggcaaccaaccccaaaagaatggggcatgcttggaagaagaacggaaatcaatggcccggaggatttcattcattcacacttggttaggcaaagatgccaaagggttcctttcttccttccttccagggacattaaggtgggaaacgaatgtccgggcatggattaaccaagggttactttggggctggggtttccgtgggacagaggaacattccaaaggtttccatttaaatacattcatgctttaaacccttagtccaaacgaatcaaggcgtggagaagggacgtgggcagaaaaataaccgaggaacgggctcgggcgggctggaaaagcacatggttgtgggaccacagaatgccgggcagaccaggtaatccagagaaggacaagtcacacgtccccacaacggaagaatgaaaacgtgccgggcaagtacgaggctgagaagccccgtgtaactctcagtccgaacaaggctgtggctccctggagaagccaggcaatggaaacacgcgagggacgggagcaaaccagcggacccctggtgggctggtgggtccaacttcgaagtggccgcacaccaacctacacccaaaagtgactggccggcatagtcgcgtagccg

SEQ ID NO: 482637 - DNA, 374 bp, Homo sapiens
ttagatgtagatctgtggccaggcggagctgtgcaggaagcagtgggcctccacctgcctaggaagaggtttagtttcctgaacctgtgccctgaggtcaaattctggttcttccgctcactgtgagacctgacctctctgagccctggtttcctcggttgtaaaatgggaataacagcacctacctcacagggttattttgatgatcagatgagataagagatgtgaaaatgtctgtgcccgtgcatagtaggctcgaatgcaaagtgcaggataggaaccgaatgccatgagtctcttgagcatgtgttttctttctttctaggtaacccagctggacccaaataaatcattattggaggtaaagttgttcc

SEQ ID NO: 482638 - DNA, 100 bp, Homo sapiens
tagaggatcccccgggccagtacggatgtgctcgttcgagtcctgattggtgtccatgtcactgtgagctcgcagtgctttcctagtcgctcgatagctc

SEQ ID NO: 482639 - DNA, 420 bp, Homo sapiens
  misc_feature (80)..(80): n is a, c, g, or t
tatattatcacacccatatgttataatattccatattaccaagcctattgatggtgttatttaaatatcctatatctttncctttttatgtatctttttgtaagagacagagtctcactctgttgttacctagggtggaagagtgcagtggtgcaatcatagctcactggaggctcaaactcctggcctcttgccttggcctcccaaagcactgggattatagttatgagattttcatcatgtttttgtgtgtgtgtgtataaaaagacctcactctgtggttctgtgcatgtgtgtggtctctgcattttaggaattctgtttcataaggttggctccttccttatacagtgcatgaaagtttatgactgttatatcttcttcacaaattgtaacttttctattcatttacataaatgt

SEQ ID NO: 482640 - DNA, 136 bp, Homo sapiens
gattctctcatctcgcacggggcgggaaatcgggctgaagcgactgagtccgcgagtggacgagagaaaaggaacagttccgtaagctctttatgggtggcttaagcttggaaaccacagaagaaagtttgaggaa

SEQ ID NO: 482641 - DNA, 231 bp, Homo sapiens
gtccatacatagtctgatgacataataatgtaatttagatatgatcatcagcatgaaaaaaagtaataccttaacagtacatttctttttttttttaaacgacaacccattattggcagtatttcaaatctagaaatgggttacttccaaaacagtgttacaattagcctactaaagataatttcttcccatcgctttatttataaagtgccagaacacacacatgcactt

SEQ ID NO: 482642 - DNA, 179 bp, Homo sapiens
gactctagagtatccccccgcgttcatgtcttacgcacagcgcttaactcgcactgatattttacctcagtatgcctagaaataaacatctagctttataccagtactaaccaaaaaaataaaccctcgttccacacaacctgccatcaactatttcctcacgtcagacatcaccgcag

SEQ ID NO: 482643 - DNA, 145 bp, Homo sapiens
accccttgcaactgtccacgggtgccgtggccccaggggttgcccacctgcgggccccggccgcccctccttgtgaaagggcatttttgtaaatgggtacatattaaaggaagccctctgtatatttgattgaataatgccccca

SEQ ID NO: 482644 - DNA, 112 bp, Homo sapiens
aatgctagcggactcggcattgtcgcccttagaccccttgtgaagcccaagatcgtcaataaagagaaccaacgaagttcatccgtgcaccaggtcagacctgatatggcta

SEQ ID NO: 482645 - DNA, 376 bp, Homo sapiens
ggcccctcagtcccttcctactccccaacaagggggtcactatccccaaaaaaggagctgttggggacccccgacgcagcccctgtactggattacagcatattttcatttttggccccgaggctgcctgtggggggagtggagacctcccatcaatgaggacagatcacagaccacgagggcctttcccggacctggaggttgcctccaaagcaggccccagctttttccctctttagacaaaaaaatttttgtaaggttttggggcagggagggagcatgaaggacgaggaaaacttgaattccagatttttaaagcaaaggatttatcatttttaccagaaaaaaacgttttaagtttttacttgaaaaaaaa

SEQ ID NO: 482646 - DNA, 342 bp, Homo sapiens
  misc_feature (1)..(1): n is a, c, g, or t
nggggtgggtttccccccccggggcttttttttttttaggggttggggggggggggaggtttccgcccccccccccggcccaaaaaagggggtccgggaaaaaaatttttgccctttgggggggccccccctttaatgggggttttttgggggggggttagggccccctttttggggggtggcaatttttggtggggcccccggttttgggtttttttcgggggctttttttcccgggggggcttgggggggggggggccctgggccggtttccctttttccttggttgggggccccctgggccccccccccccccctttttttcccctggttctccttgga

SEQ ID NO: 482647 - DNA, 83 bp, Homo sapiens
atgctggaaaagctccctcttctggtcctggctcagggggctgggattttgaaatattttctaataaaggactttgtctccca

SEQ ID NO: 482648 - DNA, 157 bp, Homo sapiens
tcgtaccggtccgctcggaccatacctatgtatccaaatggttctttttatccggagtagtaagttacaatatgggagattattccgaaacctggtaggataagaatataaacttcagggtggccgaaaaatcagaataggtgttggtccgagcgga

SEQ ID NO: 482649 - DNA, 181 bp, Homo sapiens
cataattgttacagggctcaatttcagcaagaagctctcactatcttaaatgtatatgcacccagcatggaagcacccagattcataaagcagttcttagatttcctcaagagacttagactcccacacaagttgtaaccaatttttgaggtattataatgaaaattggggtctgatctcc

SEQ ID NO: 482650 - DNA, 528 bp, Homo sapiens
  misc_feature (26)..(26): n is a, c, g, or t
  misc_feature (37)..(37): n is a, c, g, or t
  misc_feature (56)..(56): n is a, c, g, or t
  misc_feature (100)..(100): n is a, c, g, or t
  misc_feature (109)..(109): n is a, c, g, or t
  misc_feature (220)..(220): n is a, c, g, or t
  misc_feature (333)..(333): n is a, c, g, or t
  misc_feature (335)..(335): n is a, c, g, or t
tttttttattggcttcttaatggaancaggattttancaactgatggaatttacgngattacacaagtagcttggttataaaggctgtctgttttatatngaccttaangaaaacaactatgccaagactgtcttgagctacgggtaagacttagaaagtgattgcagagatttggaatgattaatctatgtagaaccagaagtttaagaatttgttaancagaaagcagcatatgagttaatattttgtggttaactcttgacttgttttgagccatatctgattttctgtctcctagtaaacttttaagaaatgaattctgtttttatttntntatttttattttttacttttttgagacggagtctcgttctgtcacccaggctgaagtacagtgacacaatcttggttcactgcaacctccacctcccaggagaatcacttggacccgggaggcggaagttgtggtgagctgagattgcaccattgcactccagcctgggcaacaagagcgaaactccatctca

SEQ ID NO: 482651 - DNA, 411 bp, Homo sapiens
gcagtgtccatttcccccgtcctcaggctgtgtgttcttcacggcagctcagaagttttctccctggacgtcagcagctgggctggacctcctctgtaggcccccgtccttgggctctaggctcgtgcagcccctgcgaggacgttggaaatcagcctgtctcttggccaatgtcctgtgttttcccctacgcctcttttggaggagcgaggaagaggaggagggagagaagcaggatggagaccaccaagaccccgtatcagtacctcccagtgccttctcagaccactgtggggaactgaccctgtaggcatgaggggctggtcctcagggcctgcagctgttgaaacggaccttgtgagtcagggcctgggaccctccaaggatcctgagactataagctccaggagg

SEQ ID NO: 482652 - DNA, 581 bp, Homo sapiens
  misc_feature (427)..(427): n is a, c, g, or t
cgcacacatgagggcgctggaggcatatactatacacactgtctgctctgtcatacccttcccagagcgtggaccaccaggctggccacctctccctgactttaacaggtaatggcaactaaggatctataggacccgctcatctgcagatacttgcattgagatggcgaaggcagagcgttccagatagtatggggtcccccatagaagcattaacccctggttattcccattgagcttcacacagccctgcacacaatggacacccaggaattggtgtcaacagaagggcgtgagcaggttgcacaggagctgggtaggctgaccatgggacctacactctctagcactccactcatatttactgacagaagcccagagagattaccttcacccagactgtggcccactgagacatactagacangctgtacttcaagcccagctgagtggattattgggcactgtgaggacaggcgtttcgacctaacagtgcccactctgtatagactcacactctattgagagattctgcagagccccatgacatttattcacaggagtccaccatacctgcgttt

SEQ ID NO: 482653 - DNA, 206 bp, Homo sapiens
  misc_feature (63)..(63): n is a, c, g, or t
  misc_feature (74)..(74): n is a, c, g, or t
  misc_feature (138)..(138): n is a, c, g, or t
tcataaatctttcttttattccaagtttcaagtatgtgtaagtgtctgtgatgacacatggtnctcagtgagcnccctgtcacccaggaccctggttatagcaccgttgatcaaaaaccacagattgacacagagatngtcacttacacagtgggttgtttttcttagatttgtactcaaggccagatgtcatattaatgcaatat

SEQ ID NO: 482654 - DNA, 409 bp, Homo sapiens
ttcatgtacagcgctttcatgcgggctgggaagaggggagactgaaggatgacgtgctccacgggtctgggtgtcacgaaatcatgatcgagtgctttcatccctaatgcgaatcactactattctaaacccactaacaaactacatagcctatccattcctcatgccttccatatgaggcataatcataaccagctctatctgcttacgtcaaaccgacctggcatgaaggcactcgatatgaaatgtcgagtgccttcatgccttacaattgagatttgcccataggttaaacatggtaagaaacaaccgaacgcataaaagacaaatctaggccgggtgcagtgtcttcatgcctatattccctgcactgtggtaggcaaggcaggccggatcatggggtaccgag

SEQ ID NO: 482655 - DNA, 844 bp, Homo sapiens
  misc_feature (24)..(24): n is a, c, g, or t
  misc_feature (29)..(29): n is a, c, g, or t
ttctgaattattgtatatgtaacnttttnctttcaatagtgtgccccctcctataatatttctctcgctttcgacctttcttgttgtgctgctccagctgtgacgcatcactgcaaccatgagtcaccgcattctccacttcccaaggttacacacttctgatggcactaactgtatgttagaattgtgtggcaaagaactgaaggcatcatcccaaaagcccaaacaactacataccgccaacaaccccatgaacttggaagtgggttctttcccagtgagctctggagatgacaaaacacagacaacaccttgattgtagcctgcgacaaaacctggagcacaagacccagctaacttgcgctcacattcctgaccaatacaaattgtgagacatatgtctattgttttatccaatccttcgataatgtaagatgaaccgatatataactaatacaaattataaaactgtatacattcgtttcatcatctattcccgcttatattcaccctcaattttccactggcctgctctctgcatatcatcctctccctatcgtctccaccctcttctctctccttttctatcatcccttctgctgtttctcccgctcatatccgctgccccctatcaccagctttttgcacatcccactctcgtcgccacccgatcctcatcccgtctcgtcgcgcttttactttttcccgttcctccctttcccttttcgtttctattcgctgtcccattctttcccatccttttccatctcattctcccctccttcttttcttcttatttctcccgtctcttcctcctttatcttctcacttctttcttttgctc

SEQ ID NO: 482656 - DNA, 946 bp, Homo sapiens
  misc_feature (93)..(93): n is a, c, g, or t
  misc_feature (105)..(105): n is a, c, g, or t
  misc_feature (107)..(107): n is a, c, g, or t
  misc_feature (110)..(110): n is a, c, g, or t
  misc_feature (113)..(113): n is a, c, g, or t
  misc_feature (121)..(121): n is a, c, g, or t
  misc_feature (126)..(126): n is a, c, g, or t
  misc_feature (133)..(133): n is a, c, g, or t
  misc_feature (146)..(146): n is a, c, g, or t
  misc_feature (154)..(154): n is a, c, g, or t
  misc_feature (163)..(163): n is a, c, g, or t
  misc_feature (170)..(170): n is a, c, g, or t
  misc_feature (175)..(175): n is a, c, g, or t
  misc_feature (178)..(179): n is a, c, g, or t
  misc_feature (228)..(228): n is a, c, g, or t
  misc_feature (248)..(248): n is a, c, g, or t
  misc_feature (258)..(258): n is a, c, g, or t
  misc_feature (311)..(311): n is a, c, g, or t
  misc_feature (944)..(944): n is a, c, g, or t
ctttagaagtagggcaattgttttttaatcggcaacccatatctgaaagccatttcttaggaataagagaccttaggtgttgaattggcaagntctgcataaagnanacngtnatcaaccnctggnacttttnattgagaatttgnttcaaggnatgcttttncctccantgtcntgnntgtcaaactagttttatagctatcaacattaggagtaactttcaacctngccagcatcactggtatgangtatatttanttaaagcacacttttccccgaccgtatacttaaaatgacaaagccattctttnaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataataaggtaataacattttatacaatttccatatagtctattcattaagtaatctttttacagttgcatcaggcctgaacccgctgccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaaccnca

SEQ ID NO: 482657 - DNA, 977 bp, Homo sapiens
  misc_feature (93)..(93): n is a, c, g, or t
  misc_feature (105)..(105): n is a, c, g, or t
  misc_feature (107)..(107): n is a, c, g, or t
  misc_feature (110)..(110): n is a, c, g, or t
  misc_feature (113)..(113): n is a, c, g, or t
  misc_feature (121)..(121): n is a, c, g, or t
  misc_feature (126)..(126): n is a, c, g, or t
  misc_feature (133)..(133): n is a, c, g, or t
  misc_feature (146)..(146): n is a, c, g, or t
  misc_feature (154)..(154): n is a, c, g, or t
  misc_feature (163)..(163): n is a, c, g, or t
  misc_feature (170)..(170): n is a, c, g, or t
  misc_feature (175)..(175): n is a, c, g, or t
  misc_feature (178)..(179): n is a, c, g, or t
  misc_feature (228)..(228): n is a, c, g, or t
  misc_feature (248)..(248): n is a, c, g, or t
  misc_feature (258)..(258): n is a, c, g, or t
  misc_feature (311)..(311): n is a, c, g, or t
  misc_feature (975)..(975): n is a, c, g, or t
ctttagaagtagggcaattgttttttaatcggcaacccatatctgaaagccatttcttaggaataagagaccttaggtgttgaattggcaagntctgcataaagnanacngtnatcaaccnctggnacttttnattgagaatttgnttcaaggnatgcttttncctccantgtcntgnntgtcaaactagttttatagctatcaacattaggagtaactttcaacctngccagcatcactggtatgangtatatttanttaaagcacacttttccccgaccgtatacttaaaatgacaaagccattctttnaaatatttgtgactctttcctaaagccaaagtttctgttgaattatgtttttgaatccccaagaaggcagcatgtgtatacaaccataccaccttgtacttaggggtatggttgtatacacatgctgccttcttggggattcaaaaacaggtttttgattttgaatagcaattagtgatatagtgctgtttaagctactaacgataataaggtaataacattttatacaatttccatatagtctattcattaagtaatctttttacagttgcatcaggcctgaacccgctgccattcagaaagcttcaaattatagaaacaatactgttctatacgagtgaccgattatgctttctttggcctacattctttattctgcggtgaagttgaggcttataagttaaaacaaaggaactaacttactgtccaccagtttatacagaactcacagtacctatgacttttttaaactaagatctgttaaaaaagaaatctgtttcaacagatgaccgtgtacaataccgtgtggtgaaaatgaattcagacttattaaatgatgaacttgttaaatcttctcagtgtctatttatcagcacaatacacacaggagaactgttgatggcatattgaatagattttcctgaataaattgctctggaaaccnca

SEQ ID NO: 482658 - DNA, 417 bp, Homo sapiens
  misc_feature (20)..(20): n is a, c, g, or t
  misc_feature (24)..(24): n is a, c, g, or t
  misc_feature (106)..(106): n is a, c, g, or t
gctgttagctggcgaggatngcanaatggattgctggcccaggttttagatatttaacctggctgcagagccaaaagtgaaccggaggaaaagcaggtgtgaaacnaatctgcagcggagatgtacggttcctcatttgacttggactatgactttcaacgggattattatgacaggatgtacagttacccagcgcgggttcctcctcctcctcctattgctcgagctgtggtgccttccaaacgtcagcgtgtttcagggaacacctcacgaaggggcaaaagtggattcaattcgaagagtggacaaaggggatcttcttccaagtctggaaaattgaaaggtgatgaccttcaggccattaaaaaggagctgactcagataaaacaaaaagtggattctcttctggaaagcctg

SEQ ID NO: 482659 - DNA, 104 bp, Homo sapiens
atggactggttggctttgttgggtgagcttgtatgtagtcctgtgggtggactgtggttggtgcttggcaggatcctggtatcctgctaacaggtcaaacatgc

SEQ ID NO: 482660 - DNA, 384 bp, Homo sapiens
ggtcacggatgtctcagtcagcagcccagctgcggcggggagctgcgtagactgtgcacagcacagcatcttgtgagcacacttacaccgtgccagatgtccgtcccgcgatcgttcgcatacaagctatgaacgtaatgaaccgtccagctcgaccatggctggactggtgtctcagaagtctggcgcacttgagacgcgacattagctaggagtacgatatggcagcatggaccacgagtgagcctctgtcatacgcctggtgttgaccggtgccccctgtgtttgcactcgcattgatcaccaggcccacggtaggtcaaaaacaggtatcataggtgacgcctccggtctctgaatattgcagcaggtggcgcgtatccc

SEQ ID NO: 482661 - DNA, 409 bp, Homo sapiens
cacagtatctgtagaatgcattgcccagatccatcaaccaccaccttagcaaatggatcaggaagtcggaaaaaatcctttttcaccaggttttttgcacagagtactgtcaggcgcagcttgacgggcccgttcatccggcgtccggggttagacatgtccccggcggcgggggcggcgggggcggcgggcggcacgggggcgacggcgaggcgcggcggagtcaccacagcggccgggctggggcccgagcagccggcgcctcgcgccacggccggagggtcccggatgtgccgagagtcgtcgccatgagccgcggagggagcgggacgccgagctccccagctcctcccgacttctcctatcacgtgcccagggccgcacaagcagagacggcagccgcggacgc

SEQ ID NO: 482662 - DNA, 86 bp, Homo sapiens
ccgggatccgaggtgcgccgagcaggagcagggaacaaaggagcggagaggggaggggagagaggggggcgagggagagcccccgg

SEQ ID NO: 482663 - DNA, 143 bp, Homo sapiens
aaggatgggcgataatccatggattatggatgagcagattacgtgaatttaaactgatgacgaagaacaagagttccgtaaactgtaaaagtatttaaaatttcccatcttgaccgggcgcggtggctcacgcctgtaatccc

SEQ ID NO: 482664 - DNA, 175 bp, Homo sapiens
  misc_feature (12)..(12): n is a, c, g, or t
tctagaggatcncctttctctgatcgctcatggagggggaaggctagtcatagagagatgacatctaagcttctttctagactttgtgggacagtaatgagcacaactgatgtggaaaaatccatttgataaattggttgaagatctacctgaaattagcactggatactcctaa

SEQ ID NO: 482665 - DNA, 293 bp, Homo sapiens
  misc_feature (88)..(88): n is a, c, g, or t
  misc_feature (287)..(287): n is a, c, g, or t
ctccaccccccaatctttttaaatggcggataaatcccttctttctggttcactaacttcatgccacacctggtaaccaactcctttnggaggcattccttttgttagaaagtgcaggcctccatggagttacctggaaagctgccatccctgaacactctgaggaggaatcaagaatagctggaattgaagattctgcatgggattgctttgcgcagggaaggggactgaaccgttgaagagagatcagatcaactgggggaaaggcctaggtagctcagtgaccnggggac

SEQ ID NO: 482666 - DNA, 798 bp, Homo sapiens
agcgggcagtcggtgtctccgcgtcgctgggtgggacttggctcggacggccatgggcaccgtcagaacgagcgaagtctggcgcgcccgacggatgttgcacggacctggcgaagagaacacagagcttctcaggaggctggtagctgcaggcagtggtacaaggggcttcatcaaggaactgcccccacgaggaatcctcaattgtggtatgagttcaatgaatgatctactgccaagcttctttccgctatggtgacgccgtccaaagttgtgcctgagctacgtcttccgcaccttttgaccagcaacaggcgatggcaccatagacttgtcgggagcttcagtcattgcgctgagcgtgagctcgcgcgggcgtctggagcagaagctcatgtgggccttcagtcatgtatgtacctggtacggtcaacggtctacatcatgccgggagtgattatgctgtgagatcgtgcagtgccatttacatagatgcgttatcgtgccgatgatgaagtatgccgcgaggactgagtcgaccccggcaaagagaggacggacgaaaatcttccgccaattggacacgaatagcaatgtactggcatggctgtccttgcgaggagattcaatccgacggggccaaaggcgacccgtcatcgtgcgtctgctgcagtgcgagcacagcatgcgcctcccgagtcctgatgaggacgccagggttcccctttctccctcccttcgccggacccctcccggttcttaggttccacgtcccttgtgtgtatctggctgggggca

SEQ ID NO: 482667 - DNA, 366 bp, Homo sapiens
  misc_feature (15)..(15): n is a, c, g, or t
  misc_feature (146)..(146): n is a, c, g, or t
  misc_feature (355)..(356): n is a, c, g, or t
ggacccaaaaattanaaacaattgtgaacccccagggaaaccgtggaaggatggttaccccagaggcctgggaagaatagtagtagggaagtggcgatggttaatgtgtacaaaaacaaatagaaagaatgaataagacctagtanttgttaatgcagcattgtgactatagtccataattaattgtacattttaaaatagaagagtagaattggattgtttgtgcacaaaggacaaatgcttgaggtaatggaaaaaccccatttaccctgatgtgattattacacattgtatgtctgtatcaaaatacatcatgtaacccatgaatgtatacaccttctatgtacccacatannttaaaaattt

SEQ ID NO: 482668 - DNA, 751 bp, Homo sapiens
gtcgccatgggcctgtgtgatcctgtggacatgatgtgaatgggcgccgtggtctgtgttcctgctgctgcacttgtaagcaccgtaaatgtgctgctgcgcgcctgcgcgccgtggatttcgctgagcggcacggctacatcaatgtgtgcatctgtcaagtgacatcatccactgaccctgttggcctgctgtgctgcggcccctctgccaatggtgtgtcattcctgggatccagtatctggtattaagaatgctgtgactgtgatgcattgtttcaattgcctgcctgagtggcaatatcatcacaggagccaagtataatgtgtataagcaaggcaagagaatgtgccacagagcatccaaacattgcggacaattagttgctcccattgatagagagacaaccaattgcccttagatatgagataccaaaatctggttgtttgcttatggccctttgagaaagagagaaaatggcccttagagagttaacactagatagtgcaaaactggcttatggaccttgcgggcaattcaacgtgggaaacactaattgcccaacgctggattaattctttcccaagcaaaagcaccatttgacgaacaccaagagaacaggaaccccggttgttgaaacagctttgcaccttctcgagtgaattccaagagaaaaggagtatatcataccatcaaagccaaacaagaaggctagtaaagtcatggtagttgagtagagcttggatcagtg

SEQ ID NO: 482669 - DNA, 882 bp, Homo sapiens
ggcgccccgccgtgctgcggaggggggttccaggaactttccaggaatcggcctcacgtgaccgcgggccccgtatgttaaagaggctcgtcgcaatacacaggcttcagggaagacggagttgtgccatctcgttaccagcaccaaccaccaacaagcaccctcaagactccctgtgatcctgggatgcactcaacgaagatgtgtgtgggcccagggattgggattggaaatgctacaagagaagcaggctcctccccttctgaaatgatgggtgatacattgaccatacaggtcaatttttcccacccaactttgggggggagccttgtcaaaagaacaagggcaaccaggagaagagaagcagagcttgaggtgggggtgaagaagggagaaattcctgaggtgcttgaatccaaaatgcggaagccgaaccaacactttggacttctcaataacaggaagcactctgcgaggcattatgtgggagggctacaactaagatttctctgcagaaaagtgtctagatgcaccagatttgggggctgtgatgtgaaaactgaaccttcactctaaatcggatggtctgtgacctcaggtgagaaaccaagtcatgctgaggaactgagatccagcggtgaacacaggtgcactaacagtggtccggcctttgagatggtgtgactaccatttctgcacgttgccagtgtacatggttaccaagtcaattaactggcttgatcctccgaaacaggttgttgtggacccaagaggctataatttaggccccagccataatgtagagatgtttggcacacccctatagatgggggggcttcgccccctcgtgttagcccccaacaaaaggttctcgcggggaac

SEQ ID NO: 482670 - DNA, 287 bp, Homo sapiens
tctaggaggatccccctataggtttggcctcgcctttctattagctcttagtcaagattacacagtgcagcatccccgttccagtgagttcaccctgctaaatcaccacgcatcgctagggaccaggcatcaagcacgcagcactgcagctcaaaacgctgtagtccgagccacatccccacggtgtatacagtcagtgattaaccttttagtcaatagacgaacagctttagactaaggcgtattctataccctagggtttggctcaactttcgatgccagtccac

SEQ ID NO: 482671 - DNA, 928 bp, Homo sapiens
  misc_feature (16)..(16): n is a, c, g, or t
  misc_feature (81)..(81): n is a, c, g, or t
  misc_feature (83)..(83): n is a, c, g, or t
  misc_feature (101)..(101): n is a, c, g, or t
  misc_feature (117)..(117): n is a, c, g, or t
  misc_feature (119)..(119): n is a, c, g, or t
  misc_feature (138)..(139): n is a, c, g, or t
  misc_feature (179)..(179): n is a, c, g, or t
  misc_feature (185)..(185): n is a, c, g, or t
  misc_feature (211)..(211): n is a, c, g, or t
  misc_feature (218)..(218): n is a, c, g, or t
  misc_feature (220)..(220): n is a, c, g, or t
  misc_feature (222)..(223): n is a, c, g, or t
  misc_feature (228)..(228): n is a, c, g, or t
  misc_feature (230)..(230): n is a, c, g, or t
  misc_feature (243)..(243): n is a, c, g, or t
  misc_feature (249)..(249): n is a, c, g, or t
  misc_feature (251)..(251): n is a, c, g, or t
  misc_feature (257)..(258): n is a, c, g, or t
  misc_feature (261)..(262): n is a, c, g, or t
  misc_feature (280)..(280): n is a, c, g, or t
  misc_feature (288)..(288): n is a, c, g, or t
  misc_feature (293)..(293): n is a, c, g, or t
  misc_feature (302)..(302): n is a, c, g, or t
  misc_feature (315)..(315): n is a, c, g, or t
  misc_feature (317)..(317): n is a, c, g, or t
  misc_feature (359)..(359): n is a, c, g, or t
  misc_feature (383)..(383): n is a, c, g, or t
  misc_feature (416)..(416): n is a, c, g, or t
  misc_feature (449)..(449): n is a, c, g, or t
  misc_feature (464)..(464): n is a, c, g, or t
  misc_feature (475)..(475): n is a, c, g, or t
  misc_feature (489)..(489): n is a, c, g, or t
  misc_feature (506)..(506): n is a, c, g, or t
  misc_feature (521)..(521): n is a, c, g, or t
  misc_feature (537)..(537): n is a, c, g, or t
  misc_feature (586)..(586): n is a, c, g, or t
  misc_feature (588)..(588): n is a, c, g, or t
  misc_feature (644)..(644): n is a, c, g, or t
  misc_feature (657)..(657): n is a, c, g, or t
  misc_feature (661)..(661): n is a, c, g, or t
  misc_feature (664)..(664): n is a, c, g, or t
  misc_feature (669)..(669): n is a, c, g, or t
  misc_feature (672)..(672): n is a, c, g, or t
  misc_feature (691)..(691): n is a, c, g, or t
  misc_feature (708)..(708): n is a, c, g, or t
  misc_feature (801)..(801): n is a, c, g, or t
  misc_feature (823)..(823): n is a, c, g, or t
acaagataaaaaaaancttaaggagtttcccactgctacagcgaaaaaaaagaaacagttcttcaggcacaaagccaagtnanataccttcctggcaaatngaacatccacagtaantnttctgcagccccagaaagnnccaggtccacagtggctgctgggccctctggccacgaganaatgancagctcacctgcgttggtcacttggntcctggntntnngaggnangggggttttttgntacttngnatttgnntgnnagcacctgctggatcctntgcatccncaggnaaagctggntggacctggtttnanaagataaagcgaaattaaccaggctctttaaactcgaaggcnttgctaaaggttagcagcaccttnttgttcaaaaagcggcgccagatcagcattttntcctcaaaggtgcccttgatcaggtactttctnaagttaacccagatnaagaatttagntccacgatttattntggggatccccaatgcnctaagctcttctganatataggttttggcanctttgatctgggcatggttttttggcaggtacacctggttgatccagtnanggtcccggattatctgttctatcttgtattggaccaagctacttatgccgtggtanctgcatatggaanctanggnagtgncanatcctggttttttgtgtanagcgtgccaaagcggancccagacatcccgaagtccttgctggttgcccacatcacatgggtcctctgggggtcagggagcctttccaggcttaggacactgcggtaccnaacagacttctcaaacacgganagcatgtagacctcatccacaatcacatgcagcctgtgcctcttggcaaataccaggtactcctgtagctcttcaggggagtatacatcagccagagggttcatc

SEQ ID NO: 482672 - DNA, 329 bp, Homo sapiens
  misc_feature (15)..(15): n is a, c, g, or t
ttcagccgggcgtgnttcagtgataccaatcggaccagtccagagtccaatgagggtccggaaaatgaaatggtctccagtttggcactgcagatgtcactttattttaatacctactatttcccactgtggtggttgagcagcattatgatgcttcacatgaagtattcaatcttgcctgactactacaaattcatcgtgatcactgttatcatcctaataaccttaattgaagccatccggttgtatctgggctacgtgggtaacctacaggagaaggttcctgagttggctggcttttggcttttgagcttctattgcagttacct

SEQ ID NO: 482673 - DNA, 152 bp, Homo sapiens
aggttgatccggttgcccttcttggccccatgcgccttcagcacattggccatgcggcagacttcgtcatgaagctcgccataggtgatgtggcggctgtccctggggtcatcgccttcccagatgatcgccgtctcgcccttgcggtgggg

SEQ ID NO: 482674 - DNA, 86 bp, Homo sapiens
agagcactcatatgcattttataagtggtctaaggtcatttagcataaaagcaaatagctccccgtgccccttctgtcgtcttctc

SEQ ID NO: 482675 - DNA, 404 bp, Homo sapiens
  misc_feature (180)..(181): n is a, c, g, or t
  misc_feature (184)..(184): n is a, c, g, or t
atgctgtcttcaggatggtcttgatctcctgactcgtgacacccgcctcggcctcttgaagtgctgggattacaggcatgagccactgcggccggccccccacttattgttgaatgtgtagcagcagcttcccaaaagccagcatcgtttttaggtgaaaaatgggcctagaaaatcaannccnttgccagatctggtggtgaccatgcagaggtgggcgtaaggaagccatggatctgaacaaaacctcagttgttcgtattagagccaattatcagattcagtgggatgcaaatctatggagagcgtgtgttcaatatgaaaatttaaaaaaatcttgaacttttagaatgtggtcttatctagtccttaaaaattaggaaatttttagtgcatgtagcagc

SEQ ID NO: 482676 - DNA, 253 bp, Homo sapiens
  misc_feature (17)..(17): n is a, c, g, or t
  misc_feature (25)..(25): n is a, c, g, or t
  misc_feature (52)..(52): n is a, c, g, or t
  misc_feature (67)..(67): n is a, c, g, or t
  misc_feature (164)..(164): n is a, c, g, or t
  misc_feature (183)..(183): n is a, c, g, or t
  misc_feature (213)..(213): n is a, c, g, or t
aggcaatgccgtgcggnaggcttcnagcacgcggtggtaataagccagcccngcgcgcgagatcctnccgcgctcgggctcgatccgcgaccattcgatcgagaagcgatgcgcgttgaagccgagcgagtcgacgagcgcgatatcctcgtcgacgtggtgantaagcgtcgcacgcgttcnccgagggctgggcgaagatcgtcggcttgntatgctcgaccacccacaggtcgctcgcatcattcccgcc

SEQ ID NO: 482677 - DNA, 549 bp, Homo sapiens
caatctgtgaggtaattaatataaattttattattttaaaaattatttcaatcacctatgtttagcagtgttttaaactatctctggtaaaagatattttttccttaatttcaagtccattgcggaccaatacttttgtaaattttttttaatcctaattactgacaatatacaattttggagaatgaaaaattcaagcccctttattttgttattagagtcaatagatataaaattgctatgtaaacattctagaagtgtttaaaggactaagctccgcttattttttatttttatggatatgtaatcgttgtatatatttattatatacatggtatattttgctatgagcatccaatgtgtaatgatcaaatcagagtaactgggatatcaattacctcaaacatttatcacttgtgttaagaacattccgaggctgggtgcagtggctcacgcctgtaatgccagcactttgggaggcagaggtgggcagatcatgaggtcaggagttcgagaccatcctggccaacatggtgaaaccccgtctca

SEQ ID NO: 482678 - DNA, 296 bp, Homo sapiens
  misc_feature (18)..(18): n is a, c, g, or t
ggggggcccccggggggnaaaaattttgggggcgggggcccccggcccccccaaaagggggggaggggggggcccccttgggggccccccaggggggggggtccccggtttggaccccctccccccccccctttaattttggggggcggggggccgggggcggggggggggggtttttgccccccccctgggggggggaaaatcccccccggggcccgggggggggggggggggaaccccgggtccccgggcccccctttttttttttttttggaaaaaaaaggccgggtttccca

SEQ ID NO: 482679 - DNA, 394 bp, Homo sapiens
  misc_feature (28)..(28): n is a, c, g, or t
  misc_feature (192)..(192): n is a, c, g, or t
aaccccctaaagtaataccattttaaantggtaaccaggaaaaattttacaagtgtaaaccaatgtggtccaaccattttgccagaattgacctgtaatatggacccttaaatcttttgtgcaagcctggaaggatccagttgtaagtaatgcccaggaaagtgcgttttacctaagacttccttctcagcntctcccataaagagaccctaatatgcattttgaactgtaattggaaatgtaactttcactgaaagtgtcatgtgatgtttgcattacttttaactgctatgtataaaggaaagtgtgtcttttgacttcatcagttatttctcttgtgcacagaggagaaatgcattaaaaatgactaaaaaaaagtaaaaaacttaaaaaa

SEQ ID NO: 482680 - DNA, 830 bp, Homo sapiens
gttgccttccggttgtcgctgcggtgtgtgggaaatgctggctgcgcgcggcgcggtggcactggtggcccttttgctgaggggctctctactggcttctggcctgctgctcctggccgtgcctcctctggattgccccgaaacacctgtggtactgtacgtgcctgcagcatggatgtgcctgggtggtggagctgaagtgtggcctgattccacctggatcctggagcctggttaagaacatacctcatcacctgtagtaaagacctggatccgatatgtgcagagtctacaaggaaatatgtcatcaactgtgcctagagcagttcggctgtgactctacgacaattgtaactctgcaaatcgataggagtccttaaaacctagcgcatcataggacccttacaaggcaagctacggtgtggaagagaccctgagtatagcctgacacccagccagacacaaacaagccatgagatcagagctcggaaactctctatggacaaagacttccgggaccgggagtccctgaatagccagacattgtaggaaagccatcaaccaaagacttgctgacatgcagaggtaataagctgcctccgaaaatgaataatcaaggaatatccatgttgaccaacccgggtagaaaagaagtatatagaagaatgcagggagagagagcaaaacaggaggaaaacggggcaaaaaagacaagaggacagaagaaaaccacgaaaagacagcaaacatgtgcacaacgtgagaaaaggaccaaacatgacccgaaaaaaaaaggcgtaagaaaatcaaaaacgaagcaagaaaagaaa

SEQ ID NO: 482681 - DNA, 1259 bp, Homo sapiens
aggacatgcacacacaagtaacattgagctgcaatggacaggagccttgacgctggcgtgtgggaagttgagcgccatgtctaggctgtagtgggtatccccctggtaggggcagctagggctgtggttccctgctccgaactctcagggctgtctccctgagtctccagggccagaatgcctggatgcgctgggtagccatgtttggaggatgtgggctgcaacgtgcggtcaggccagcgatggcgtcgctcacttggctgtagtcaacctgactagtcgctattggtcgctacctcgcgtgttccgttgactcgttggactgggggtttggacgaccaggtccgccctttatcgatcagcttcgtgatgcgctcctttagtcttgtctcatgtgagatacagaagtggcacactgtgtgcatggctatgcggcattagatgatacagtagaaactgtggtcatgtctccaatcacgccctatgctaacagtgcgtgtgtttggcacgacacgcaaaggggggagatcaaagggacaacccaatctcaaatcaatggcgcaaatgggggatccaacggacgctggaagttggcaaacggcgaggatctgatgcccattaagtgcaacagcgcccgatggctctatggctaacatagtagacatctcggagtactatagcagatatggaaggccgaagcattctccaagttacacggaccattattggctttgcactagttccccatatcagttatacgcactatacggagtgtataagtgaccatcgagtgatgtgagaaattggaagaggagaaaaaataaggcgggagatatgaggacaaaatggagaacattacacaaatttcgaaattctaagtgaaatgtttgggaaagcggggggtcgagagaagtggactgcaaagcaggtttgttgagcagcatcacggaaggcggtacaggtgtattccaaggggaaaagctgccggtttacacaaaacacagcgagtgatggcagtacatagcaggagcagatgagaaaacaaatatttgcgttgagacgcgataataaacgccacctagatccagagagcccgacccgaacgatgactacacactgagggaaaggcaggcattcgagggatgtatgcaacacagctatactatagggacccattatgtattggcttgaccccaacaatgggaggcaacgtaggaccacaaaaccacagatacacacacagattccaatccttccga

SEQ ID NO: 482682 - DNA, 126 bp, Homo sapiens
gtcgtgaggtcgatctctaggatttaggcaaagctcgtacatcttctgtctggtatactacagactttatccccctcaccctccagttgagtagctgttggagcttctgggcccaaggctttcagg

SEQ ID NO: 482683 - DNA, 116 bp, Homo sapiens
cgtccccctgactcctgggcctcccggaacctccacggacgtggtggtaggccctgcctctgccctcacggggctggcacgaccaccccgcatactgttcattggatggcttcttc

SEQ ID NO: 482684 - DNA, 919 bp, Homo sapiens
  misc_feature (35)..(35): n is a, c, g, or t
  misc_feature (51)..(51): n is a, c, g, or t
  misc_feature (54)..(54): n is a, c, g, or t
  misc_feature (56)..(56): n is a, c, g, or t
  misc_feature (73)..(73): n is a, c, g, or t
  misc_feature (81)..(81): n is a, c, g, or t
  misc_feature (93)..(93): n is a, c, g, or t
  misc_feature (107)..(107): n is a, c, g, or t
  misc_feature (132)..(132): n is a, c, g, or t
  misc_feature (142)..(143): n is a, c, g, or t
  misc_feature (203)..(203): n is a, c, g, or t
  misc_feature (224)..(224): n is a, c, g, or t
  misc_feature (262)..(262): n is a, c, g, or t
  misc_feature (267)..(267): n is a, c, g, or t
  misc_feature (296)..(297): n is a, c, g, or t
  misc_feature (325)..(325): n is a, c, g, or t
  misc_feature (337)..(337): n is a, c, g, or t
  misc_feature (381)..(381): n is a, c, g, or t
  misc_feature (412)..(412): n is a, c, g, or t
  misc_feature (421)..(421): n is a, c, g, or t
  misc_feature (482)..(482): n is a, c, g, or t
  misc_feature (486)..(486): n is a, c, g, or t
  misc_feature (488)..(489): n is a, c, g, or t
  misc_feature (495)..(495): n is a, c, g, or t
  misc_feature (502)..(502): n is a, c, g, or t
  misc_feature (529)..(529): n is a, c, g, or t
  misc_feature (568)..(568): n is a, c, g, or t
  misc_feature (582)..(582): n is a, c, g, or t
  misc_feature (617)..(617): n is a, c, g, or t
  misc_feature (636)..(636): n is a, c, g, or t
  misc_feature (648)..(648): n is a, c, g, or t
  misc_feature (653)..(654): n is a, c, g, or t
  misc_feature (659)..(659): n is a, c, g, or t
  misc_feature (678)..(678): n is a, c, g, or t
  misc_feature (761)..(761): n is a, c, g, or t
  misc_feature (764)..(764): n is a, c, g, or t
  misc_feature (837)..(837): n is a, c, g, or t
  misc_feature (857)..(857): n is a, c, g, or t
  misc_feature (894)..(894): n is a, c, g, or t
acgctggtgggcctgtagtggagtacgctttggantgagaagaatcgaggntanangaagaagctgtagcaangaaggccnaggggggatggnggctaaaagagganggcgcttaaagtgggcaattaagcnaagcgggcanngaggaggaagaaggggtagaagtaaacggggaagtagaaaggaagaatagatataaaaanaaggaaaaatggaaaagaaantaaaaaaaaaaaaataaaaaaaaaaaaaaagaaaaaanagaangaaaagaaaagaaggagaaataaaattannataaaaataaaaaaaaataaaatagaanatataaataatnaaaataagaaggaaaaaaaaatataaaatataaaaataaaaaanaaaagaatatataaaggaataaaaaaaaatnaaggaaaanaatagaaataaaaagaaaataaaaagaagataaaaaagaaaaagaaaaaagtatataaagngtangnnatatanaattagnaaaataaagggtttggcattggctgtntacaagtaccagtacatgggactgtaacctacacatgcntcggattggttagncttcattgagcacactgagagaatggagtacagtngtggaggactgcttttgtnaacatgagagancagcnnctggnccctatgtatttgggtctnatttacatacttctataagcacagtggctcctcagcatactcttaaactaatcacttatgtaaaaaagaaccaaaagactttnctncatggtggggtgacaggtactagaaggacaatgtacataatcacgacacacacagagacactataccataacncaaggctggaaaataatgtngaaaactttatttttgtctacagtacagaacacaaanaacaacaaaaaaacataactatgta

SEQ ID NO: 482685 - DNA, 707 bp, Homo sapiens
agcggaattggggggcagctccgtgagggacggtttctgccttgttcccgcctcagctcggcagctccccatccgtcgcccgctgttctccgcgctcctcggccgggttcatggtcctccccgtctcggtctgtgtcgcttctaggatggggaggtaacaggcagggccgtaaagagcctcgtcccgacaaccgagagaccgaccggtccccggaggtgagcgccagcctccgcgtgtccatacaccggcggggggccgcctcgccatgctgcaagagcaggacgaggaaggacgaacgaagagcgacgcaagggaagagaggcaagaaagaaaccaaaagagggaaaaaagaaggcgcagaacggggagggccggccaagagggggcaagtccgatggccatacggggaggaaccatcaaggcacgaccgatagggaaagcagagcagcaaaacccaagcaggagtaaggaagtaaagagcaacaagaaccatggagggagaacctcccaggtagccgtgacaggagcgttgcccatcaaagcgaagcaacagggacccacgagaccgataggcaagagaggctgagcggaaaaaaccaacaagagacaacagaccagggacgtgatggcccccaaaaagctaaactagcaacacaacaacacaggagcccggggacagaacacgacgagtagaacaaggagccac

SEQ ID NO: 482686 - DNA, 298 bp, Homo sapiens
cttgcgtgtccatacttcagggattatgcactatccactcattacatattatgcctaccctgagtttatatgaatctgccacaataatgaatcctggatagcaatttgaaacccttcatgaagcactgaaactactgccacctgctcactgcgaaaccctccgttacctcatggcacatctaaagagatgtaccctccacgaaaaggagaatcttatgaatgcagagagccttggaactcgtctttggacccacccttattagacccgcaaggtgatcacggagctctcattccgtaa

SEQ ID NO: 482687 - DNA, 543 bp, Homo sapiens
gttaatggtttaactgctggttcaggttctgattaaatcatttgtgtttaaagtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggggaatttgggggggagacacttttagggccgcccaagtagggagcgggttaatatataataacaggacacgaaccgcgcggcgcgatcgaacaaccaacgcgcggacggagaaaacagtgcgagcatggtggggtatactttgtgggagaagaagcaacaccccttctggggggggggaggaggaaatacgtgggggagccaaccccactacgaaatgaatttaaagacacgtcagagggagaaaataaaacatgcggagggtaggtagggttggtaaacaagcgcgtatataattggttggtgggagaaaaagtttgagcaggggatatattgtacaaaaatatttatacagagtgtttaaaatacgggggacgt

SEQ ID NO: 482688 - DNA, 102 bp, Homo sapiens
agcagaatgagtcgggtagcgtagatacctccggagaacgtgttactggcctggtgggcgacaggcccgccggaggccagctgggatgtgtagagcggataa

SEQ ID NO: 482689 - DNA, 350 bp, Homo sapiens
ttcaaagactccctgatttgtgattggttaaggaagcaaagctttgtctacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgtggctattgtttgaaactgttatgaccttcttgcttatcagcttgctggtttccttctcggggcgagctgggtgcctggagttttcggtgaaggaaactcaagattctcctttatttctgtgcttgtgggtccccctggcacaccccggggg

SEQ ID NO: 482690 - DNA, 965 bp, Homo sapiens
cggcccctttttttgtttttttaacggagaaaaaattttgatggtgatataaaatgcacttataaaaggtccaccagaaggcatgtaattcttcacgggtatataaatgtacggggaatatgttattcaccatctaggtatgatacggccaactaaaacatactgtaaacgagtgagttatacgtctataacaaagggcatcacgtgattttcagcaatcatggggtttaataataattaggtttaagactataatcacatctatattcgtggaagtgtccatttactcttaagtgtagcggtaggggaatttagagtataatggcccatagagtggtacagaaaaacattcacgttctaaattattttataccttcagtgacaggtagtcttcctgactgaaaataacagcttcagctatggtcctggctcaggattcttaaggcacataataggggtgtatgtgtgtcgggagagtggcgggccgtgaataagcttccaaaatgatgcccaacacagttatccctattgaaacgaggggactgatcgctccaaggtatcccccagttgtgagtaaacatcagtgctgccaggtgcttgctgaggctgtaagactcaacccggggtccccgtggtcatgaaccaagactaaatggtcacaaggcagaggcaaggaacaatcccaactgcagggggccaatctgaaacatcctgaatgttgccaaccggagaaaagcttggcgtaacattgcccaaacccaaacgctagcagggagtgatggccccccacaggaccggtaggcgaaattgaaacagcaacctaaggggaagcacacccagcacgagagacgcacacacagcacacacaccacgatggacgcgacacgaaacgggcagacgagcacggcaccatacagaaccacaactcacaggacgacgcaaggtcaagagacggcacacaggca

SEQ ID NO: 482691 - DNA, 1045 bp, Homo sapiens
gaatgggatcatcagcatacggaacaaaatatggcgaggagacaatggaaagatcgagcggtcggggggctccctctcggcccatatggtccatctgcgggatcccttcaagagacgagagtaatgacatcctggtctgtggctgactggggacatatgagtttgcttctaccagctgagtggaaatcagattggaaaaggactcgggcaaatgaatcattctgactcccgtgctatgtatcaggcttacatttagctaaaaaggcgaggtatcaattctctgcatgcggggctgcgggacaatccaatgtatcttctctttcaccgcagtggactggatgtgaggcttgtgggacttgtgtgagcgcgagcacgaacctccctgggatgatggactgtgctcaagtctaaagacggactaccaaacggagtgtgagatggtcgggtgcgaaggaccgcatcatggtgccattctagccatgtatctaattgtatcccgccacgaggtgccactgcccgcttgaactatacggaactggtatgcctatcgctgatactttgactgacgtcattggtgtcagccacctgatgcaccgattcagaaagtcccgggattcactagtgcatgagagcttgtcaagactgattgccatctagctgaagtcgctcgtggtatcaacattgcctcagaagattcctcatctatgaatcgtatttccgcaggacttatcagcacgattggatgagcgagtcctggactgacgtaatagtcaatcacaggtctgagttcaatcccccgcctggaggtggagtctcccatcatcagtgtgtgcccggaacaacccgtttacgaaaggcagggcggcaagggaaccggaacgatcgggtggttgcacaatgtaagtgttccgttgggttaccaaggggaaacggggaccaccgggagcacaagcctctgtggggcccaacatatgacaccgcgctcacgggccatccgacgtttggccttcaagaaacaccggccaataaaaagtcccaaaggcgt

SEQ ID NO: 482692 - DNA, 461 bp, Homo sapiens
  misc_feature (63)..(63): n is a, c, g, or t
gagagagagagaaagaaattataatgctctagtatgcacagaagcaagtgcacgcatttttanaatcattttgctgcctatatgatttcaatggtttctttataaagtgatcattattcaaatatgcgaagcctctacagtctaagagcaaggccacttctgcaaggcttttaattgtgatcttaaaaaattaaatcaaaagcattttctttaaaatatctttgtaatatattacttttcctaaatatatgagtgagagggcagtctttcagattcttactgtagagttttgattttaattgtgtgtttatttctgtggatgctttggtataatatcttagtaattccaaatgtaagcatacctcagtaattgtgttaatagccataaagccacttccatggtgcttcatcattgtaactgacggtgaaactaacaaaaataaaaagtatgttggaggtgc

SEQ ID NO: 482693 - DNA, 615 bp, Homo sapiens
ccacggcttcagcgttggatgtgcccacacagagcactgttgtcagcgtgtatgccaccagcaaagtgacctctgcgccgttcgacaataagttggtcctggccgctcgggacgatgctgccgctttcattgccactgacggccaatggcggggcgcacgcctggagtccgcgctggactatctgcgccgcacccagccaaaacttcatgcaagcgaccttgaactggcgcaagcaattctcgtccaataatcatcattgtatttctatctttgtcattggagtcaccccatgcgtagcccgctgatcgtcgccgccctcggcctgctgtttttggccgatgtcgcccaggcgcaaaccttgaaggccaccagcaacatcgtcgtgcgagcctcggcgcgcaccattgatttcacctcggacaccaccacctccatccgcgactccaagatcgtgcgcgaagcccacgatgacgccgccagtttcgtcgctaccaatggcgagatccgtggcgcccaactggaagccgtgttcgatacccttcgcacccgcgtgccagaagcccgtgatgccagcgaccagaccctcgcagaagctatccgcagggacccactcg

SEQ ID NO: 482694 - DNA, 148 bp, Homo sapiens
ttatcgctcttttttcttttattcccaaagaagatgtacaaatgcttacataatcagaacagggcaatcttaccaatgaagtttacctggggggggctacatttacttatttcatttcttcgcacaccaacataaatttgataccgtc

SEQ ID NO: 482695 - DNA, 100 bp, Homo sapiens
  misc_feature (9)..(9): n is a, c, g, or t
cgtttcacntacgcacgactttaccacactccgacttcacgacgtaccacacacacgaccactttacttcacgtaccaccaccacacacttacgtacacc

SEQ ID NO: 482696 - DNA, 5468 bp, Homo sapiens
  misc_feature (953)..(953): n is a, c, g, or t
  misc_feature (1013)..(1013): n is a, c, g, or t
  misc_feature (1073)..(1073): n is a, c, g, or t
  misc_feature (1249)..(1249): n is a, c, g, or t
  misc_feature (1280)..(1280): n is a, c, g, or t
  misc_feature (1286)..(1286): n is a, c, g, or t
  misc_feature (1310)..(1310): n is a, c, g, or t
  misc_feature (1318)..(1318): n is a, c, g, or t
  misc_feature (1325)..(1325): n is a, c, g, or t
  misc_feature (1334)..(1334): n is a, c, g, or t
  misc_feature (1338)..(1338): n is a, c, g, or t
  misc_feature (1340)..(1340): n is a, c, g, or t
  misc_feature (1345)..(1345): n is a, c, g, or t
  misc_feature (1355)..(1355): n is a, c, g, or t
  misc_feature (1367)..(1367): n is a, c, g, or t
  misc_feature (1370)..(1370): n is a, c, g, or t
  misc_feature (1384)..(1385): n is a, c, g, or t
  misc_feature (1398)..(1400): n is a, c, g, or t
  misc_feature (1487)..(1487): n is a, c, g, or t
  misc_feature (1490)..(1490): n is a, c, g, or t
  misc_feature (1496)..(1496): n is a, c, g, or t
  misc_feature (1514)..(1514): n is a, c, g, or t
  misc_feature (1518)..(1519): n is a, c, g, or t
  misc_feature (1529)..(1529): n is a, c, g, or t
  misc_feature (1534)..(1535): n is a, c, g, or t
  misc_feature (1544)..(1544): n is a, c, g, or t
  misc_feature (1547)..(1547): n is a, c, g, or t
  misc_feature (1550)..(1550): n is a, c, g, or t
  misc_feature (1564)..(1564): n is a, c, g, or t
  misc_feature (1580)..(1580): n is a, c, g, or t
  misc_feature (1583)..(1583): n is a, c, g, or t
  misc_feature (1630)..(1630): n is a, c, g, or t
  misc_feature (1663)..(1663): n is a, c, g, or t
  misc_feature (1693)..(1693): n is a, c, g, or t
  misc_feature (1703)..(1703): n is a, c, g, or t
  misc_feature (1741)..(1741): n is a, c, g, or t
  misc_feature (1771)..(1771): n is a, c, g, or t
  misc_feature (1783)..(1783): n is a, c, g, or t
  misc_feature (1797)..(1797): n is a, c, g, or t
  misc_feature (1801)..(1801): n is a, c, g, or t
  misc_feature (1827)..(1827): n is a, c, g, or t
  misc_feature (1831)..(1831): n is a, c, g, or t
  misc_feature (1857)..(1857): n is a, c, g, or t
  misc_feature (1861)..(1861): n is a, c, g, or t
  misc_feature (1947)..(1947): n is a, c, g, or t
  misc_feature (1951)..(1951): n is a, c, g, or t
ggtatcgataagcttgatggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcagaaagaagcttccggttctgaggtcctggaggtgccatttccctctctgttgaagcaaaggccggggcagacctcctagtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggaggtgccgatggtggtggtgcccccagtgggtgccaagggcaacacaccagccactggcactactcagggcaaaaaggcggaggggactcagaatcaaagcaaaaaggctgaaggagccccaaaccagggcagaaaggcaganggaaccccaaaccagggcaaaaagacagagggaaccccaaaccaagggaaaaaggcaganggaaccccaaaccaaggcaaaaaggcagaaggaaccccaaaccaaggcaaaaaggcgganggggcccagaaccagggtaaaaaggtagatacaaccccaaaccaggggaaaaaggtggagggggccccaacccagggcagaaaggccgagggggctcagaaccaggccaaaaaggtagaaggggcccagaaccagggcaaaaaggcagagggggcccagaatcagggcaaaaaggnagagggggcccagaaccagggcaagaaggcngagggngcccagaatcagggcaagaaggcngagggggnccagaancagggcaanaagncngaggnggcccagaancagggcaagaangcngagggggcccaganncagggcaagaagnnngagggggctcagaaccagggcaaaaaggccgagggggctcagaaccagggcaaaaaagtagaaggggcccagaaccagggcaagaangcngagggngcccagaaccagggcaanaagnncgagggggcncaganncagggcaanaangcngagggggcccaganccagggcaagaaggcnganggggcccagaaccagggcaagaaggccgagggggcccagaaccaggncaagaaggccgagggggcccagaaccagggcangaaggccgagggggcccagaaccagggcangaaggccganggggcccagaaccagggcaagaaggccgagggggcccngaaccagggcaagaaggccgagggggcccngaaccagggcangaaggccgaggggncccngaaccagggcaagaaggccgaggggncccngaaccagggcaagaaggccgaggggncccngaaccagggcaagaaggccgagggggcccagaaccagggcaagaaggccgagggggcccagaaccagggcaagaaggccgaggggncccngaaccagggcaagaaggccgagggggcccagaaccagggcaagaaggccgagggggcccagaaccagggcaagaaggccgagggggcccagaaccagggcaagaaggccgagggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgttgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccgg

SEQ ID NO: 482697 - DNA, 143 bp, Homo sapiens
tctctcacttgagtgaattggatggaagtggtgaatttcagccaaagtggccaaagaaatcctgttcctgtgataatgacgccatcagcctctgcacctctgtcttcccttctgccacatgttgtctgttctccgtgactttg

SEQ ID NO: 482698 - DNA, 5368 bp, Homo sapiens
  misc_feature (953)..(953): n is a, c, g, or t
  misc_feature (1013)..(1013): n is a, c, g, or t
  misc_feature (1073)..(1073): n is a, c, g, or t
  misc_feature (1249)..(1249): n is a, c, g, or t
  misc_feature (1280)..(1280): n is a, c, g, or t
  misc_feature (1286)..(1286): n is a, c, g, or t
  misc_feature (1310)..(1310): n is a, c, g, or t
  misc_feature (1318)..(1318): n is a, c, g, or t
  misc_feature (1325)..(1325): n is a, c, g, or t
  misc_feature (1334)..(1334): n is a, c, g, or t
  misc_feature (1338)..(1338): n is a, c, g, or t
  misc_feature (1340)..(1340): n is a, c, g, or t
  misc_feature (1345)..(1345): n is a, c, g, or t
  misc_feature (1355)..(1355): n is a, c, g, or t
  misc_feature (1367)..(1367): n is a, c, g, or t
  misc_feature (1370)..(1370): n is a, c, g, or t
  misc_feature (1384)..(1385): n is a, c, g, or t
  misc_feature (1398)..(1400): n is a, c, g, or t
  misc_feature (1426)..(1426): n is a, c, g, or t
  misc_feature (1429)..(1429): n is a, c, g, or t
  misc_feature (1435)..(1435): n is a, c, g, or t
  misc_feature (1453)..(1453): n is a, c, g, or t
  misc_feature (1457)..(1458): n is a, c, g, or t
  misc_feature (1468)..(1468): n is a, c, g, or t
  misc_feature (1473)..(1474): n is a, c, g, or t
  misc_feature (1483)..(1483): n is a, c, g, or t
  misc_feature (1486)..(1486): n is a, c, g, or t
  misc_feature (1489)..(1489): n is a, c, g, or t
  misc_feature (1503)..(1503): n is a, c, g, or t
  misc_feature (1519)..(1519): n is a, c, g, or t
  misc_feature (1522)..(1522): n is a, c, g, or t
  misc_feature (1569)..(1569): n is a, c, g, or t
  misc_feature (1602)..(1602): n is a, c, g, or t
  misc_feature (1632)..(1632): n is a, c, g, or t
  misc_feature (1642)..(1642): n is a, c, g, or t
  misc_feature (1680)..(1680): n is a, c, g, or t
  misc_feature (1710)..(1710): n is a, c, g, or t
  misc_feature (1722)..(1722): n is a, c, g, or t
  misc_feature (1736)..(1736): n is a, c, g, or t
  misc_feature (1740)..(1740): n is a, c, g, or t
  misc_feature (1766)..(1766): n is a, c, g, or t
  misc_feature (1770)..(1770): n is a, c, g, or t
  misc_feature (1796)..(1796): n is a, c, g, or t
  misc_feature (1800)..(1800): n is a, c, g, or t
  misc_feature (1886)..(1886): n is a, c, g, or t
  misc_feature (1890)..(1890): n is a, c, g, or t
ggtatcgataagcttgatggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcagaaagaagcttccggttctgaggtcctggaggtgccatttccctctctgttgaagcaaaggccggggcagacctcctagtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggaggtgccgatggtggtggtgcccccagtgggtgccaagggcaacacaccagccactggcactactcagggcaaaaaggcggaggggactcagaatcaaagcaaaaaggctgaaggagccccaaaccagggcagaaaggcaganggaaccccaaaccagggcaaaaagacagagggaaccccaaaccaagggaaaaaggcaganggaaccccaaaccaaggcaaaaaggcagaaggaaccccaaaccaaggcaaaaaggcgganggggcccagaaccagggtaaaaaggtagatacaaccccaaaccaggggaaaaaggtggagggggccccaacccagggcagaaaggccgagggggctcagaaccaggccaaaaaggtagaaggggcccagaaccagggcaaaaaggcagagggggcccagaatcagggcaaaaaggnagagggggcccagaaccagggcaagaaggcngagggngcccagaatcagggcaagaaggcngagggggnccagaancagggcaanaagncngaggnggcccagaancagggcaagaangcngagggggcccaganncagggcaagaagnnngagggggctcagaccagggcaagaangcngagggngcccagaaccagggcaanaagnncgagggggcncaganncagggcaanaangcngagggggcccaganccagggcaagaaggcnganggggcccagaaccagggcaagaaggccgagggggcccagaaccaggncaagaaggccgagggggcccagaaccagggcangaaggccgagggggcccagaaccagggcangaaggccganggggcccagaaccagggcaagaaggccgagggggcccngaaccagggcaagaaggccgagggggcccngaaccagggcangaaggccgaggggncccngaaccagggcaagaaggccgaggggncccngaaccagggcaagaaggccgaggggncccngaaccagggcaagaaggccgagggggcccagaaccagggcaagaaggccgagggggcccagaaccagggcaagaaggccgaggggncccngaaccagggcaagaaggccgagggggcccagaaccagggcaagaaggccgagggggcccagaaccagggcaagaaggccgagggggcccagaaccagggcaagaaggccgagggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgcactccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgttgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccgg

SEQ ID NO: 482699 - DNA, 1203 bp, Homo sapiens
  misc_feature (1203)..(1203): n is a, c, g, or t
tggaaatggagtctcccaggcggaaatgcaagggtgcgatctcgacttcactgcaatcttcacctcccgggttcaagcgattctcccacctcagcctcctgagtagctgggattacaggcacctgccatcacgctcggctaatttcggtatttggagcagggatggagtttcaccatgttggccaggtgatctgcactcccactccccccacatttcccaaagtgctgggattacaggcataagccacaagccacctcacccagccaacatgttacatcttaattctgggatttccttcactgcagggcttggcggtggagaaataaacactcttcaaatgcataatctgggagatccctgtgaatcaataattcttatacacaactgcggctcaaaatccctcctttccctttcccgagttattccatccatcttattcagaagggaagtgaactcaggtgtacggtggtctgtaacaccctgaacatcttttataccgtgctacaagggtatgcctgggatatataggtagccatacaacgcagagactgacactaccagctaacagaagaaggaggattccaaggcaaactgattgacctgaaacccacaagtcatcagtgactgatcctgcatatagacataaggtagcgaccacttccactgaaccatagtgccgggaacttcattacagccgacacctatcaagttagcatcccatatcgtattggaggggacattagagacacacagttcacacacgggtaaacattggacgtaagaacacgcaaccatttttaaaactatcaaaacaacttcttgaaagagaggagcataaacggacaatcgatatacacagatgaactacaccttagaaaacaggcaaacgagacagtacagccactagacaccagggggtgaagaacatggagcgagggcccagaacacctgtagagcgacacagtgacggcacacacgctaccccccgcggggcacaacgagcacaactcgctcgggccaccaagcgctgctccgcagaaaaacgagggtacgaatcacacgcccgcggagccaacacgaaccacgagatgaccgaaaaggccagccgacgaatcaagacagaacacaacgagtgagcaaccaaacacgacgagcgacgcaggcgaggtatacacaaccccaagaacaggcaagaacacccn

SEQ ID NO: 482700 - DNA, 121 bp, Homo sapiens
gtcaacaggatgcagactaggtgcaagtgcaaactagttcctgtcggaagcctaagactcacccaggttaaaatatttcccctcatattgacaggaggcttgatcttggaactagcacttc

SEQ ID NO: 482701 - DNA, 336 bp, Homo sapiens
ccgccttcagctcccaaagtgctgggattaaaggcatgaaccactgtacctggcctttttgtattttttgtagagatggggttttaccatgttgcccaggctggtctgaaactcctgaactcaagcagtccccgcaccttggcctcccaaagtgttgggattacaggcctgatcccctgtgctcaaacctgatgagatcttttcatgtgcttatttgccattcatatatcttctttggagaaatgtctatttaaattctctgcacattttaattttatttttatacacctattgttttttaggctaggtccttgctctgtcactctggcttaagtg

SEQ ID NO: 482702 - DNA, 384 bp, Homo sapiens
ttgagcccctggcatgtcattgagtcccctagatgctacttatcataaagaggacttataaaaaataatcactgcatcaaaatgtacaagaggtggggttatgctgtgatattaattttcctcaattaatgtttttcttgactgttcatgaacaatattaatagtttccacggtaaatttgttttcataatgccgaattgcgaaacaattgctggcttcacgtttctgaatacctttaatattttctctgcgttgcggttggtttgtttccttgtcttgacgctgtctatccatatggaaatcctggttctcattgttttcattgctatcagtaataaccatgtgctcctgaatcatattggactgaggcatatcggttccagc

SEQ ID NO: 482703 - DNA, 550 bp, Homo sapiens
gacgcagaccacaatgataaacaacaaagagaaagaaagaaaggaaaaaagaaaggaaaaagatagacaacaaccagaagataataaacaaaatgacaaggataagtccacacttaccaataataacctgaaatgtgcacaaattaaattttccacttaaaatgtctagactagctaaatataatagatttgtttaaaacatgactcagctatatgctacctataagaaactcattttacctgtaaagacgtatatagactaaaagtaaagggatggaaaaagacattccatacaaatggaaaacaaaaaaacaagcagaagtagctgtacttatatcaatatcatataaaacagaatttaggtcaaaaaagagtaaaaatagatcgaaaaaggtcgttaaaacacaataaagggatcaattcagcaagaagatttaaaaattctaaatatatatcagccaacatgggtatatataaattaaatattattagacctaaaggcagagatagactcgaatataataatagttacagacttcaacaccccatt

SEQ ID NO: 482704 - DNA, 347 bp, Homo sapiens
tcatgttgtgtcactctatcccagtctttcttcccacattgagaaggcttgtggccaccagctggtttcgccatgatgatctgatccactctaagtacagtgactgcagcattagtagcgagtttgatagcccaatattttcccaggtaagtatctagaataccagcttccagcatgtcctttacagcagggacttcagcctcaatatctaatccaacgtatttattccttcttgatgtactgcataaagtttagagattacttcattggccttaactccagagttttctgccagtgcgcggggaatagcttcaaatgcctcagcaaacttcttaatagcatactgt

SEQ ID NO: 482705 - DNA, 1090 bp, Homo sapiens
ggtagatttcattctgatgtgctatccggtgacaagcccgatcgacatggttttcctgggatcatatctcgggtgggtgaaagtctgtgagcccgaagaaggatgcgaggctcatgtgaccggtggacatccaagctgcggatccgcttcaaaccgttcctcttccggccaacgtaggctaggttacatcactcgactgagtcgtcggtcaacgagtcccagcaagacgttgcatacgtgactacaaagacattatgtgcacaaagcaagtgccgtcctggcgcgcaaagggtatgcaatgttgagagccacgggaccaaggctagcacggtttgcagctagcgacgacctcgacagcaccgataacaccagtcgagctgttgcacacacatgtggaggaatagaagcgctaacacttgccgacgaagtgcacatttctctccatggtggcacctgtacagcgctcgcttgatccgggcggggcggagctttgcaatgctcggcgtatcccggctgtaccttaatcgaaacccgtacttaaatggaactcgtggaggtcggtgattactttacctttcaccgccatagggtgtgggaaaagccacttcgcatggtctagccccgccggaaaggtcgaccaaccatggcttaccttatcacacatcggcccgattccataggcttgtggcacgggctggcctggtaccccctttactgcaaccaagaacagccccttcccaagttgcgaggccaaccaagacggcacgaggcccgcttgtcaaatacgtacgagaggcgcggcaacctctgggcaaaccacataccaggtaaaccacctccgggacagcccccggaaacggcataacccttacccaagaattacggggcatacccttttcataagcacacggcggcagttggggccacgaacggggcacgaagcgttgggacgcccaaggcaccctatacggggacccttacatgggcaagtccagcatgtggccctctgtcggcatccccatgcacccgggatcttccccccctcgatggtaggggcttgcacatccttcgacagcccgacgcaatgcta

SEQ ID NO: 482706 - DNA, 530 bp, Homo sapiens
atgatcattcctttatatcatcagatatccacttaatgttcagcttgccttgattagagtgtgcttgtttcgactaagatcgacatcaggtccattcattgcaaataattgacaagtcttttaaaaacagctttattgcgatagtcaacatattacacaattcacagcgcaggttgaactcacagccttgtgcgcccgtccctgtgcatcaatgattttttaaaaatcatattcatagggctgtgtaaccatcaccacaatctaattttggaacattttttgtccccctctgcccccactgccccggagagaaaccccatacgcattagctgtcactctaatcccctccctcccaccaggccccagcccctctggcaaccactagtctacttttggccagactctgctgagacattagaacaggatttatttatttatttatttattttattttattttattttattttattttatttttgagacggagtctcgctctgtcgcccaggctggagtgcagtggtgcaacct

SEQ ID NO: 482707 - DNA, 167 bp, Homo sapiens
gcttagatctaattgcttgctgtgattttgaaaactgacctacactttttgtgcattatatgtatgtcaatatagtttaggtcatattatataaggcgttcgcatttggcttttacaatataggcaaccacaggattttgttacatattttaaatccctcctaaatt

SEQ ID NO: 482708 - DNA, 101 bp, Homo sapiens
aatgtatccttttcagacaaattacactatgttgaaatcgcagaaaaaaaaaaaaggggccccgggtgggaattccttaaatattaggccttggcgttttc

SEQ ID NO: 482709 - DNA, 183 bp, Homo sapiens
  misc_feature (49)..(49): n is a, c, g, or t
ggagagagactatgtatatccgacacgtcacgcactgatcaaaccctgngaatcttacaaaaccgggagatgctttgtacaggagctggtggatgttgtgctcatctcgacctactatcgcatcacccaaattttgcagcagcacaattccctgtggtatggcacaagacggtaagagggaga

SEQ ID NO: 482710 - DNA, 455 bp, Homo sapiens
  misc_feature (87)..(87): n is a, c, g, or t
  misc_feature (152)..(152): n is a, c, g, or t
ggcacgagcccaggctggccttgaactcctgacctcaggtgatccacctgcctcggcctctcaaagtgctgggattataggcgtganacccatgcccggcctaagcttgtgttcttaataaatacacaaccgcataatccagttgtttaganttaactaaacttttactggtttcattgctcactacaaacagcttcttgtgttccacaccctatcaatttttgagttacttatttgaattttttgttgttgtttgtctggagtattttctcaaacaagttttaacagaaatagcacgagtataatttctaagcctttctgtatctgaaagtgtcctttttccttcacacgtgaattaattctgggtgtctagaaattctagggtcatagttcccctatctatctatctatctatctatctatctatctatctatctatctatgtacccatctac

SEQ ID NO: 482711 - DNA, 238 bp, Homo sapiens
ctcacgaggccacagcatagagatcgacatcaaacaagaacgactactgaatacacaacgccccaaaccccacacaccacagcactccccgcctacggcggaaagcccgtcccttccacaggtcctgtcactgcaacatctttccatgccaccagtacctatccaaccccatcacaccctgagaccacacttcccactcacgttccacctttctccacctccttggtgactccaagta

SEQ ID NO: 482712 - DNA, 998 bp, Homo sapiens
  misc_feature (314)..(314): n is a, c, g, or t
  misc_feature (342)..(342): n is a, c, g, or t
  misc_feature (359)..(359): n is a, c, g, or t
  misc_feature (380)..(380): n is a, c, g, or t
  misc_feature (398)..(398): n is a, c, g, or t
  misc_feature (403)..(403): n is a, c, g, or t
  misc_feature (431)..(433): n is a, c, g, or t
gaaacacagttccaaatggactgttacagactgaaagctgttcacacctttcagtctgtaacagtccatttgaaacagtgttcccggtagcgcgtgttgtcgaagtgatcggggtggaatcgcggggagggatgtaagtgaggggtaagggactctattactttccacagattggtcggggaagagggatctaaacacttttgtacagcagcacatattttgtatattcatgtttatttcatgtggtgaatatgcaggcggtacactacgcactggacagcatcagaaatcctctgttaatgtggactggagcntggtagatgcttgattgttttggtctcnaaatggtgtgctataangataaaggtgaggggaagacnaagcacaccatatgtccnctgtnctgttctcatagaggaaattcaatcccnnnttatctacttagcataactcaagggcactgctgatacacgtctcccgagtaacacagacacttttttcacaagccttccacctctttgtggacttaacacctttcttataaagatcactctatactactgtcccttcccactgtgagcgcaactacgaaattaccttcgtgctggatctgcagacgctttggctacaccccagtttccatcctaaactgcacaggtggacaaatccttccttcttaaacattagccacttacctgacaccatgaaacgtgttaacttttaaccctgctgtcgacactatccaaggaacctacaccaagctaactatcaaacccctcactaccactccatccacacaaccacaccacactacacaccccttaccttcgccacatcaaccacaacccactaacaacaccacaaccacaatcacacctctcctacactcctcctcacaatatctaatcacaaataccctcccccttaatccccaccacaacacacaccacatatctcataacgataccacccatatcacactatccactaactatccc

SEQ ID NO: 482713 - DNA, 124 bp, Homo sapiens
cctcgcgaagtgcccgtcttggcctctcaaattactgtaattacaggtgagagccaccatgcctggcgccatatagactttatcaatgcaaagtacaggatatttcgacaggccactgtattta

SEQ ID NO: 482714 - DNA, 508 bp, Homo sapiens
  misc_feature (314)..(314): n is a, c, g, or t
  misc_feature (342)..(342): n is a, c, g, or t
  misc_feature (359)..(359): n is a, c, g, or t
  misc_feature (380)..(380): n is a, c, g, or t
  misc_feature (398)..(398): n is a, c, g, or t
  misc_feature (403)..(403): n is a, c, g, or t
  misc_feature (431)..(433): n is a, c, g, or t
gaaacacagttccaaatggactgttacagactgaaagctgttcacacctttcagtctgtaacagtccatttgaaacagtgttcccggtagcgcgtgttgtcgaagtgatcggggtggaatcgcggggagggatgtaagtgaggggtaagggactctattactttccacagattggtcggggaagagggatctaaacacttttgtacagcagcacatattttgtatattcatgtttatttcatgtggtgaatatgcaggcggtacactacgcactggacagcatcagaaatcctctgttaatgtggactggagcntggtagatgcttgattgttttggtctcnaaatggtgtgctataangataaaggtgaggggaagacnaagcacaccatatgtccnctgtnctgttctcatagaggaaattcaatcccnnnttatctattaccgataatccagcctcgtgatcaccgttttgagtaaaaacggtaccggctcgattcgatctgtct

SEQ ID NO: 482715 - DNA, 315 bp, Homo sapiens
  misc_feature (117)..(117): n is a, c, g, or t
aaagtcactctagagatcctatttgatgctccctctcttaaatctgagctggagatggggaagaatggaggagaaatcaataaacgtttgaccagcagaatgaattctgtctccagntgaggctgtgcttgcaattttgtcttggcttttttatttttctgaactttctctcaacataaatcctttttcctttccttttacccattaaaatgtttttactctttgtgccagcactttgtcctttggctctttctgtgtctgtcccagctcagattttaaggagaggggagcatgcaaatgtaccatccatggcag

SEQ ID NO: 482716 - DNA, 719 bp, Homo sapiens
agcgggagtcgcgtgtgtggtgtccccacctggttgtaaggctgtgggtccgggaacccgagccaaaggagtggggaagtggacccggatcgaggataacatctccctgccctgtacatgactgtacacaagctgtagctgttagaccgaaatggatgtagtgctctgtactacatcgaatggaatcgacgaaagaacgtccacaagcgagggatttcccaagggatggacggagatatacagcctagatgatactgcggatgcgtcattatactctatcacgctgcgtaagtcaatcaagatgttcccgctagacatgatggatggcttactggccttccaaaatagtcggttaacagactccattattactaaattgctctagtgggcatcaaacgtatgtcactagagttaggtgactatgagagcggtgatgacgcacatacgcggagatggtgcatgtatccgacatatacagagcgctgtctgtggagctggtggagaagaatccccctatacccgcatggggcgcactaccatgtggacaaagtcgatgcatcgtagtcggattcccagatgtggaatcctaatgttcgctcgctgaccttccttctccatatgggtcggttggctgaaagcatagactactcatcagagtctcaagagtaagttctattgtctgtctagtaggcccatttccagaactctgtagtaacatt

SEQ ID NO: 482717 - DNA, 795 bp, Homo sapiens
gctcgctgcatcctcgatctcctgggctcaagcggtcctcttgcttcagcctcctgaatagcagagactacaggtttggtgtataaaagcagatcaagctcaagatgtagagaagattagagaaatgccacagatcgaagataaatgcgatatatatggtagaccaaggatagcctcgaaatgttagccatggataatctgatggtgaactggtttgaaatgaagatcttggtcgatgtaagcttaggaagtaaatatcttttgaattgaagagaaatgtgttgggacagaaagtactttatgtaactaagtgggctgttcagaagcttagaggtcatttttgtaattttctttttaattactttagagagctagggatgcaaatgttttcagttagaaagcctttatttactttggaaatgaacaagaaatgcatctgtcttagaaactggagattatgtgatgttaggtaaaacatgtaatcgtttctctggcaaattgtatcagtaaattggaaaatgagatattaggaaaaaagcaaatgcttcttaaatggagttcatctattcttttaaaagaagcttcagatgtaaccattttgtcacattccaggtattctgggagcataaaatgtatgctgttgtgaccataaatcttacattctggtcattgggaataaactcaaaacatagattgcttgttttcatactggtacctaattttgctcgcagtgtagctcaatctatccgaaagtattgtggccaccatatgtggctatttcaattaaccacgtaa

SEQ ID NO: 482718 - DNA, 170 bp, Homo sapiens
agctcggtaccgtagcgtggcagttcacctggcaacagctattctgaaaaacccagagtagctggcaggctggcagccaggacagcctgcgcctggaggcgggcctctgcctgtatgggaatgacattgatgaacacactacacctgtggatgggcagcctcatgttgga

SEQ ID NO: 482719 - DNA, 136 bp, Homo sapiens
tgtagtgatctagaggatcccacatgactaagaaccaagtatgttaagagaaaggaaagacacaaaaaagatcatttagaattctgctatactttgagcaacttgaacaagttttcttggtgagaggaggcggtgg

SEQ ID NO: 482720 - DNA, 750 bp, Homo sapiens
gaagctccctaaagcagtcgtgtgtggcgtgctgcacatgtacggtaacttgaacatggatcatgactggtttccaagagatatcgtggtctggactagtgttagggtccttacccaatataaaacagtgtggccgttggacctgacgtgtgttggtaaaaatctcaaggatgtgtcgttaattgaagtgtatattaataggaatgatatcgaataagagaggttgctgagcagaatttcgactatcgtccattacagcaaccgtgggatgtttaaaaaagaaattagaaggaggagtaatgtgaaatccttttggagctcaatggctgattgcttttatgaacaggaaaatctatccccgtgtatctaattttaacttctcactggttaaaattgtgagaaatctgtggaaaccaaagttccacaaggctattctcatatttcttccaatttctttttcagccaacgtccaaggatatgtatcaccctttggacttaaattttgctttctctaagggaaacaggggcacaaacatgttcaccatagctccactggaatgtttttatataatagaggagagatattgtaaaatagaggactgcagccagtttccacaaaaaaaggaagagttcataaatttgacatgtttggaacccataaagacattttctttgtttggaaccattataaaaagtaagtgaggttttcagagctctatatacatttttaattccctcacggttatatgc

SEQ ID NO: 482721 - DNA, 643 bp, Homo sapiens
catcttgatctcacagaatcagaggtacagccgcgagagagagtcaatgaacagactagagtcgcttgaggagtcaggagggtgtagctgcgtggacaacagactacagccctcacaggtggctctgctcttccaagcaccagtggaagatgatcacatcccagggatcagtgtcgtttagggcaatgtgactgtgggctatcactcaagaggagtggcagcatctggaccctgctcagaggacccgtgtacagggactgtgatgctggagaactacagtccaccgttgtctcaggtagggtatggcattcctaaaaccagaagtgattctcaagttggagaaaggcgaggagccagtggatattagaggaaaagtttccaagccagagtccatctgggtgacgttacgtatgtgccaggatgggaattttaaaggaaggtagatcaccaaaggtgaatcagagctagaaaaacaatcgagccagcgtgcagtggctcatgccttgtaattcacaggactttggaagggcctaaagttgggatacatcgtcctgaggtcacggagttccagaccaggcttggccatcgtgatgaaaccctgtctctaacctacaaactcacccacaattagccgggcatggtg

SEQ ID NO: 482722 - DNA, 266 bp, Homo sapiens
tattcaaataaaattttaaggatttcagttcctgaaaaggtagggtcattaaaggtcatttccggctaaatttcaaattacagattggggggccattcctgagcagaagcatcatttctactaaatattcaggtggttaactaggggtaactggacagtatcatgggcaggagatgacgaaggcgcaatggatcagctcatagctaagaaagggggaaaaaacacaataaccaaagcaaaaaacaaaatagctacagatattatgt

SEQ ID NO: 482723 - DNA, 126 bp, Homo sapiens
gtactagaggatcccccggccgcacagcttctcgatgcaattgtcaccagtacactcgtctactgatgaatgatcgtaatagatgtagatttttgaggttatgtggcgatatcttcataagacctc

SEQ ID NO: 482724 - DNA, 546 bp, Homo sapiens
agccaccatgtcagtggcggccgcgtataaaatggacacatcggaagagtgctggactgattgctccaggattcagtggccgaatgtcgtctagttccatgtcaagcgactcgtacttgggcctcccccctggtcggggagtgactcgggggtcgggacccggcaacctgaaaggaaaagtcagcgcggtccaagaggtgccgggtgcacggtcggccctgcgtagtaatgccacagagatttcagtgtcaactatcaacaatggagggaccgagaaactcccgagggagcggggccgttcagcctggctgaaaagccgcagcacatcgccagagcatcgcagcgatcggcccacagctccagaaattaactccgtgtcgcgagccggtcacggatcgcccctacaacgaacgtcgaagggaagcagcatagaaaggacggccatggcgacccactcatcccaaggacatgatccggaccactctgggctactcccatacttagggaacagggcctttggaaaattggtgcttgaccatggtggct

SEQ ID NO: 482725 - DNA, 521 bp, Homo sapiens
ggttgactatagcaatgggggccatgggacccaggtgtgtggaacccccccacggtatggccggtatatggcaaaggggtggcaagcccccccttatggggttagcgggcacccatggaatccacagggatttggagtagatcaatccccttttgcggcttggaggggtggatttggtgttcaccctccccaaggacaagctcccccccctgtaaaccctcctcctaaccaagccggatatggtatggcaagttccccaccccagtgacccgggcctttaaaaaaaaattgtaattcatgaaggggttcgttttcctgtgcccctttgaagccatgaaagtagccatcggaaaatgaaaattttttttttaaaaattgaaaggtttggcccctttagcccaaatttgctttggtgagggaccggggttttttagtttcccctttttaagtttttgttcatgagggatatgaccatgttttttttttttggccaaaaattaaaataaagtcaataaagccca

SEQ ID NO: 482726 - DNA, 717 bp, Homo sapiens
tgccgaaacggctcgacagtgtggtgcaattcgcggaacttcggtcccagctcggttttcggctaagtttcgacgtggaactcaacaggggaggctggacgcttgcatggcgcttgagagatgccatcgtgcctggctcaaataagcgcttactggaagcgaagaggagcagtactgaacgcggaagaggtagctgaggactgggggatttggagcgatcatcgaatgaccatggcggttgaactccagagggacagatgctagcttaaactggctgagggcttggaactactggaagatgatgaagaggagaaggatgatgatcgacacatgatgagagagcaaaggatagagcgtgccacatcctgagactaccatcatggtgttagagtcatgctgacgtgtctgatgactgcatgcactgagagatttagaaaccaatggatagacttgttgatgtaccagagcgattcacaggttcgccaggactactaccagaacgagtgtattgaccaggagcacgcgctgcacgagaggtgacaatggaccagaatggggagttttcagaagcttggatggtggagaagatgccgtacatgcggcataaagcattgctgggacatgtaggtgactaattgaatggagcaagacgaaggtgaccttggtcaagaacatgaagctgaggaaatgggaacttgaaaatgtgggacttgataa

SEQ ID NO: 482727 - DNA, 895 bp, Homo sapiens
  misc_feature (895)..(895): n is a, c, g, or t
acagaactactcatatttaatagtcctcttcgaaagcagacttatcacccacacttggtatcatcacaccgatgaggcaactcagccagaacgcctgaacgcaggcacatagcttcgctattgcatacaccctagtatggctcccttcccgctactcatggcacctaatttacagctcgatcaaaagcgcatagggtcactaaaatattcgtactactcagtctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgcccgcagtactcttgaaactaggcggctatggtataatacgcctcacactcattctcaacccctgaaaaacacatagcctaccccttccttgtactatccctatgaggcataattataacaagctccatctgcctacgaaaacagactaaaatcgtcattgcatactcttcaatcagcacatagccctcgtagttacaggcattctcatcaaacacctgaagctttacgggcaggcattctcatatcgccaggaatcaatctcattatattctgctaggcaatcaatagacgcatcacagtgatcataatccttttcaagattaaatctatccctatagttttggatttacaagctgtaactgttacccatataacatggggatcttgggtgtaaccggtccgtaaatatcccataggaaatagaggcgttcctattacacaagggcgccctaaaacttcaagcagtgtcatcttcccacatggaaaagcgttcgcgcgggtgtctctacgacacacgn

SEQ ID NO: 482728 - DNA, 410 bp, Homo sapiens
  misc_feature (146)..(146): n is a, c, g, or t
  misc_feature (157)..(157): n is a, c, g, or t
cagtcaagcgactatatactcatgtcatacttgacacgaacagtacctaagatacaggcaactatttatagatccatataaaaatagggttacgacctcgatgttggatcaggacatccgatggtgcagcgctattaaaggtcgtntgttcacgatnacagtctacgtgatctgagtcagagcgcagtatccaggtcggttctatctacttcaaatccctcctgtacgaagggacagagaataaggctacttcacaaagcgccttccccgtaaatgatatcatctcaacttagttattatacccacacccacccaagaaacagggtttgttacagatggccagagcccggtaatcgcataaaacttaaaactttacagtcagaggttcaattccttttcttaacaacata

SEQ ID NO: 482729 - DNA, 85 bp, Homo sapiens
ggatttgctggtgcagtacaactaggcttaatagggacatgcaaaagaatgaacttgagctacttcttcacgctgtatacaaaaa

SEQ ID NO: 482730 - DNA, 1145 bp, Homo sapiens
  misc_feature (28)..(29): n is a, c, g, or t
  misc_feature (55)..(55): n is a, c, g, or t
  misc_feature (59)..(59): n is a, c, g, or t
  misc_feature (76)..(76): n is a, c, g, or t
  misc_feature (78)..(78): n is a, c, g, or t
  misc_feature (82)..(82): n is a, c, g, or t
  misc_feature (99)..(99): n is a, c, g, or t
  misc_feature (115)..(115): n is a, c, g, or t
  misc_feature (124)..(124): n is a, c, g, or t
  misc_feature (143)..(143): n is a, c, g, or t
  misc_feature (154)..(154): n is a, c, g, or t
  misc_feature (163)..(163): n is a, c, g, or t
  misc_feature (241)..(241): n is a, c, g, or t
  misc_feature (448)..(448): n is a, c, g, or t
  misc_feature (528)..(529): n is a, c, g, or t
  misc_feature (546)..(546): n is a, c, g, or t
  misc_feature (549)..(549): n is a, c, g, or t
  misc_feature (615)..(615): n is a, c, g, or t
  misc_feature (619)..(619): n is a, c, g, or t
  misc_feature (667)..(667): n is a, c, g, or t
  misc_feature (689)..(689): n is a, c, g, or t
  misc_feature (702)..(702): n is a, c, g, or t
  misc_feature (823)..(823): n is a, c, g, or t
cggttgacagattggggttcagaaatgnnggcttggggattccttcaaaatgtgnaagngatttcgcccccagggnantgcntggaagattcaggagcntgggggccttcgttantctcactgnttctgagttgcccaggagnccactggcagntgtcccggngaagagaagagacacattgttggaagaagcagcccatgacagctccccttcctgggactcgccctcatcctcttcctnctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttntatatacggtacttatttaatatccctttttaattagaaattaaaaacagttaatttaacttgaacagagtagggttatnntgcagtattcgttggtnaantatttaatttcaactatttatgagatgtatcttttagctctctcttgctctcttatttgtaccggntttngtatataaaattcatgtttccaatctctctctccctgatcagtgacangtcactagcttatcttgaacangatatttaatttntgctaacactcatgtctcgtgccctccccgatcccctggctccgccagcacacattcctttgaaataaaggtttcaatatacatctacagtactatatatatattgtggcaacttgtattngtgtgtatatatatatatatatgttcatgtatatatgtgattctgtattgaatagcaccgttggcgtagttctgaacaccggtagtattgtaagccctcaaaaaggacgaacccttctcctgagacattctacctgtatgttaaaaaacaacagaatgaaaactttctcccattgataacccggggcctggggtccctgtcttgcttcccggggggggcccggtgaccaccttttggttccctttaccgcgggctacttcgatcctgcgaatgagcggggctctacccgtgcctggtgtgccagggctccgtccaaccgaga

SEQ ID NO: 482731 - DNA, 451 bp, Homo sapiens
catggccttaatcatcttatgctttgtcttcactgttcttcaatttgtgcccttctctagtgccagccatgtggtaggccctgaagaacaccctcatggagagcatattctgtagtcccagctactcaggaggctgaggcaggagaatcacttgaacctgagaggcggaggtgcaatgagccgagatcgtgccactgcactccagcctgggcaacagagtgagatctgtctcaaaacaaaagaccctgtctttacgaaaacaaacaaacaaacaacaacaaatatatatagagagagacagagagagagtgtcaggtatggtggtatgtgcctgtggtcccagctgctcaggtgactgaagctagtggatcccttgagcccaggagttcaaggctgttgtaagtcgtgactgccatgcactccagccaaggagacagtgagatcctgtctc

SEQ ID NO: 482732 - DNA, 736 bp, Homo sapiens
gagaaagacattgcagcagtatacctattattcgccgcatgagctggagtcgtaggcacaggtctaagcctccttattcgagccgagcgtgggccaggcaggcaaccttctaggtaacgaccacatctacaacgttatcgtcacgagcccaatgcagtttgtaatcgatcttcgttcagtgagctaatacccatcgataatcgggaggcttaaggcaactgacagtagtgcccctaataagtcggtgcccccgatatggcgttggccccgcaataaacacagataagcattcatgactcttacctccgctctctcctactcctgcatcgcagtctgctatagtggaggccggagcaggaacaggttgaacagatctaccctccctatagcagggaactactcccaccctggagccatccgtagacctaaacatacttctccgttacagactagcaggtgtctcctctatcttaggggccatcaatttcatcagcaacaattatcaatataaaagccccctgccataaccaataccaaacgcccctcttcgtacggatcctgtcctaatcacaagacagtcctacttctcctatctctcccagtcctagcgtgcgtggacatcactatactactaagcagacgcaacctcaagacgcagcttcgtcgaccccgcggaggaggagatcccataaatataccaacactattctgattttcggtcaccctgaagttatat

SEQ ID NO: 482733 - DNA, 119 bp, Homo sapiens
cacggttgacagggttcttctacaccgctgtagtaacagaagaatcacacatcaatcccaaagcccttttacatcccttctctttttgggcttgtggctgctgttggcactgttggact

SEQ ID NO: 482734 - DNA, 113 bp, Homo sapiens
caataaagggtttttttttaaacccaaaaacaaaaccaaaagcctaatgaaacccttataagaaatatataatgaaaccgggaaactggattaaataatttttcatccatata

SEQ ID NO: 482735 - DNA, 454 bp, Homo sapiens
  misc_feature (20)..(20): n is a, c, g, or t
  misc_feature (39)..(39): n is a, c, g, or t
  misc_feature (56)..(56): n is a, c, g, or t
  misc_feature (182)..(182): n is a, c, g, or t
  misc_feature (357)..(357): n is a, c, g, or t
  misc_feature (440)..(440): n is a, c, g, or t
cagatttttgatgaccatcnccctgaaccgtcatgtgancaactaattaaatgaanatttaaatgcctatggggcatttttttaaatgcattgatgtaaataggaaaagttagagaaaagtattaatagaacatgtggaatatggaccatgggaaaaaacaaacgcactgctgggtgccagntgttacgcctgtaatcccagcattttggaaggccgaggcgggaagatcacttgaggtcaggagttcaagaccagccctggtcaacatggtgaaaccttgtgtctactaaaaatacgaaaaacattagccaggcaaggtgtcacacgcctgtagtcccagctactcaggaggctgnggcaggagaattgcttgaacctgggaggcagagattgcaatgagccaagatcatgccactgcacaccagcctgggtgacagantgagactctgtctc

SEQ ID NO: 482736 - DNA, 218 bp, Homo sapiens
agctatgccgggaccggtgctggggagtttccagtcccggctcggcttgggacgcagctgtgcgcaggcgtgtgtcggtccggactttggagtgggacctgggccgtgctgggtcttgggcgtttggtgcacgcggagggctggctggggcttgttctgtcttgggacgcttgggaatgcggaggactggctggtggctgcacatctgtcaaaggggc

SEQ ID NO: 482737 - DNA, 469 bp, Homo sapiens
cacgaggcgcagcacctggtctcgatcggccagggcctcgaggagatcgcgagcgaggtcggctacgccgatgccgcgaccgtgcgcagcctgctgcggcgcaagctggggcgcggggtgcgggaactgcgctcggcgctggcataggtcgtggggcacgatctcttcgtgtccgccaatggcgcgatccgcaaggtatccgaattggcgcgtcgattcagtgaacgcgcaattgctcttcttctttcatggcccggcgcatcggcgaaatagcgctcgctcattcgacgcgcgccgtgttgcgagcgcattccacgctcaggcttcgccgcaattcgagaggtcggcgaaaggctcttattcgtaatgagataaattctcattcgaatttattgcgtcgtcagagggcaacaagtttcgcaaaccaaaggtaaagttgccgtaaatcgatagtgcgagtcattatcat

SEQ ID NO: 482738 - DNA, 91 bp, Homo sapiens
cgtccgatggaggcactcacaacacaggaggaagcgccacacaactcagctcctcgctatctaggaggccattggtatggtcggcaagtga

SEQ ID NO: 482739 - DNA, 249 bp, Homo sapiens
atctaggaggttacgtaacgccttccccaacagatgatatagtctgccttactcagcacttacattctgagtcagcaattgacagaatcaaatccccagtcatggtgaactgatagaaacgaaccttcttcacagacacattgatggcactctatcctaataccctttatctgtcccggcatccttatattgtctccatacaaatgatgagacagccacaagggacgggatagcagtggactgtcaaga

SEQ ID NO: 482740 - DNA, 394 bp, Homo sapiens
atggccaaacagcattggaaggctttagccctgctcctctaaattccatcctgtaaagaacaggagtcaggagccgttggcggaagacagcatgtaacccaggactttgccggtgcaaaatatgagcaatgccatgtttttgcagaaaacgcttagcctgagtttaataggaggtaatcaccagacaactgcaaagtgtggagcactgaccaggacaactgacctgtctccttaacatagtccatatcaccacaaataacacaccaaaagggagaagagatattttgggttgaaaaaaagtaatcttttggttgttgccattgatggtggtgacatggacttgtttatagaggacaggtcagttttctggctaagggatctacattctgaagcc

SEQ ID NO: 482741 - DNA, 725 bp, Homo sapiens
gggagatgacacgccgaccagctgcagagaggaactaccctctctgctgacagctggacacttatcaggagacctgcctgcagagaggagctaccctctctgctgagagctgaagagaagatgggccaaccagctgcagagaagagaggagctaccttctctaccgaacacggaacactccttgggacgacctgcccagcagagaggagctaccctccctgctgagagctgaacactcatcgggacaccctggctatgcagaggagctgcacactccaggtctactgtgagctgttctattgttcagtaaagctcctcttcgtcttgctcacgctccacttgtctgtgtacctcattcctcctggacacaggacgataatctgagacctgccaaatggcggggctaaaagagctgtaatacagacagggctgaaacacgccacttgctcgccattttgtgagtgacaaggacgagagaagtgagaaggagagaaggagaggagctgcagctctttgggaaacctagacctgggagctccccaagccaggctgtgactacccctttggggctctgaggttcctggagtctccaagcttctgggcaccactgtgttcctggtgccagcgtggaagctgcttgtggtgcagctggccagcagcagctcgcagagatgcgacgcttgtgcagactggagtgcccgcccacgcagcgtcaggttcgactg

SEQ ID NO: 482742 - DNA, 1141 bp, Homo sapiens
  misc_feature (392)..(392): n is a, c, g, or t
gcgctgaagccgcgccggcgggcgagggctctgaagctgctcgcgcgcagtcggaggcggagaaggacgaagactgagactgacacttctgctcccggcgccggatttacgcggggccctcctaagacggccctagagcaacgcagattcagacgtacagaggtagagagcgggcgcctatatgcacgctctcatgcacatgttgctggctgctgaggaagaaatccgttcattcgtctccaggtttcgggaatggagcaagggggaccactttccaatggaaaggccaaacgagagatacggacaggcatattaaccagctggcgagattttcacgagagtaatttggaaaataatggaggggcgaaacaggcagactcctggggagaganccaggaggacaagaacagtacccagcaaaagcaacgacacaccggggataggacagagagccggaggtaaccactcctcgctggaggcacagcgagacggacgcaaggatatgggagcgagcacgaatttggcagagcacggagaatcaaggggcacaaatagccagggaggatacagatataactgggcacacagccaggggggccaaacaattgggaccctgtgtggcaccagcggagcaagtaggagaccaactctacaggaacacagtaccggggacacaccgacagatggagccatgagcaccactcaaggggcagacaaattcgaccaacacctaaaggatatactctggcgcaactacgacgcgtcacattgaccaaacacttggcgacaaaagcctccaccacacgggccacggtgacacaccgtattcgacgggcacgccagcaaacagagaatccacccgacaacgcagcacacaagtcgccgcaacagggccggaaataccactcgcacccgagaaacatgattcacacacaaccacggggagcagacacgcgcgaccatgtagtacccgacacgccacgtcagcgccgtgggaattcaatgtgagagacagccacagctgctgcaccagaggtcgtcaaaagaacacagaaggagacgaggggcagacagccacgatgcaaccaacgggagcacaaggggtggcaacacgccgcttagagaagcacgagcacaccaa

SEQ ID NO: 482743 - DNA, 416 bp, Homo sapiens
aatggaatcgatccccactcgctgttctggatcaaaacgcgacttccccttcgactctgcgtgggttgtttcagaggtcgagcacctgatgcgtctgtcggccgtcaagtgtcgtacgccgtgaacggaagctcagcattcttctactggtctcaggtagattctggagtcattgctgttgccaggttggcatcaagtgcagtcgtcgaagttgatgtcgtacccgctgcgcaagttgacgctccatctgcgcacagggcactaccagtgacagctcaatccatctttctatagcactcacttccctgaggaggctcccctatgcaggtcatggcatcaacaattcaaaaagtggagatttctgaaataaaagcgctcgaccctgtgacatgcatcttgcaagatttgggtcgtta

SEQ ID NO: 482744 - DNA, 1494 bp, Homo sapiens
  misc_feature (416)..(416): n is a, c, g, or t
  misc_feature (1245)..(1245): n is a, c, g, or t
  misc_feature (1493)..(1493): n is a, c, g, or t
tctgagaagggagtctcgctcgtgtacaccaggcgggagtgcaggggcgcgatctcggcaaacctcgcgcctttcgtggggtacaagcaatttctccgtgccttcagccctccgtggaggtagcgtgggacatatagggtgcagtgccaccagtgcccagctaattttgggatatttataagtagagcacggggtttcaccagtgttgggcccaggatgtggtctcgagtcctccgtgacctcagtgatcacacccaaccttcggccttcccaagaggtgtcgtgggattctccagggcggtgagccactgtgcgccgcggtccagcccgtggtggatcttctacaaagaaacccttcggcccccagtgtgatgtggctgtgatatcttcaacctcccaagcgtggtcttcgtatngcacattataacactctccttctcctgttggggaactccctgtcttctcctgtgaagcagccatgtggtcctatggtgggggagataccaggggggacagttaccctgtgtaagagtggaacccctgtgcgaccccacattagatcctctgtgtgcccaggagcagagggagtagaattcacacagaaagcccggatacatgggaggggagacaatcccctcacattgtgacctaagcacacaaggcgccccatatcacggaaaaagcacaagggagtggggcactgggggcatctaaccttacagcgaggggggcatcctcccacaaaagaaaccaatccaagggaaggtgggaatatacaagagcagcccccctgggagggggccctgcgggcgtatggaagcggagaggggagcccacacaaatcgaaacgatccccgagtgggagcctacataaacgccccactcggcggcaacaagggcgtctaggcgatcatggatatactaacgcgagcccactactcattggggtgcacacacaacgtaggccagtgaaaaaaagccccccaatatcacggtggaggcacccccctttcagggcaaccataaagacgcgggggttacccacaaggtatcccccccaaggtggttgtgtacccccacggacaacggggcgcgacgtagtacacaggagggaaacacccacgcgtcgaaaatataacaataaagagaatctagtagggcaccaaatgggatattatcaccggaggcgaatatggagataatgcaacacacgatgttttgtgagcaccaacaaacagaaacaangtggggcggcataaaataatacaatgaggcgaggcgagtgaacaatcccacacttgattaaagatggacacgatcgcaaacaataaatacaagagtgagtcatacgatagactaagagatagagagcagtaaataaggtcggagcagaaacaacatacagtagttctctcgtatgtcttatcatgaaatctgcatcatttatagacgaagtaaagcgaagatcgaaagcgaagagagaggagaagagna

SEQ ID NO: 482745 - DNA, 862 bp, Homo sapiens
  misc_feature (4)..(5): n is a, c, g, or t
accnnagaatggagtagtgtaagtaagaaagaagaaaagagaaacgcgtataatagatatggggcgcaatcttacgcatattattgtgaacaacgttgtccagtgttgccccccgcgggaccacacccaatgtagttcacactgttatccgcctgccgttatgtccggttcaccccatcccttgtaactccccgtaacataccgggcactcgaatatttaaaggccggcacatgtccgtgaagggcgaaaacggacattgtctttcttccaaaggccgtccttcacaataccctgggttccctaattcaatccggttccacaaaacaaaagctgctgaaaaatctcattatgcccgcgagtgccagcattcatctttacgaaggtgacatccttcgcacgtcccaagatgggaagtccttacccccatgcacttatgtagaaaaacacccccctcacacattttttcaaaagacacccgccctcgtcaattggtactcaccaattccgtttcatatgaagccacagtggcgactctaaacatgatcgtagggagcccaacaagtgtattccagggtgcacctttggaagcccgcagggtctatatatatcaatttttgaggggggtgttgagttgatgtccccattaaacacggtgcttgttcagcgtgtgtacacgtgtgcacacgcactgggcaataaatctgtggtacccacgcttttgtgtaacccaccacccaagccccgtataaggttcagtagggtgcgagtctcccacacaagcgaagtcagggggagttaagcgaaaaagttttgggaataagaccttcttaaagaaaaaaaagagaacccgcctacaaaaca

SEQ ID NO: 482746 - DNA, 538 bp, Homo sapiens
gaggatccccgtctggagcaagcggggaatgtcttatcttcgctggttcaggggacagtttggctaaatatagaattctgggttaacatggttttggttttagcactttgaatatatcagccacggggccttcttacctccaagatatcatatgagaaaagggctgataatcatatggaagatcccttatatgtgatgaatggttacggtttggctgcttttaagattccatctttaccttgggctttggacaattggaatatgtctcaggatagttctcttggagtttatcttactggttgggtgagcttctgggattggtagagtcaggtttttcatcaaattggggaagttatcaaccattacttcttcaaatacactttcgggccccttcttctctctgcttcttcggtgactccggcagattatgtgggtcggctggatggtgtcccttgagttccttaggcgctgttcactttttttcattcattttcattcattcttctttcggtttctcaaactcagtaattggaccttc

SEQ ID NO: 482747 - DNA, 241 bp, Homo sapiens
cactcctggatgcggtcggagccaaacgataggctacttgctccctcaacatccaaatctcatcgccctcccaataataggtacccggcctggccttggcggggtcttcaaggatcagccccgcctcacgcaattgctgcacaaaatcaccgacgtaccgaggcgcaagtcctcggcagtcagctacggtgaagccgccattggtcaatctcggcgtaatggccctgtccagtgccaacag

SEQ ID NO: 482748 - DNA, 321 bp, Homo sapiens
gtaagcgggctagagcggctctccaaaagtcaattcaatccccaatgagatagaaggtagaaactcgaataatgcttcagagaaagatcaacatgtgtcacagattccctcccagcttgttcggctctaaggcaggtgattcctttgttccttcagactgaacaccaactcttgattaaaatttggaaactactttggaaaggatgtgatggtctgtaaatatttccagggcaacccttcataaaataacaacattcactagtagtaggaagaggacgcaggtagaagagaaaaaagaagcctcctaaagcttcccaggac

SEQ ID NO: 482749 - DNA, 840 bp, Homo sapiens
  misc_feature (211)..(211): n is a, c, g, or t
  misc_feature (260)..(260): n is a, c, g, or t
  misc_feature (263)..(263): n is a, c, g, or t
  misc_feature (271)..(272): n is a, c, g, or t
  misc_feature (277)..(277): n is a, c, g, or t
  misc_feature (280)..(280): n is a, c, g, or t
  misc_feature (282)..(282): n is a, c, g, or t
  misc_feature (285)..(286): n is a, c, g, or t
  misc_feature (289)..(289): n is a, c, g, or t
  misc_feature (291)..(291): n is a, c, g, or t
  misc_feature (297)..(297): n is a, c, g, or t
  misc_feature (303)..(304): n is a, c, g, or t
  misc_feature (306)..(306): n is a, c, g, or t
  misc_feature (308)..(308): n is a, c, g, or t
  misc_feature (317)..(317): n is a, c, g, or t
  misc_feature (322)..(325): n is a, c, g, or t
  misc_feature (329)..(329): n is a, c, g, or t
  misc_feature (332)..(334): n is a, c, g, or t
  misc_feature (336)..(336): n is a, c, g, or t
  misc_feature (338)..(339): n is a, c, g, or t
  misc_feature (344)..(344): n is a, c, g, or t
  misc_feature (347)..(347): n is a, c, g, or t
  misc_feature (349)..(349): n is a, c, g, or t
  misc_feature (354)..(354): n is a, c, g, or t
  misc_feature (360)..(360): n is a, c, g, or t
  misc_feature (371)..(371): n is a, c, g, or t
  misc_feature (379)..(382): n is a, c, g, or t
  misc_feature (390)..(390): n is a, c, g, or t
  misc_feature (395)..(396): n is a, c, g, or t
  misc_feature (399)..(399): n is a, c, g, or t
  misc_feature (405)..(405): n is a, c, g, or t
  misc_feature (413)..(414): n is a, c, g, or t
  misc_feature (419)..(421): n is a, c, g, or t
  misc_feature (424)..(426): n is a, c, g, or t
  misc_feature (430)..(432): n is a, c, g, or t
  misc_feature (437)..(437): n is a, c, g, or t
  misc_feature (440)..(440): n is a, c, g, or t
  misc_feature (462)..(462): n is a, c, g, or t
  misc_feature (488)..(488): n is a, c, g, or t
  misc_feature (492)..(495): n is a, c, g, or t
  misc_feature (502)..(502): n is a, c, g, or t
  misc_feature (507)..(507): n is a, c, g, or t
  misc_feature (515)..(516): n is a, c, g, or t
  misc_feature (518)..(518): n is a, c, g, or t
  misc_feature (522)..(522): n is a, c, g, or t
  misc_feature (527)..(527): n is a, c, g, or t
  misc_feature (568)..(568): n is a, c, g, or t
  misc_feature (572)..(572): n is a, c, g, or t
  misc_feature (577)..(577): n is a, c, g, or t
  misc_feature (676)..(676): n is a, c, g, or t
  misc_feature (696)..(696): n is a, c, g, or t
  misc_feature (736)..(736): n is a, c, g, or t
  misc_feature (837)..(837): n is a, c, g, or t
tccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcaggtactccctgcagaagctggcatacacggtgtcgcggaccgggcggcaggtgttgggggagcgcaggnagcgagcccccaactgaggccccagctcccagccctgggcggccgtatnatnaggtgctnntgtgnatntnggnnagnangggagnaagtgnngngnaggaatgtngggtnnnntgtnttnnntngnnagagnagnanttggnaaggtnagtgagggganagtagaannnnggagaagnagtannganaatgangaagatannagatnnnttnnnaaannntttgnaanggtaaaaataaggggaggggtngggagggggggggggatagggggagnagannnntgagatntgggnataggcanngnattntgatntggacaaagtcgggacagcaccatcccagccccgaagccanggcnatgcnagcaggccccaccatggaaatcaaaacaccgcaccagccagcagaatggacattctgacatcgccagccgacgccctgaatcttggtgcagcaccaacngcgtgcctgtgtggcgggantggagggcacagttgaggaaggagggtggttaagaaatanagtggggccctctcgctgtcccttgcccagggcacttgcattccagcctcgctgcatttgctctctcgattcccctttcctcctcactgcctcccaagccnacc

SEQ ID NO: 482750 - DNA, 370 bp, Homo sapiens
  misc_feature (299)..(299): n is a, c, g, or t
cctcccaaagtgctgggattacaggtgtgagccactgtgcctggccaggaggtcacttctaaatcttcctgggggctatgcacggtgcctcatgcctgtaatcctagcactttgggaagctgaggtgggaggatcgcttaagcccaggagtttgaggctgcagtgagttatgattgcaccactgcactccagcctgggtgacagagtgagaccttgtctgtaataatagtaacaatcaccatcatcatcatcatcatcatcatcatcatcatcatcatcatcccagcactttgggaggncaaggcaggcggatcacttgaggccaggaatttgagaccagcctggccaacatggtgaaaccccatctcta

SEQ ID NO: 482751 - DNA, 447 bp, Homo sapiens
ttaaccaaatgctttcctgacagcgtcttggccagctcgattgcttccagaccttcacgcactgaaagaggtgtgtgcagtgtccgcaacaaggtagccgggtcggaaatcccggtgaattttgcgaaatcgtcttcatgcatcagcgcctgctcgagaagtaggcacgcagcttcgttgatatgtggaagcgccttgccaatgctttcggtgagcagttctgcactcacctggttggttctaccctggtaaataggaacaacccttccactaccctcagcagcgaccagcgttggattggacaaactcaggcggccgtcgaaggtagtcagttcgccgtaaagattcaccactgtcccaagctcaggattcaaccagctttcgatcgctggttttccaatcacattgatctgaaccctttcgccacgggcgtcagctgcccggagg

SEQ ID NO: 482752 - DNA, 264 bp, Homo sapiens
acgaggggctgaggccacagccgcatcttgatcaggctttctcaagccgtccatcggccccaccagatttccattgtttcccatgaggtccaacacatgagaccccacctccctccctgcctgccagccatagaattgttggagcatagagcccttcctccccaggcataagtatgtggagctctgctttggcagtgccccgcagaggccacgcctatatattctgtttctgttgtattgtttttaacaactttactttgcaca

SEQ ID NO: 482753 - DNA, 173 bp, Homo sapiens
catgaggatccagagccgctgtaaacttaagggagtctgtgggaacaccaagaagccggaatcattcacagaaatgcggagaagccgaactagagaacaccggggcgcagacaccacggctggaacacagagacttggcaacatgcgtggatttgaaccggcggtgcggcgtg

SEQ ID NO: 482754 - DNA, 987 bp, Homo sapiens
cctgtattaaaatttccccgaaataaaaaaagctgtcttttaaaatccaaatctggccctttgaaaccaatccgtacttggaattttccttaagattcattctgaatcccccccctgaccttgtgtcccccaacccaccattatttccaacatgagtaaagccctactttgatgcccatgctagaaattgatcccccataatactaaaattgttcatttccaaaaagatccatttggataccagctatgtataaaatggaaaataaaaattattctatttgcatgaatagttccgactttcccctacccccgccacagccgttacttaaattaggatcttaattttgccatggataaaaggtctcaaggttcatattaattatagctcctcttaaaccctcgtctcttctaagatttttcaccccccgtgattttcccaaaatttgggaaaatgtaaaacccacttgaataataatttaattgataatgttggcttaccacagttcaatcctttctcccacaaataatccacttcacgaagagaaatgtgaaagctctgttgttaaatgagaagagcttataacccctcttgtggtccactttgtggtgtttgcaaaattcacaataccccccacattataaatttctgaacctcatatatgtttgcactcacttaaactttcctaatattacccacgaaccactataccctcttttcacagtaaaagttggcccaatgggatatggccaccttttaatttttgaaaaaatatgtaaccactgaccttaatatttttataattttcacgaattagaaacataggaagggaaaatgttttaattagataagtccacctttttatgtgtctgtagtggtgtactataatacgccaattataaacgccttattaaatgtttataataatttttaatattacctacattatgaatttaacttaaattaagtgtgagttgtatattttttta

SEQ ID NO: 482755 - DNA, 1391 bp, Homo sapiens
tgtctcttctcttgtctttctgcgtttgctcgtgttccttggtcttttcctcgtcgtgtgtgctcttcctgtctccgtctctgctcttcgtcttcgcctagcatctctccgctagcccgcctgtgtcctcctcgtcactgtggcccgcggtgtgccgcgtcccgctccacctgtccgttcgccttcttcggtgcctcctgctgctctcatcgtcgtgctgtcttctttcgtcctggtgttcccggcgggctctgccgtgtgcccgtatcttctgttttatatggctagtgtgtgatgtatatgtgtgggtgtggggttgtcttttgtttatatatgggtgcgatcgggtatagtgtgtgtggtgggtggtggtggtggtgtccttaatgaagctgactcatatttgggatgtggtgtagttgtggggtgtgtattggacagttagtgtattgggggtatgtagtgggtgttttgcgtgctgcgcttggcgttcacgtccttttctcatgtgttgtcggcatgtctcaggatctttcttccgtggctgtctgtgttcagctggtgtctggttggattcctggctatcgtgtctatcagtcttgggtacctgcccaccgtacgacagtgtcttgtgtttgacccaagtgtttgtcctggcatcgtgtgatgttgtgtcaatgtcaatctggtgctttgcagtctccacagggagcatggatgtcttgcttgctgcacgggtccattcagacgatctgccaccatgcaaagtcttgggttgctcatcccatgcgcatcgcatgtcgcgtccttccagtctacctcgccctaccggcatcgcaccggctgtctcctgggctgtgtccaggccagaggcagtttgaggtgtgtctgggtgtcacttggagtccacttgggagcctccttggaggacattcgtccagtgctctgtggtgctttgttccctgatgacggtgatgatggtgtgagagtgcttagtagcaggtgacgcctgtacggaaaggggtacatatccaatggccgcctgtccatcacgctcacagcacaaatcctgctcattgcagtctgtgatgtcttggcatcggggtggctcagtgcagagtggagcctcaatggccccctcggcctcctgggcaatctttggggtacacatggatacatgtggtgttatgtccgctccgtcatctcaaccccaggttatggggtatcacctgatcccatgctggctatcaggcccaggggcaccttcggctggtcctgtggggccctggatcggtggcccatgtggtggatggggctgctcctggctgtggttgtgcgcccggggccttgggatgcaggcctggtcacgctaacgtggcggcgaatgtgtg

SEQ ID NO: 482756 - DNA, 753 bp, Homo sapiens
  misc_feature (1)..(1): n is a, c, g, or t
  misc_feature (233)..(233): n is a, c, g, or t
  misc_feature (248)..(248): n is a, c, g, or t
  misc_feature (269)..(269): n is a, c, g, or t
  misc_feature (436)..(436): n is a, c, g, or t
  misc_feature (465)..(465): n is a, c, g, or t
  misc_feature (534)..(534): n is a, c, g, or t
ntccgagagaggcgccctctcgtaatatggggtgtgtcgctctctccccgggtttcctcaaatcccatttgggaaagactattttgggggcccccaacaaaaagagctcttctctcggagagggtttttttttggtgtgttctctctgggggaaaccactctcccgagagggacacacagagaggccttctataaattccccactcgtagagttttttttggagttgtgcgcnctcggagatggagtncccaccacgccgcgaggagcnccccctcggctttattacactattactaacacgcctgtggagcacaccctgcgcgctctgtgggcggccccccacacgctgggttgtgtggctcctcacaggacacacacagcggggtttggtgttctcggggccacataccaaggtgtaaagaatcacatgctggnccctcgggggagacccaacacactcgtgntataaagagattggggcccccctataagagaggccccctcgcctcgagaccacacgctgaggccacatntgtggagaaccccacaagaatgaggatactggcccacccaccccccacttcctcacgagaccacgaaagggtgtggaagccacgagccgccctgccactgccccacagccacagtctccacaccacgcactaacacacgggtttcccttggcacgctgtatttctggagtctggatgttgctcttctttaagaccctttaattaaattttgtaccaaga

SEQ ID NO: 482757 - DNA, 357 bp, Homo sapiens
tttttttttttgagatggagccttgttctattgtccaggctggagggcaatggcacgatctccactcactgcaacctccaccacccgggttcaagtgattctcctgcctcagcctcccaggtagctgggattacatgcatgtgccaccacgcccggctaacttctgtatttttagcagagacggggtttcactgtgttggccaggctggtctcaaactcctgacctcaagtgatctgtccaccttggcctcccaaagtgctggaattataggcatgagcacaacacccggcccaagattttttttaaagaaagaatactattttcatatgtgtacagtcacatttaaaatatactac

SEQ ID NO: 482758 - DNA, 149 bp, Homo sapiens
tacccgggcatgtgtatggcggatcacaggcatgagccacgatgcaatgcttcacactggaccaagccagcaacaacttggaaggccatgagacaagaagtggaactgcttaagatcactcgatcatcaatgatggaatctaactgagc

SEQ ID NO: 482759 - DNA, 115 bp, Homo sapiens
gagaagccatgagcagcaaagacactcgtgcgacaccccgttacgaggcggtgcgggaaggcccccacgggacccagcgcaagccctgcaagttccctggagacggcgggagttc

SEQ ID NO: 482760 - DNA, 208 bp, Homo sapiens
gcggccgcctactactactactgctcgaattcaagcttctaacgatgtacagggacatggtcgtgtgtgcctgtagtcccagctacttgggaggctgaggtaggaggattgtttgagcccaggagtttgaggcggcagtgagtcaggatcacgccactttactccaacctgggcaacagaatgagaccttgtctctaaaaaagaaaaa

SEQ ID NO: 482761 - DNA, 573 bp, Homo sapiens
tttccctaatccatttcctttgtctggctggctgttcgccctcgccttcttgtttcctcttctcacgagggcatttccaatccggtttgtttcccccctctatggtcgtttccgatttacggttgttagccctagctctcttccgataactcaggctcctcttgcccctccctccttggcccactcctgtggggtgggagcttcttctcgtctatttatgaccccacggtttttctcccggtgccaaaatcacgactctgtcccagcatcctacgcggggtccaccacggtcttcgtttccccgcccctccactaatactgccctcgcgtatcacaatgttgtgcccccacgcacccctactgcgggtgtcccaccacccccccccccccattacccacactctagaccactccgctatctccacgccatatgaacacacctcgtccttattattactcagctcacttcctctcccccatttgatccttcgcttatcatcgcctcacctcacccggcacatactcaatttcaccgggattgtgtctcctcgttaaacaattaacaaaaaaaca

SEQ ID NO: 482762 - DNA, 309 bp, Homo sapiens
  misc_feature (50)..(50): n is a, c, g, or t
  misc_feature (67)..(67): n is a, c, g, or t
  misc_feature (85)..(85): n is a, c, g, or t
  misc_feature (89)..(89): n is a, c, g, or t
  misc_feature (91)..(91): n is a, c, g, or t
  misc_feature (162)..(162): n is a, c, g, or t
  misc_feature (164)..(164): n is a, c, g, or t
  misc_feature (188)..(188): n is a, c, g, or t
  misc_feature (191)..(191): n is a, c, g, or t
  misc_feature (202)..(202): n is a, c, g, or t
  misc_feature (209)..(210): n is a, c, g, or t
  misc_feature (214)..(214): n is a, c, g, or t
  misc_feature (234)..(234): n is a, c, g, or t
  misc_feature (301)..(301): n is a, c, g, or t
caactccggggttgagagataaatgaatgaagagtaccaaaatatttgtngacttctcttcattttncccatacaatcggaagcntttntngactatcatatccccaactcacagcagcgaaagccagttcagatttgagatcagtctccattcacttccangnagcaccacagcaagagtgaccggnggnagagagctctngtggggnnagcnttctaataagcatgtgaagngaaaaagaaccctctagcagcacactgatttagtttgtaagactttaatttacaaattaaaaaagcnatttaata

SEQ ID NO: 482763 - DNA, 576 bp, Homo sapiens
caacgatggtcctctagcttggaaacaaaagtaactgaaataagtctcaatcaatttagaaagtttattttgctaaggttaaggatgcactcatgacacagcctcaggaggtcctgacgacatgtgcctgagggggttggggcacagcttgcttttatacattttggggggacataatacatcaatcagtacacgtaagattcacattggttcaatctggaagggcagaacaactcaaaccagggtgttgggggacttccagctcataggtagatttaaacatattctgattggcagtctgttgaaagcattattatcagtagaaaggaatgtctggctaatttttgtattgttagtagagatggggttttaccaagttgcccaggctggtctcaaactcctcagcacaagcaacccgctggccttggcctccaaaactgctgggattacaggtgtgaaccactgcaccagcctagacataattcctaaatatatcgtgatttactgaataacaagggaatcatgatggtggcaaactgttacagtattctataccagataacaggacgatgcgga

SEQ ID NO: 482764 - DNA, 170 bp, Homo sapiens
ctcccatggatgaggattgctccaaggatgaggattgattttgaccatgagccatctggttggaggtgactgactggaaatacttgaggatctctgaatgggcggtctcaagcgtccagctgggctcttagcaggttctcgtcgatcctctgaatggtttcctccagttt

SEQ ID NO: 482765 - DNA, 821 bp, Homo sapiens
gcaggagggtgctcggaggccacaggagtgtgttcctggctggcctgaggctggccggaggggatggggctagcagcgtgtgtagaccgagggttccatcatgctgggcgcgaccgtggccttgcccttctcggtacacctctgtatggaacgcctactcgcgctctcgcctcgtgtgacactcgttggcccgcgcgcgcgtcacgacgaccctgtccctctggtccttccacgtgaagctaccgcatgtcggtctgctcgtggcgatctgccttagcgcgggcaaaaggctggcggctgcatgcgctcgtggcgtaggtaagccgcgcagagtcggggacgcgagtcttgcacgcgctgttcagacacgaggacgctgtccagcgctctcgcacgcgtgcgtgccacagtgttactttggaggccacgagagaccatgggccacgttgtgtcgattgcgcgacataggtaaacactcgatactgggcttgcccgtaaaagcttggctccaacatcagcatcagcgctccgtgctaaggctaaagccctacgagcagacgaactagatcggcagtatccaatagaagcccactgctgtttcctgacgtgggacatgagacaggtctaccattgacgcataacagtcaatcatggaaatacgtgatcgagtggtgtctcagccctgaaacgcaggtgagaggatcgtacaatgacttccgtcaggacttacggcgttcaccaaagggctgccttacgcggaacgttgcacgttgaaatgaaaggggcaaatgcagagaagcattgtcagttggaactaccga

SEQ ID NO: 482766 - DNA, 201 bp, Homo sapiens
atcgagctcggcaccgttccggcagcaggtcagacgcaggatggatgggggagggcatacccctctgtagatgggcacagtgtgtggtgaccccgtcaccggagtccaccacgatgccatgtggtacgtgccagagtgcgtacagggatagcacagccgtggatagcaactgtacattggcttgggtgtgtttgaagtgtc

SEQ ID NO: 482767 - DNA, 100 bp, Homo sapiens
aaaggacaaatgctctcatactttgattatgtgacgaaggatgagtgtgtgtcaatgcctgtctaacacacagtaatgatccagtaaattagactactat

SEQ ID NO: 482768 - DNA, 202 bp, Homo sapiens
ctgatgtagtactgagctaaactaatctatctagctactactttactgactaagctagctactagcgcgggcgacgtactactaaagccccgtaggggcactaaaatatcccctttaactacgccggcagatagtctaattatctaattaggtaatttatttaattgctttagcgtctaatttctttaactttataagctct

SEQ ID NO: 482769 - DNA, 447 bp, Homo sapiens
ggtcgacctgtagcatgcagtgctgtttgatagcattttacccactatagaacttcttttgaaattggagtcaatcctctgatacagctttatccactaagtttgtgtaatcttctaaatcctttgttgtcatttcagcaatgtaaacagcagcttcaccaggagtacattccatctcaaactgcttctttaattcatccataagaagccattctggctgggcgcggtggctcacgcctgtggtcccagcactttgggaggccgaggcgggcagatcaccagaggtcgggaggttgagaccagcctgaccaacatggagaaaccctgtctctactgaaaatacaaaaattagccaggcgtggtggcacatgcagaggctgaggcaggagaatcgcttgaacttgggcggcggaggttgcggtgagccaagatcgcaccattgcactc

SEQ ID NO: 482770 - DNA, 972 bp, Homo sapiens
tggaaacagagtcttactcaattggctcaggcgggagtgcaggggtggcaatcacggcgtcagtgacaaccatccgaccatcagtgggatccagagcagatacgacctgacggactctcacaacagatactcgtgcgcatgacaggctgcgccaccgagtacacaacaggcgatacactctcggaggagtatctacaacgacaacaacagcacgcggcccctacacacaagtgataggcgccaaagagccagcggcacctacagagaacgaacgcgcgaaacgacacacaagactcgaacccgcgaacccacagctgcaggcccccacaaacagggacgtgagcgaactgaaacaagcgacagctagcagccccaccactatgacacccacgtgcgccccacacaaacaacctgccaaaaacacgtagcccaactacacacaacacaacagaccccaacacacacacaacagagacacacggccactctccataaggagcaacataaataagcaccaccgcgcacccaaaaaagcacgcacctaacaaaaacacagtcacacaagagaacagagagcaaataacagcaccaaagagaaggcgaggggcaccagcgcacaccgagacaaaagggagcaccaaactacccgcgctcgatggggccaccaagacaggcacgatgggccaaaaacgagacgagtcgaccacccaccaagacatgcacacaacacaccagaggagtgatctacgcgacaaaacacaagagacaccgcagcaaaaaatgaaacacgagacacagaatgcacacaaagcacccccacgccacacgaagagaaaaaagtccacaacaaaaaaacagcgacgacagcggacacagcagaggaaaacacaccacaccaacaaagacaaacaagcggcggagacgacacgagaaggagaaacccgacgaaaggagagacacaacaccccaaca

SEQ ID NO: 482771 - DNA, 797 bp, Homo sapiens
ttaaaaggaccataatcttaagcccctctcgagggcagcagctttagttctagtgttccaccggccttaaagatttcgcctcacgaaagttcctgggctacccatggaccgctctctcgaccgtggttaccgttctggtaagaactagccgtaccaaagtcctcgcttcttgcctaggtgtccctgatgccaagattggcattcatgacctgggtcggaaaaaggcataagtggttgagtttccgctttgcggccacatggtgtcagatcaatatcagcagctgtcatatgaagcggtggagtatgacgaaatttgtgccaataagtacatggtattacgttgtgcaaagatggcttccatatccgggtgcggctccaccccttacgtgtcatccgcatcaacaagatgatgtcctgcgctggggttgccaggctccaagcaggcatgctaggtgcctttgtaaagcctcagggcactgtggccagggttctcattggccaagttatcatgtccctccgcaccaaccttcagagccaggagcatgttattgatggccctgcgcagggccaagttcaagttttctggccgccagaagatccacatctcaaagaagtggggcttccctacgttcaatgctgatgaatttgaacacatggtggctgaaaagcggctcatcccatgatggctgtggggtctagtacatccccagtcgtggccctctgatacaagtggcgggccctgcactcatgagggcttacaatgtacagcccccctcttaatactctcccataaattc

SEQ ID NO: 482772 - DNA, 127 bp, Homo sapiens
actaatacactgactggatacccagtctctgcttttagtctcctcaggagaaaacaaatcttgtagcatgaagagcctcacacatttctccaaggagacacgtcagcgctggatttagggctcccag

SEQ ID NO: 482773 - DNA, 110 bp, Homo sapiens
acgcaccacgcataacttagactatcagaagaaatattccagctgggcatggtggctcacgcctgtaatcccagcactttgggaaggctagacgcaggcagatacaccta

SEQ ID NO: 482774 - DNA, 593 bp, Homo sapiens
  misc_feature (41)..(41): n is a, c, g, or t
  misc_feature (66)..(67): n is a, c, g, or t
  misc_feature (99)..(99): n is a, c, g, or t
  misc_feature (116)..(116): n is a, c, g, or t
  misc_feature (123)..(126): n is a, c, g, or t
  misc_feature (128)..(128): n is a, c, g, or t
  misc_feature (133)..(133): n is a, c, g, or t
  misc_feature (135)..(135): n is a, c, g, or t
  misc_feature (138)..(138): n is a, c, g, or t
  misc_feature (176)..(176): n is a, c, g, or t
  misc_feature (190)..(190): n is a, c, g, or t
  misc_feature (203)..(203): n is a, c, g, or t
  misc_feature (241)..(241): n is a, c, g, or t
  misc_feature (252)..(253): n is a, c, g, or t
  misc_feature (255)..(255): n is a, c, g, or t
  misc_feature (261)..(261): n is a, c, g, or t
  misc_feature (263)..(263): n is a, c, g, or t
  misc_feature (281)..(281): n is a, c, g, or t
  misc_feature (286)..(286): n is a, c, g, or t
  misc_feature (301)..(302): n is a, c, g, or t
  misc_feature (305)..(305): n is a, c, g, or t
  misc_feature (317)..(320): n is a, c, g, or t
  misc_feature (322)..(322): n is a, c, g, or t
  misc_feature (349)..(351): n is a, c, g, or t
  misc_feature (369)..(369): n is a, c, g, or t
  misc_feature (373)..(374): n is a, c, g, or t
  misc_feature (381)..(381): n is a, c, g, or t
  misc_feature (384)..(386): n is a, c, g, or t
  misc_feature (399)..(399): n is a, c, g, or t
  misc_feature (405)..(406): n is a, c, g, or t
  misc_feature (414)..(414): n is a, c, g, or t
  misc_feature (417)..(417): n is a, c, g, or t
  misc_feature (420)..(420): n is a, c, g, or t
  misc_feature (422)..(422): n is a, c, g, or t
  misc_feature (424)..(425): n is a, c, g, or t
  misc_feature (438)..(439): n is a, c, g, or t
  misc_feature (443)..(443): n is a, c, g, or t
  misc_feature (453)..(453): n is a, c, g, or t
  misc_feature (455)..(455): n is a, c, g, or t
  misc_feature (479)..(479): n is a, c, g, or t
  misc_feature (488)..(488): n is a, c, g, or t
  misc_feature (490)..(491): n is a, c, g, or t
  misc_feature (499)..(499): n is a, c, g, or t
  misc_feature (508)..(508): n is a, c, g, or t
  misc_feature (521)..(522): n is a, c, g, or t
  misc_feature (528)..(528): n is a, c, g, or t
  misc_feature (570)..(570): n is a, c, g, or t
  misc_feature (574)..(574): n is a, c, g, or t
  misc_feature (583)..(583): n is a, c, g, or t
ccctagttaaattagcatgcctgacattaactctgggttgnaacctacctccgtcaaataacaagnngactctccaagcaaatgtctacacggcaattnaagcagcaactcaagancccagannnncnctggngncgnggccatcactccacttcccagtgcgacaaccacttttntgtaaacacctgtnagatgctaaaaanacggccttacacactaccgtcaccaaagtatataagcnataagatcagnnancggggncngctgcggcccctctgacngtccngggctggggcgctgnnggngggtctccgggnnnngncccctctgcccggtctcgggccgcgcnnngggggtgctgtggcctgntggnngggtggnacnnngccacctacgtgngttttnntgtttggnagnttntngnnttctgcagcttgnngggncccgtttttngntctttcttccactgggtgctgttnggtgggttntnnagcttgtnttcaaatgntagctatgttttnnggttgnttaggcccagctgcaccaccgggttatccaggatggcctganaganaggactgtnggggtcgatg

SEQ ID NO: 482775 - DNA, 282 bp, Homo sapiens
accatgttggccaggctgatcttgaactcctgacctcaggtgatccgcctgcctcagcctcccaaagtgctgggattacaggcgtgagccaccacacctggcctttattacctatttctaatgagtgcttagatattcctaccggtaatttttaaataaaaacattaatactgattatgtattgatcagttgtaactggatgaagaatgtccaagcgaagaaaaataaacacaaacttaggttaaaattgaagataggtctggcttcatgctctagtgagtg

SEQ ID NO: 482776 - DNA, 339 bp, Homo sapiens
agggtattgtgctttgaataaagtgagtgttctgttagcaaggaagtatgcttattacgaaggcaattagaaacatcagccatacgccttttaaaatataagaagattaagtaaactgtgttacgattatgtggtggaaatctgtgtagccattaagaataatgttcttgattaatatttaaggatatggaagcaagctccgtagactgaggggtgggtagcaagacccaaaaacacatataattgtcacagtttcctttaaaatatctatatgaagacagcactgattatggacaattttcgtcttcatactttctctgttttcaagatttttgacaa

SEQ ID NO: 482777 - DNA, 319 bp, Homo sapiens
  misc_feature (52)..(52): n is a, c, g, or t
gacggcaggcaagcttaggtggacggccacgtggcactagatacttcgtcgnagcgcgtacattccgcggtcgctgactgacacgatacctatggcgccagctgcaggcggccgccatatgcatcctaggcctattaatattccggagtatacgtagccggctaacgttaacaaccggtacctctagaactatagctagcatgcgcaaatttaaagcgctgatatcgatcgcgcgcagatctgtcatgatgatcattgcaattggatccatatatagggcccgggttataattacctcaggtcgacgtcccatggccat

SEQ ID NO: 482778 - DNA, 576 bp, Homo sapiens
tccgaagatttcgaacgacattctggctacaatatatttttctgactgcacaacgaatcccaaggtccaacttgtggtctaccttactcaagcttagcgagtgctgacctggtcacttgcaagctttactctacacaactgggactactgaaatgtgtccacattccctcttgcagctcttcttgactgcagacacacagcaacgcatactacgcacgaactctacaccttccacggaagcaccatacagcttgaacactgctgcgtcattctcccttctgcacacaggcacacgtctcatgacattataccctacacacctgcttctgggcacagctatcacatactgactgcagcacacctggacacaccaacacttatgcacgcagaccactttcagcctctgagaatgccagctggcgctcctgcacagcactgcgctcaagcctctgctcttgccctctagcacttcctgactgctcacccatagcaccaaccaccttaacaccctccatactgacaacacacacacactctaaacactaccgcctactctaccacacgctacaacacaac

SEQ ID NO: 482779 - DNA, 194 bp, Homo sapiens
  misc_feature (75)..(75): n is a, c, g, or t
  misc_feature (81)..(81): n is a, c, g, or t
cccatacatgtctgatgacaggatgtccctgcattggctgtatcaattaaacaatctgtccatgggcatacaggntatttnctagtttttttttcctcttagaaaataatactggcgatgactttcctggtagctcagactttttcacgtctgtggttatctcttggggaatgctgaatacatacatttcgaga

SEQ ID NO: 482780 - DNA, 120 bp, Homo sapiens
gaccagaacagcgcccctgcatcccaggcccaggagaggcgagccagcagctgctgcagctaaacgggtcaggttactcagttgtcaccaacgtgtccagtacgtaccacccatcgtatc

SEQ ID NO: 482781 - DNA, 244 bp, Homo sapiens
  misc_feature (45)..(46): n is a, c, g, or t
gggggggggggaaaaaaaaaaaggggggcccctccggggggggtnnatttttttcccccccggggccccacccggcggggcttttggggcgggggccgggggccaaaaggggttccccccggccccccccaagggggcccccggggggtttaaaggaaaattttttaggggccaaaagccaatttgccaagggcccccttcccggtaaataattttgggggaaaaaaaggggggggttttttta

SEQ ID NO: 482782 - DNA, 358 bp, Homo sapiens
agacacagtgctgtcgcactggttcccttcagccatggttgacgcaaggaaagacccgacagacctctgtgtaggccagaaaggccagcccttcaaccgttggtgttagattaagcgtgtaatgaatccatgatggaagccccttgataagcctttgtgggctcaaagcccttacctccagcctgcttctgtctctaggagagtcccagaagttgaagtatgggtatgggggaccccagagttccttacagagaagggagttgcctctcaggacaggggaaaagtttgagtttccacagctcccccctttacagagaagttaatgcttctgcttaagcacctccaaagagagagagag

SEQ ID NO: 482783 - DNA, 149 bp, Homo sapiens
tttagatatttgcaaatacaactttattctgattctaaacgaaaaggaatgtggcagtttaacttcattttttggacctgcatatttatgttttggaacttcgagtttgcgatatatcaagactgctgcagctcacatcataatattca

SEQ ID NO: 482784 - DNA, 92 bp, Homo sapiens
gcccggcggccatcttgagccccgccttttacttcggcccgcttcttctggtcactccgccaccgtagaatcgcctaccatttggtgcaagc

SEQ ID NO: 482785 - DNA, 432 bp, Homo sapiens
  misc_feature (231)..(231): n is a, c, g, or t
  misc_feature (233)..(233): n is a, c, g, or t
  misc_feature (249)..(250): n is a, c, g, or t
  misc_feature (368)..(368): n is a, c, g, or t
  misc_feature (423)..(423): n is a, c, g, or t
agtcggggatcgcggcggccggtctctcgttctcatcgcagacacttctactgcaaacatggtcaacgtaccaaaaacccgaagactttctgtaagaaatgtggcaagcatcagcctcacaaagtgacccagtataagaagggcaaggattccctgtatcgcccaaggaaagcggcgctacggatcgcaagcagagtggctacggtgggcagacaaagccaatctttcgananaaggccaaaaccacanngaagattgtgctcaggcttgagtgtgttgagcccaactgcagagtccaaggaggatgctggccattaagaggtgcaagcattttgaactgggaggcgacaaagaagaggaagggccangtgatccagttctaaaacttggtgttctctgaagaggaaaaatactgaagcagtngagaaatta

SEQ ID NO: 482786 - DNA, 157 bp, Homo sapiens; identical to SEQ ID NO: 480870

SEQ ID NO: 482787 - DNA, 200 bp, Homo sapiens
aggtcgcatctacaggcatccccctcaaggaatcccaaagaattccagcccaacaacaaaaatcccgctgagtggcaaacattgtctggcatctctcaacatgcacctcaaacaacgccaactgcgttttactatgctaccttattggaccactccacttccttcattgcgccctttaacaaacacaatatccaaggttg

SEQ ID NO: 482788 - DNA, 469 bp, Homo sapiens
ggcatcagggcgtagatggtagggcgatgggtccagaaggattcctatgtgggcgaccgaggccgagagccagagaggcatcctcagcctgaagtaccccatcgagcacggcatcgtcaccaactgggacgacatggagaaaatctggcaccacaccttctacaaagagctgcgtgtggcatcccgaggagacaccccgtgactgctgaccgagggcccccactgaatcccgaaggacaaacgcagagaagatgagccagatcatgtgttgagacacttcaacatccccaggcatgtacgttgctatccaggctgtgcctatccctgtacgcctctggacgtaccacgtggcatcgtgatggacatccggtgacggggtcacccaaactgtgcccatctacgaggggtatgccctacccccatgccatcctgagatctggacctggctgtgcgggaccttgactgacta

SEQ ID NO: 482789 - DNA, 950 bp, Homo sapiens
taccaagacttttacattgacctcctcaggtcagagagagaagctttgtggaaaagatgaagaaaacggggaggaagatcatctggtgttctacggctcccagactgtgggactgcagaggagtttgccaaccgcctgtacaaggacagcccacctgctacgtgtgatgccgaggcatgtcagcggaccctgagtgagtatgacctggacctgacctgagcaggccatgccagagatctgacaacagccctggtggttatacttgcatgtgccacctacgtgtgagtggaggaccccacaccgacaagtgccacaggacattctacgaacttgtgctgcatgtgatgacatgacagtggatctctctgtgttgtcaatgttcgctggatgtatatggtccttgtgggaacaatgacctaactgaggcacttcaatgccatggtgcaatgtacgtggacacatgccggcatggcagacaaggctcggcagcccacgagcatctttgagctggggataagggcagacagacgattgtggaacttggagatgagtgacttcatcacctggcctgagagcagtccatgagccgcgccgtgatgtagaaacacctatggaggcgttggaagccactggcgcaggacggtaccagacaatacagccagaacgacagcttgatggaccaccaacgacagatagaatgcagggccaacggcggaacatgaggggagcactgggccggcgagcgcgccactacgaacgaaccagagaaccaccccaaaagatagccaagaaacccgacccctgaactgcaacacaccaccaacagggaacgaaacacaggaacccagcagccacacagtacactgaagtgaaacacggaaaccacaaagcggaaaaatgcagccgcccgcgcgcccacgcgaagagagcagacacaaacaagggaaccc

SEQ ID NO: 482790 - DNA, 345 bp, Homo sapiens
ctccatggcacttcacaccacccactgttgaggtaaatccgactcatcattttcttatatctccccagcggggaaatgaaaaaaatcactggccattccccagttctgttcggccattttaaggagctccaagctccttgtaatatgaccgacggcctccaaaaagaaaaacagtttttgaaaaggtgatttatttccaaaattgctttttcttattgatcactcctctttatttgagaaactgccggccctaacttattcactcctccttacagaatgagccctgactcgaaataaaacccctacaattagccctctgtccatggccatggagtaaatggcagg

SEQ ID NO: 482791 - DNA, 261 bp, Homo sapiens
agagcatcataagggttgtactaccatcacagacggatacgattacacagagcatcacgcaacttgacacgatagacagtgcaatcgcccacgtaaactgactgcttgatgtagatattccactgtctgtgggactaatttacacaaggacgaatcccagccagttacatgcggtttaatttctgtgggacccagccataacgcacctctgtcctccattcaggtgcacttgatccacggtccaccagatcatcttagggc

SEQ ID NO: 482792 - DNA, 123 bp, Homo sapiens
  misc_feature (69)..(69): n is a, c, g, or t
gaaatgtattactgtataaagcaaagctgtaatatactaaacattttttagcagagtaatatttatttngcatagtctatttattgtattcgtatcacactgttattacatactgggatgaat

SEQ ID NO: 482793 - DNA, 959 bp, Homo sapiens
ggatcatacgtgtcactctcggggatgttttcctctctgggttactctgctctggcaagatacattacccaattgggcactctcattacactcggggccccccgtttgcaacagcgagttgccaagttctttttgagaaggcgggggcatactttacggttggagggctctataattctgggatatatggcgggccctcccccctgtcttttatgccgccccccgttccgtcgaacgcatgaagatccgtcgggtgcagtgcctaccttcatgcattgtccttcctagatgggcaggcacgctcctcctcggggataggtggtatcacccccccccaaggcttttccctctggaggataatttggtcccccaggggctctttcctttatccttgcgtgttcgagaaaggcttgccccaaaagtaacatcacgctcggggtaacaatttggccaaggtccgcctgtgtacaacaggaagaagtcgcaagcgcccttctgcgcgaggtgaaaataagatatcagtggcaagatgccttatataattcaggattaagcatgacaggcgaagcaagaacacacaaggagctgtacctcctgacggaacacactcatcgcttaggtgcagtgttgacgagaaatacaagcgccaagtaggacgccctattgtaatagggtcgcgacttcgctccccaagatggtgatgctccaagaaactccaccaccatttcatgggataagtttcaatcccgacaagagtagttgctgaagagtatgatgcaagcctacattgactcttcctcggaaatttatgtatagcaaactaggaggaatgagtctttctgtagttctatccgcaaacagctgggcgagcatcatgctattacgatgaagaaacagttcattttctgtacaatagaaggtgttttaagaaaaaaccagtaaaaaaacacaaataacaa

SEQ ID NO: 482794 - DNA, 881 bp, Homo sapiens
gcagcattgccccccccacgtttcagcacagtgctggccgcagtctgactggacaagggacggagcctatgatggcggcggccgacggcgacgactcgctgtaccccatcgcggtgctcatagacgaatctccgcaatgaggacggttcagcttcgcctcaaacagcagtcaaggaagctgtccatccatcgccttggcccttggcggttgaatatggatcgccgacagtgagcattctgcgcgtttgccttacagtagtaccatctatgatgaagatgaggtcctcctggccctggcagaacagttgggaaccttcactaccctggtgggaggcccagagtacgtgcactgcctgctgccaccgctggagctcgcgtggaccacagtggcacggagacacgtgtgtgcgaggagcaaggcagtggtaggtccttatcgggccatcatcactagctgagtcactcgtgcctctgacctggtaggcgcactttagtggcctgctagtgaagcggctggcgggcggcgactggttcgcctcccgtctcctcggcctgcggactctttctccgtctgctgtccccgagtgttccagtgctgtgagggctggatgtttcgaacatgtacttccggatacctgtgctcagatgacacccgccatggtgcggcgggccgcagtctccaagctgggggagtttgccgaggtgctggagctggacaaggtccagagtgagatcatccccatgttctccaactgggctctgacgagcccggactcggtgcggtgctggcggtggaggcgtgcgtttaactcgcgccagttctgccccaggaggatctggaggcctggtgatgcccactcttggcccgggcgtggaagacc

SEQ ID NO: 482795 - DNA, 569 bp, Homo sapiens
atttatgttaattgactgcccaaattcagttgtaagcagcttcctcagtctctgaagggcccacattctgtgactggcagctagggcactcagctgtgcacaagctgccagcgaggccgcaaggcgagggacgatgcttctgttagaggcaaggttgagtcggaagtctaacagacacgtcaccaagtcccatggatggacaggagaggacgcagcggtcagagaggagttctttagggccagcagctggcatgatgggatagacggtgaagcgccagccccagccattcacagacccatcgctgatgaacttccactttaactcatcccctgggatgcgcagctcgctggaccagtcggaccactctcggcctgaccgcacggagacgatcctgttgacgccgtccatgactgtgagagggtcgtggcgcctctctgtggagcactgccggtcaaattctaccctgagtccttctgcacctggtatcttcactgtgccactggtggaggtgtcgtcggtgtaagggtggctactctccaccaccacaggctgagaagagaggcggccg

SEQ ID NO: 482796 - DNA, 360 bp, Homo sapiens
ctatagatcactgtcagaaagtggtaacatagtcactacatacgtatgcattaggtctctcatgagattcgatgtattacatgggtaagtcgtatagaacatattaatacaagatgaggcataagactccaggtaagacatctcggctctacctgctgactctggggtgtggacattaggctgtagactgtgaggtggctatctacctgtggagtgcagcgcgtcctggcccttggattgaggagaacaaggtcaactatactcacctcactagtatctggctacggtgaccttggacaagtttaacttttctctctcctagtcttagtcttcttgtctgtaagtgacagcaatgatgct

SEQ ID NO: 482797 - DNA, 331 bp, Homo sapiens
ccccacccctccagtagcctgcattttgagcttaagagtgttgtttgcagccgggagcggtggcttacacctgtaatcccagtactttgggagaccgagttgggtggattacttgaggtcatgagttcgagactagcctggccaacatgatgaaaccccctctctattcaaaatacgaaaattagcccggcgtggtggcgcatgcctgccgtcccagctgctagggaggctgaggcaggagaatagcttgaacctgggaggcagaggttgcagtgagctgagatcgcgccactgcactccagcctgggcgagagggagagactccgtctca

SEQ ID NO: 482798 - DNA, 526 bp, Homo sapiens
ccgggcctcaacaattttcttcttaataatttttgttgagttgttaaaaacaaaagatatacacatgggtaacagaagctgtccagaaatgcaagtcagtgatggatcaatatcaggacagcatcactcagaggaacatcaggggatacactgagggcttccagaatttgccacaggttaggtctagacttgggtcatgatgactagagcatctgcctgattatcatgaagctaaacatttactttgtgtgactttctatatcatgatttattgtgcaaaagtagtttgttagaaaaggggagaaaagtgattctaaagcaattctgtaacttctttttataaaatggagatggttgtttctactgaagcaattacagaatcacatcattctgaaggtgggaaaggctgcagctacacgctgggccagcccctgcacctggtatcttcactgtgccactggtggaggtgtcgtcggtgtaagggtggctactctccaccaccacaggctgagaagagaggcggccg

SEQ ID NO: 482799 - DNA, 196 bp, Homo sapiens
acctagatccatatctgacggactaactcatagaacagcacccacatgtaattacatattatcttcagaatagttagaggcaccacgtttaagatttcttcattttctcctctcagtataggcagcaattcaccattttctttcagttccttcacaatatccaatcctcccaccagctcccctttcacatatggcg

SEQ ID NO: 482800 - DNA, 344 bp, Homo sapiens
gtgactctcagaggatcccgaaatggaacgaacagcacagaaaatgagtttcacgaactaacagaagtagccttcagaaggtgaataataacaaacaactccgagctaaaggagcatgttctaacaaatgctaggaagataagaacctagaaaaaaggttagtcgaattgctaattagaataaccaatgtagagaggaacataaatgacctgatggagctaaaaaacagcatgagaactttgtgaagaatactcaagtatcaatagccaaatcaatcaagcggaagaaaggatatcagtgattgaagatcaacttaatgaaataaagagagtgttcgttccatt

SEQ ID NO: 482801 - DNA, 158 bp, Homo sapiens
gtggtgcactaccacacccagctaattttggattctcgtggagatgaggtctcagtatgttcccaggctagggtgaactcctgagctcaagaaatcctccggcctgagtctctgaaagtgctgggattacaggcgtgagccaccacacatggcctatg

SEQ ID NO: 482802 - DNA, 744 bp, Homo sapiens
tgtgccgcccgagtccaggctggtcggacctttcccagggtaattgtgcgaccatttactctgaagggaccccccagttgatcgtgaaggcgccccccgaggaacccctgcgggagggttcttccgatccacctccgatgtgaggaactcccgccttctttggaatagatgtattaattatagaggtctcccgggttgcaccaaatggtggggtcaccagaaaggaactggctcacccgttcggactagtttgtagtccatgtcaccagcaccatgatccagggtgtttaccactgggcttcccgttcaccaagatgaggtctgtgtatgctccacattcccccatccaaccgttgttatcccggagaatgggtctcttgttgaaatccgaaattttcttggggtgaaaaatacactccccacgggttcggatgagaccccggtggttgcttggtccaacgtgattctccagccccgagaagatgatattaatccctctgaaggaaatgacccttggagcttgtttccaattcccgcggctttgattcagccagcccccaaccgtttaaaacccaggatatccggaaatttttggatggtatctatgtctctgaaaaaggaactgttcagcccggctgatgaataagatctaagagttaccccggctaccgaaagaagatccccgatgacccttaagacctaccttgtgatatttaaatgatcccattaaagacctatttgatt

SEQ ID NO: 482803 - DNA, 340 bp, Homo sapiens
tacagtggaccacgaggaacggattctggcaatggttcaggtcttgccaggagcatactgagaatcctaaagtctttgattcaggtccaatcccttacccatggcagaactcccttccagatgtgcatttttccagattcttctgagcatttccagggctgaggaagccacagctttgtgaggcagcctgttccactgttctgtagccccagttgttagaaagtcctccttccagcaggccagaatctaccctcctgtagttacaccctgcagtcccatctctgtctcccagggtcattggggaactactctcttccttcccctgcagggcagctctccc

SEQ ID NO: 482804 - DNA, 393 bp, Homo sapiens
ctcgcgctgagatattcacaaagtagtgcacccatccttagtgtgttattccagaacactatcatcatggccatagtaaatatggggcctagtccgcacctctccatgcctaccttccctttccccagtccctggcaaccattaatctattttctgtctctatggatttgccaattctggacatttcatattaaggaaattacacaatatgtagccttttgtgtctgtctctttcacttagcataatgcttccaaggttcatccacgcagtagtatgcatcaatatttcattactttttatggctaaatacatctgcaaaattttgcttatccattcattactttatggacatttgaattgtttccacttatagacctttatgaataacatca

SEQ ID NO: 482805 - DNA, 187 bp, Homo sapiens
agtgacctgaggatgatacccagatcatgtttgagaccttcaacaccccagccatgtactttgctatgcaggctgtgttatccctgtacgcctctgggcgtaccacatggcagtcgtgataggactccgtgtgacggggttcaccaagatctgtgaccattctacgaggggggtggactcgtctaga

SEQ ID NO: 482806 - DNA, 1614 bp, Homo sapiens
  misc_feature (412)..(412): n is a, c, g, or t
  misc_feature (727)..(727): n is a, c, g, or t
  misc_feature (951)..(951): n is a, c, g, or t
  misc_feature (974)..(974): n is a, c, g, or t
  misc_feature (1004)..(1004): n is a, c, g, or t
  misc_feature (1164)..(1164): n is a, c, g, or t
  misc_feature (1267)..(1267): n is a, c, g, or t
gggcagcaccaccacacagtcacccctccctccctctttcccatccctccacctctcacgtggccctgtccccagccacctaagaacccggtctgcgcactaagctcccgcagattcttgcacgtggtgccgtgcttatcactgtagtggcaactgaagcgtggatcatgatgtagagctcgtgcgagatgtgcactagggagagatgggcatgatggtagcgtgcagtgttgagctgtgcaccttgtcagcccctgaacacgggaagcgatgtacgaactctccacgagttgtcaagatgggttgatcatctttgatcgatcattgccatacggcacctcgttttacatcgagaaacgtctcgagtcaagttcgcccagtgggtgagagcgtctagggggatagatgcgcntgggcgagcctggcggagcgccagtctggcgcttcgcgtcctcgaattgtaataccaagaggtcgaatgccttttgccaccctccgaattcttgagggcctctcgattggggcgcctaacggaaggacgacctcgtcgtgcagcgttcattgcgacatggttagggggcacgatcggtccatttcggtccgccgttagcgggaccccaagtcatcgattgcgcgaccgtaaaggggaacaccaccgttctttgctcgcgattggggccctatggtcggcggtgagacgatactctgtactgtttcggctcctttnctgagttgcgccggtcatagggccgatcctttcggagaaaagctccccaagttcgcttaggaatacgatccgaaactggcgaattggcagcacaacggggtagcggagcacatggcgccggtgcgcgcgcattacacatattggacggcgggatgatcaggagaatactcgaggtgcaacacgctcgtgccagaagctgtccatttcgggcgaccacttggggncacgacccccgcacagaagatgngggattggagataatgcgccgagtgcgacngtggaggcgcacctgtggagctttaccactgccctttatctgcgcaccaccccagagtcttgtcgccgaattgctccatccacttaggcgctcgctgtgggcgaccaacacttgtccctgagagccaatcatggccggcggacgattcccccaaagggcnggagacgctccacgcgtgtcaggcaccacaggaatgcgctatacacaccaaggggacaacacagatcacagttcacatatagcataatcgctggagtacggtnttttcaaaacctgtaggacccgtaacaccaccacatcagagtcaccaccctggcgcgacacacacacactcgacccaccaccacacacataccgtaacagacacgcgccatctagcaccaagagccgcccagtgaagacgctgatcaagttcattaatgccgcattgtgtgcgatatccaggctaaccacacattttccgcctatgatgcgtctgatacactaggagacgacgacagacacgaatggagggcgcgactgaacacagagctacacactatacgtcgaccgcttccgttttgatcacctccccgcactacgcctatagcaacaccttggtgctcagcca

SEQ ID NO: 482807 - DNA, 547 bp, Homo sapiens
aaggatcctataggtcgatcactgtactccagcctgggctacagaagtagacctcatctcaaaaaaaaaaaatgttgaaatggcctggcacaatggttcacacctgtaatcccagccctcaggatgccaaggcaagaggatcacttgagcccaggagtttgagaccagcctgggaaagatggtgagactgtgtctctacaaaatgttttttaaaaattggctgggtgcagtggtgcacaccctgtggtcccagctgctggggaggctgaggcgggaggattgcttgagcctaggttgtggtcccagctgctggggaggctgaggcgggaggattgcttgagcctaggaggttgaggctgcagtgaatcatgttctcagcactgcactccagtctgggcaacacagtgagaccctgtctcaaaaaaaaaaaagagggaaaaaaagagggagggagggaaaaaaaagaattaaagaaagaaagagaaagacagcgaaagagaagagagggagagacaaaaacaaaagacaaaggaaaaagaaagaaaag

SEQ ID NO: 482808 - DNA, 129 bp, Homo sapiens
gtgtattgtgaccagacccggggagctggccatgtagaaagagagagacctcatctttcatgctggcaagtgaaatatgtacggaacatgcacttgccctaataaaaaatcagtgaaagggtctctggt

SEQ ID NO: 482809 - DNA, 164 bp, Homo sapiens
gtattgatgagactggtgcagtataacgttacaggggtactcgaaccccaaaatcctatccagatccaacacgtttcagagttggcttcccagcaatgccaaaaaatggaaataaatttttgagtgtattgttcttatttttgtcgatcagtgattaatttatt

SEQ ID NO: 482810 - DNA, 676 bp, Homo sapiens
ccaggttcaagcagttctcctgcctcagcctcctgagtggctgggactataggtgcccaccaccacacccagctgattttgtatttttagtagagatggggtttcaccatgttgcccaggctggtcttgaactccttacctcgtgatctaccagcctcagcctcccaaagtgctgggatttcaggcgtgagccaccgtgcccagccccaggctagtttttaaaataaaattttagaaatgaggtattgctgtgttgcccaggctggtctggaactctaccacttgaaaatttttagcataaagcaattacattctcactcagaagctattgtctttaacgctaacactttcaacatggtacgtacgattcactcactttacaacgcttaacaccaaaaaacctaaaacaccggctgcttcaactagcatcagcacagctctcacggtacgcactctcttctctacacaacggtgacttcttacatataacaaaaactgctttgtaccttcatcaagcatagctttttctacttatcactacttaatgtatttcaacatgcagctatcactgtgcaaaattaacagggctgtgagaattcggaaagtcaatgttgttttcttgtcagcaaagccaaaataatgtagtcatagtttctgaaataaataacttacattt

SEQ ID NO: 482811 - DNA, 216 bp, Homo sapiens
cgagctggatgatcggtgctgtgcccaaatccatcaaccgttccgtgatcgtcgggctgatgatcagcactaagagcgtggtccgagacatgcggggggatatcacccacacctacaaatacccagagcgggcctcagaggagagggaggccttcacaagggcgaaccacctgaacaaactgtccgagaaggaggagacaggtatgagcatgcgga

SEQ ID NO: 482812 - DNA, 126 bp, Homo sapiens
tgggctgtgtgcggtatggggtgaacctccatgcagtctttaagtgactccatcattcaatctgaagttttgaattttaattccatcatccgacatcttaatccttttagtcacgacagcgcaaaa

SEQ ID NO: 482813 - DNA, 305 bp, Homo sapiens
tccgacgtgctactggttcttgttgagcgccaagctgttccttaagtctttgttctttacttctcccattatggagcctgaagttatttgaacggatccttggagactcttttgtgattgcatgcttggagtaacattcctcgtaacttgtccctgtctccttagaactacaacagacttctgtgattctcccaaggattcataagtcttcatagactgatgacggtggaccgtgacctcagtcgcctgacccatatggtcactctgatagccacgctcgcgagggtaccgatgctcgacattcg

SEQ ID NO: 482814 - DNA, 81 bp, Homo sapiens
agcggagtccactgctgggcctggaacacggagcagtggctgccctgcgaggaggtcctagagcagctccagcaggatggc

SEQ ID NO: 482815 - DNA, 472 bp, Homo sapiens
ccggcaggcacttagaactcttcccttcaatgatgatgtcttgagagctgagattgtgtcttttttgtttgtttttttgagacggagtctcacactgccctcctgggctgggtgcaatggcgtgatctcggctcactgcagcctccgcctcccgggttcaggcgattctcctgcctccgcctccctagtagctgggactacaggcacatgccaccatgcccggctaattttttgtatttttagtagagacgtgttagccaggatggtctcgaccttgacttcgtgatctgccagcactttgggaggccgaggcaggcggatcatgaggtcaggagatcgagaccatcctggctaacacggtgaaaccccgtctctactgaaaaatgcaaaaaattagccgggcgtggtggcgggcgcctgtagtcccagctactcgggaggctgagtcaggagagtggcgtgaacccgggag

SEQ ID NO: 482816 - DNA, 348 bp, Homo sapiens
atggtgttgatgtaggacccgtatgagtgtggaatccagtacatcgaattaagtgttgatactacagcgacccagtcattgtgaatgtgctctagggcgcaaccgagctcgacattgccccctcatacactcatatgaccgccgaggggtgacagtcaggcgtctacctgccatgcagcctctaacccccctgcacagtattcttggctgattgactgggacacagtccagcaacacacaccaagagctctttctctccaacatcactgacgacagaacagcggactctatacctgccacggccaaataactctgccattgggccagctggggggtaacccgagctcg

SEQ ID NO: 482817 - DNA, 243 bp, Homo sapiens
cgtttttaggtcggcgcagccatacatctctgtccgtgtgagacccggctcgccttggttgtatgtagccgcgctggttccgccgtctctctcggtaagtctgtgtgttggtcttggcgatctgtgtctcccggtcccaatactccggcccctcctgctctatccatggcgcccgggtctccttcctcggactcgtggcgtcgctgtcgaccctcataacgaaccgggaatcctcttagagtc

SEQ ID NO: 482818 - DNA, 291 bp, Homo sapiens
ccagatcaaatggtaccagagtggtatgtgatgaatataatgcagtgaaaagtcatctatatgcaagaataattaaagacatggagagggccaggcgcggtggctcacgcctagtaattccagcacttagggaagccgaggcgggtggatcacgaggtcaagagatcgagaccttcctgggctgacatggtgaaaccccgtctctactaaaaatacaaacattagctgggcgtggtggcgggcgcctgtcgtcccagctacttcggaggctgaggcaggagaatcgctaga

SEQ ID NO: 482819 - DNA, 372 bp, Homo sapiens
cactaaggatgggcggacgcctggaccatgaatcacttcaagaagaccacctactgcgacttctgccatatcatgctcatcggcgtccgcatccacgcctgtgctgcacttactgtaaatactctgtccacgaacgctgtgtgtccagaacacattcctggttgtgtcaaaacgtagtctaaagccaaaaggagtggtgagtttcaccgcaaatgtgaattatcaacgttgtgtgacggttgggaactcagagaccacatcttactgtccacctccatattctcccatcacccgggtttgtgctcctgccccggcgagggctgtagcttctcccggttctggtttccgatctatgccgctttccgacgttca

SEQ ID NO: 482820 - DNA, 104 bp, Homo sapiens
cattgcatttcactatcaatgtggagacctgctgcctagggtgtggaggaactgctcagaggccacacttagggagcatccctgctgtggcagcatgcagatgc

SEQ ID NO: 482821 - DNA, 433 bp, Homo sapiens
cacatacacacacgtaggctatgaacttagaaatttttcctagagcctgtttctgtgtactgatgtcaacctggaagtgtagaattagaaagtgttcacatttcactattggcctgctggattcaagtatttgcatgtttgatatgtctttttttaacttttaaaaaatattttttgggataaaaaaatgacatgaaaaagtaatgaaacaagggtaatgtgcataggcggatccaggggaacagagagcagatcgcagccagcgccttccgcatcagtcccatcgcggagccctctgcgcccgacagtacacaccagactctaccctgataaccggccacctctaaaaaagaacataatcatcacaggcacataataaatagacttcaaaaatacaaccctcccccacagataaataaaccctttcacagcc

SEQ ID NO: 482822 - DNA, 424 bp, Homo sapiens
cgtcgacagggagagggggcccagaaccaaggcaagaagggagagggggcccagaaccaaggcaagaagggagagggggcccagaaccaaggcaagaagggagagggggcccaaaaccaaggcaagaagggagagggggcccagaaccaaggcaagaagggagaggggccccagaaccaggccaagaaaggagagggggcccagaaccagggcaagaaagaaaagggggcccagaaccagggcaagaaaggagagggggcccagaaccagggcaaaaaggcagagggggttcaaagtcagagcaagaaaggggaagggaccagagaataagaagcagctctgaatgaactaaagaggtgaacttattcagcagtaagtctgagaggctgaaaacattctaggcatagacaaaattggtcgacgc

SEQ ID NO: 482823 - DNA, 869 bp, Homo sapiens
  misc_feature (3)..(3): n is a, c, g, or t
  misc_feature (6)..(6): n is a, c, g, or t
  misc_feature (8)..(8): n is a, c, g, or t
  misc_feature (20)..(20): n is a, c, g, or t
  misc_feature (26)..(26): n is a, c, g, or t
  misc_feature (36)..(36): n is a, c, g, or t
  misc_feature (38)..(38): n is a, c, g, or t
  misc_feature (55)..(55): n is a, c, g, or t
  misc_feature (58)..(58): n is a, c, g, or t
  misc_feature (64)..(64): n is a, c, g, or t
  misc_feature (67)..(67): n is a, c, g, or t
  misc_feature (89)..(89): n is a, c, g, or t
  misc_feature (92)..(92): n is a, c, g, or t
  misc_feature (147)..(147): n is a, c, g, or t
  misc_feature (159)..(159): n is a, c, g, or t
  misc_feature (170)..(170): n is a, c, g, or t
  misc_feature (201)..(201): n is a, c, g, or t
  misc_feature (204)..(204): n is a, c, g, or t
  misc_feature (216)..(216): n is a, c, g, or t
  misc_feature (266)..(266): n is a, c, g, or t
  misc_feature (279)..(279): n is a, c, g, or t
  misc_feature (282)..(282): n is a, c, g, or t
  misc_feature (288)..(288): n is a, c, g, or t
  misc_feature (291)..(291): n is a, c, g, or t
  misc_feature (312)..(312): n is a, c, g, or t
  misc_feature (316)..(316): n is a, c, g, or t
  misc_feature (388)..(388): n is a, c, g, or t
  misc_feature (400)..(400): n is a, c, g, or t
  misc_feature (443)..(443): n is a, c, g, or t
  misc_feature (460)..(460): n is a, c, g, or t
  misc_feature (473)..(473): n is a, c, g, or t
  misc_feature (476)..(476): n is a, c, g, or t
  misc_feature (577)..(577): n is a, c, g, or t
  misc_feature (579)..(579): n is a, c, g, or t
  misc_feature (582)..(582): n is a, c, g, or t
  misc_feature (584)..(584): n is a, c, g, or t
  misc_feature (586)..(586): n is a, c, g, or t
  misc_feature (663)..(663): n is a, c, g, or t
  misc_feature (807)..(807): n is a, c, g, or t
  misc_feature (854)..(854): n is a, c, g, or t
tcncantnaacttttttaangggtcncaaaattctntnacaaatttttggtcaanttntttccnttnaaaaaaactaattttaaaaacnaanaacttaaaactgccacacgcaaaaaaaaaaaccaaaatggtccacaaaacattcncctttccttctnaaggttttacnatgcattgttatcattaaccagtcttttacnacnaaacttaaatgnccaattaaaacaaacagttctaaaaccgttcttccaccactgattaaaantggggtggcaggnatnaggganaanattcatttacccttcttaccnttcngggcaaacttggtgaccttgccagccccaacacccttcttgtccactgctttgatgacacccaccccaactntctgtctcaaancacgaacagcaaagcgacccaaaggtggatagtctgaaaagcnctcaacacacatgggcntcccaagaaccanatnaacaatggcagcatcaccaaacttcaaaaatttagggccatcttccaactttttaccaaaacggcgatcaatcttttccttcaactcagcaaacttgcatncnatntnanccgtgtggcaatccaatacaggggcatagcggctgcttatttggcctggatggttcaggataatcacctgagcagtnaagccagctgcttccattggtgggtcatttttgctgttaccagcaacgttgccacgacgaacatccttgacagacacattcttgacattgaagcccacattgtccccaggaagagcttcactcaaagcttcatgggtgcatttngacagattttacttccgttgtaacgttgactggagcaaaggtgaccnccataccgggtttga

SEQ ID NO: 482824 - DNA, 502 bp, Homo sapiens
ttagaggatcccgacgtgccctctgtgccttcagaatgctttggggtctctttctgcaaccttctgccatcagttttcatttgcatgaagtgggagaacagcgcaagcgcaactggccctgctctatgtcttctgatatcttcctgaagtgaatccaacagatagttccctaggcataactagacaaggacatacggacttaggagagaatggggatcagttcaggtttgaaagtatgtgtgtactgcttcatggtattttagaacttcaggaaatatatgtcaaattctgatttaataggttcattgagtgtttctttgacaaattctgcaaggtatgcttaagtttaacatttgagtgtatctggggttcacagtcagtaggtttctttttcttttagaacatggttaggtttaaatacaaaaagtagccgcgcatggtggcacaagcctgtagtcccagccactggggaggctgaagtgaacgaattgcttgaccccgg

SEQ ID NO: 482825 - DNA, 349 bp, Homo sapiens
gcaggatacaaggccgctctcacatggccaggcttgctcttgatgatgtgtatgttgtcggtgcaaaacatcgtcatctttgccatgtataacgtaggcctcacagtgtatgttcctatgcgcacatggagtccgatgggtgcggcacttgtcctgagggtgaccacaatgaggcctcagccataaaggtgtggcgcaggtcgtagtgcgcccggagcaagtgcgtgtcctgaaggagctgccagtaacacatgggagtctgagggtgagccagctggagggagtccaggtgcgacaagtgtagggcccggaggtgcatctgggtacgcctcgggggtggggactgcat

SEQ ID NO: 482826 - DNA, 109 bp, Homo sapiens
  misc_feature (1)..(1): n is a, c, g, or t
nctggcgagacgacttgctgtgtgaggaaaaggccgccgtgggaaagaaacctatagcctgagcaaggagagggctggatcgccacgcgccgagatggagaggtcttca

SEQ ID NO: 482827 - DNA, 114 bp, Homo sapiens
cacgagggggaacgggagcagtctacgaattgtcattcgggacaaggcaaagttctgaggtctcactgtgtttcatgaggatcccatcgagtccaaaatatccttcaggttaaa

SEQ ID NO: 482828 - DNA, 194 bp, Homo sapiens
ttgagctcggccccggcactgtttggactctgggcactgtttggactctgggcactgtttggactctgggcactgtttggactctgtgcactgtttggactctgggcactgtttgaactctgggcactgtttggactctgggcactgtttggactctgggcactgtttggactctgggcactgtttggactctg

SEQ ID NO: 482829 - DNA, 252 bp, Homo sapiens
  misc_feature (61)..(61): n is a, c, g, or t
aggtgaggcacagtgtggtgcagcgaacttggagtactgtccgtgtagaaaacggacatgncttatcagccaatactgggagtgctgtctccacaatttcagggcatctgaatgtttgctgtggttgtgtgtgtgtgtatgtatgtgtataatattgaagtggatcatgagatgtaaagacaacaataatggcaatgacttatattcaactctgtatatgtatctttatcactgtactctgctgaggacctt

SEQ ID NO: 482830 - DNA, 442 bp, Homo sapiens
agcggagtgggtgcggatctgtggtggagaaggtatctcattcctctctaacatcatctccactttgcatctgtctctcttagtctgctttttttccacagaatcattacgagcagggagcccgcaggactcatgaggaaaggactatagatcgaggtacatgtgtgcgtaaagggtcatgaaagacacagtatggcagtcatcgacaaacaaataagagtagaccaaatggacaatacaacgaggatcctggacagacgacaagcaagaaagaggcaaccccaaaagggtttacaacacgatcgaggaagaccaggacagcgggtgaccaaggaggagagagaatgaaccaagataccccggagacgacgcaccagaacatagagccatgggaacaaagtgacccgacgtgagatcgacccacgaggacactcgaagaacg

SEQ ID NO: 482831 - DNA, 187 bp, Homo sapiens
gttcattgttgagtggttcaaaataattccccccatgttattattgtgtacacctggggttgtggtccctgtaacatttggagtggtgtggcgacagggaggaaaagtcaccattgtccacatgtccctgtcactctgttcagagcagtgtgcagaatgtaatgctatttaaacttctaaaactagg

SEQ ID NO: 482832 - DNA, 399 bp, Homo sapiens
gtaacctttattatactcctatatctgtttagcgcgcttaatctcacgggtgtgggaagtcgagacgcacactcgatagagggtgattataggtttaaagaattgagcgaagagaatgtcatagccttggagcagaatggctgagctcactatcacaagcagtgtgcatgtgaagatcacgttccattagcgaatgaagtaactgacactgcaagaacatggcatgctgatgagacagctgaggaacgtgacaagagactttatacgactctatggagacattactatgcacagatgctactctgcgtgaaacctatggtgaaagggctgactgctaggcataacacgatccagagagatatgtgctgcttgcagcacgactgacagccatcctcttct

SEQ ID NO: 482833 - DNA, 124 bp, Homo sapiens
tgggtatttttaagtagagacggggtctcactgtgttagctgtattccttaccttgggtataatgttaatattgggcttgggtaatgagaaaataattattttaaaattttagaaaggatggag

SEQ ID NO: 482834 - DNA, 904 bp, Homo sapiens
gtcccaccaattctggaatgatcccaaactgagacgcaggggacctgagttctaggcctggctctgccgtggcttgctgaccttggcgaattggagaagcttgtgccctgtgcgacagtgggatgggggtacccgcttcatctagtatcggggagatcaacagaggtatgggatctgaagaggatggcagactgtgcagtgctggtgcactccggtcttcctaggttgttttctccctccttattctcctcccaggagtctaagcgtgtaagcatagacatgtttggatggagggctggtggcacgtccctagggttcatcccgacttgtatcagctcgttgtacactcatcctctttcttgacgtatcttgtttaggctcgtgcatgggacttgtgatttgccctctatcctctggaatactagcgttgagtctgctggccgtgcgttgtaaacacgcgtttcgccttaccgtgggtgtctgtgctgttgaggcccggtgatcgcccgggcctgacaggagtgccggtgggacgcgcggcggcctgagggtggggcaaattggtgggtccctcggtacttggccgcgttgcgaatgcattcggacgtgtactgtaggcccggtagtactgtcggtgccggctttcttactaatgccgattgcccctgggtttgctgagcccttgctggcgtagttcgggacggtgtattgtcgcgcccaagcgttaggcttaccatttggggcctaagcagcaggactgtcgcggccagctttaatcttctgcttctgcgtgacgctggtttccttggcgctgctgggtgggaacggcctcttttgtctgggtggtaccggtagggcccagtttccccgcgttgcgtcgacggccggccgttgccggctccgt

SEQ ID NO: 482835 - DNA, 979 bp, Homo sapiens
gctggcctttgagactgtcccactcgtctctcccacctggcctgtgggctctggcaccagcaccgtcctgggctccagcagcggaggggccctgaatttcactgtgggcgggtccaccagtttgaatggtcgatgcgagtggctgtcccggctgcatgagtcggcatggtgccgaaccaatacaaccctctgcgtggggagtgtggcgaccgaggtccccctgagcacaacaggccccctccctgcagcatggcatggtaggcccgctgcacagtagtcctagtctgccagcgccctggtcccaaatgatgatgctatcagggtctgcgccagcactcgccggctggccacaccatcctcatctggtgcagacccagacaggtgcgagcgcaacaaaacttacagatgcatcaagcagagacctgcagccagcaaatgattccagcagctagcaaagcctgcagccgtgaccatcacccagcacatggcgcaccttggcgtgagctcagcgagccagcggccacctgggccggagcattcctgagtggagagccagagccagggcagaggtgcagccactgggccccagcagcctggcggtgcagcacgtatttctgccccaggagagccgccgcctgccacgtcgctgacatcctcgtggtcccacccgtgacgcagcgcagtacctgacgcgcgccttcgtgtgacagtacttctcgctgttggatgacagtgccaatcaagtgctacagggggcttgatacactatggtacgcagccctgaatcccctgacagatggacaagatcggtccgaatctaaaagctccgagtggcagaagacttgaacaagactaaaacacgtagagacagaacacgcgagagggagggaacaaacagaaccgactagaaccgggtagtaccaacacgagaataggcctatagacaaaggacacaaacagtaaaacctttaaaaaagcg

SEQ ID NO: 482836 - DNA, 172 bp, Homo sapiens
gcattgctgttgacgtgcaggacacgcccaaatgcctgtgtcaccttcaacttacctgtgtcatgaacagccgagtaactgtggactgcagccgtctcggtccggtctccattccccacgaccacgatctctatccggggctccagcaaccagaagagggaaaagctgtctt

SEQ ID NO: 482837 - DNA, 316 bp, Homo sapiens
cgctgatcagcttagcatctgggctgggacaggaaggcgccctggtttgttttccccagttgtaatagatgccaagcaggcctgattctcgcgattatactcgactcacctcctgtgttgtgctgggagcaggactgattgacttacggaaaatgcctgtaaaatctgagtaagaaactatcatgctggcctgtgtgatcacaagcagtcagcatcattaacaggacacacgtggcaggcacttccatctgtgccatacttgttctagtcatttcgcaaatgcagctcaacttgatttgcttaatctctctgccgg

SEQ ID NO: 482838 - DNA, 158 bp, Homo sapiens
ctatgtatctacgcctagtaggcagccctttactacaagaccaactatgcaccaagaacaagggcccattactccacaatccataacagccaacccaggggtcagaggcccttcctgctatggttcagtcctttgctctccagcatctagatactttt

SEQ ID NO: 482839 - DNA, 87 bp, Homo sapiens
  misc_feature (61)..(61): n is a, c, g, or t
gatttgctggtgcagtacaactaggcttaatagggactaggcttaatagggacaagcttcntaacgttagaaggcttgaattcgagc

SEQ ID NO: 482840 - DNA, 879 bp, Homo sapiens
ccacgcgtcgcccacgcgtcgaaaaaaaaaaaaaagaaaaaaaaaaaaaaaaaaaaaaaaaaaggggggagcacacataaaagattacccccagggggcccacaaaataaacgcctcacccccacatatgaggggaaaacaaggggcccccaaagcggaccgcgcaattataacaacaacagacgagagacacccagcagacacaccgggataacacacggagaaaaaagtgggactcatctgtcggcgatccatatatcgggcacagacgaagctctcatatcccatctgtgctgagccgagtgtgcgacaatatttagtggaggacacaaacatcacccaagaggcatatatatatcaaaagcctttaaaaggagaagatattataccaaatgtataagtgcggctaatacacgggggggttcaacaaagctaagcgggcgacactagcaaacaggatagcggccacctttggcacacctgttgggccactaacaggaaaggacacggacactatcccagagcacaccacctctctcttatcaccaggagaagaaataaacagagcactaaagatatctgaataggtgagagagcgcgagcgagcgggaggggacaggggcaagtggaggtgaaggagaaaacaataggaggaatgacgaggacagcgacgacagcggggaggcaggcgaggacccgagtggtaagcgcagtaggggagggatgcagtaagcaagcaggaagggggccgcggagggggaggaggaagaagagcgacggaaacggagcaaaacagagcaaaaaggcgcgaagagaggaagtgcaccaaaaggtggaggcacaggcaggaggagagagggggaaagagagagagaaacc

SEQ ID NO: 482841 - DNA, 677 bp, Homo sapiens
  misc_feature (233)..(233): n is a, c, g, or t
  misc_feature (235)..(235): n is a, c, g, or t
taagactctggttcacgtcggcgtgggattatgcgcactgtattgtgtcacggtagtatcgactgctggtgtttcagcgccaccccgagcaacgctggcgtgaggtggcagacgtgctggaagagctgaccacgacctggtattttggcgcacgcctgattgtgctgtggctgttgtcccgcgttctggaaaacaactttttgctggcaattgcagggctggcaatccttgcngnccgcggtagtgtctttgctggcgaaagataagaagttacatcaccttacgtctaaacatccgtacgccgctgaccctgtcgtggccgttatcaccagtagcggccacaaactattccacacaatatccagactcgcatccttcaaataaatctgcttggtaatgtccgtaaagtggcgaatagggttaatccacgtcaggttttgcaccataccggcatgttttccaccggagaaacgtaaccggaaaggagaatggcgggcatcataaagacaaacacgccgataaacgcctgctgttgtgttgaacagagtgatgaaatcaacagaccgaatcccaccagcgataaaccataaatcaccatcgtaaagtagaacagcgccagcgatccggcgaaggggatttgatacgcccagataccaatcgccagcacaatggtggcc

SEQ ID NO: 482842 - DNA, 162 bp, Homo sapiens
  misc_feature (130)..(130): n is a, c, g, or t
  misc_feature (138)..(138): n is a, c, g, or t
gacaggccagcatgtgcacaaaccaacccttaaagttgaacaaatgatctatgaagtttgcctcatccaccatattcatctgacctgtggccaaccaactaccacttcttcaagcatctcaacaactttntggcagangaaaacacttctacagggtaccga

SEQ ID NO: 482843 - DNA, 743 bp, Homo sapiens
gccactttcagcctagcgtgaaagagatggagtgtgctattcccacttccctttatgtgtacccgtggaactgatggagcatgcccagggtcatcggcatgttacgtctcgtagacgagtctctctaggtcttcctgcaatggcagcgccgaggttgtatatttctatggtgcaggtatatgattgccatatgagtacaaaatcgtgaataatcatcccaagataagatacaagagacatagtacaagataggtagacgatggctcagataaactgtcttggcagagcgcacacagtttaccctaaaagaaaatcctaaattacatcttgcatgtgtacgagagatctgaaaactgcattcaagcatatatgggtgttcaaatcgtaggtgaccagggagattagggctttgctgaattgcgaagagagaagagcttagtgttctttggaaatgtgcttgtgcaggatagaaaagtgtggtcttaggttttcctgaataggttggattccgtggagaacctttgtggaggcttacgtccttacaggaatggtttaactgaacattttggtactactatgactttaaaaacagtgcctccatttagggaatgtagactgggaagcccaggggttaattagtaggacgtaaaggtaactttagaagatacgagagttacttcctttctctttttgttcaacattttggaaacggaaaaacttatgatttttgagtggaaaactaa

SEQ ID NO: 482844 - DNA, 1038 bp, Homo sapiens
gctccgaaagtggcagctagccagagagggagtcggtgtggacgcggatgagccgggcgcttagaacagagtgcttgcacaggtggagatgtggaagctcgtgtagctgggccatgatgatgtctgttatccgtgtgagacccagggtgtatgatttggtgacacacgatcctgactgttgtgacatgacactctctgaccaaggagcaactgatggggagccaagacgcatcgaggggtctggacgctacgagaacacatctaactatccaccagctgaggaacaagagtatcacgagtgagccatgatgttctcaggaagaatcgagatggcgtcagggcccgaatgcatccctatggctatgcgaggtcgtgctttcggcctagacacgcagaccgaatggacaaagaagctgacaggtagagtgccatagaggtatggttgcctgcacgtgtggctgaagctactctatctcaagacgagatgctggcccaatatggcttcgcgcgcgggcaaaggtacccgcgacgtccgacccaaggcgaccaccggggacactactcagcaggtccagacacacctcaggcctttcgactcaactacacagtgccagaacgttcgagagaaagccaacacgaaatttcgttcgcagaaacacattgaacatagtagtatccatcacgatggagcagtgaagactaggcgctcccgcgaataatccagcgggcataggagcaacaaaagaggcgaacgtaaaccatataggcatagggcaccataagactactgagtgcctttgtcgagtagatttacttgcaacgctgtcaacgccaattgacaacccgtaacaggagcaccgcagaaactacatggcacccaacataggaccgcaattccgccccaagagaagagacaaggtacacctggacaataggagcccccaaagctcggcagacaccttctgcggcagaatcacgtagcaccagcgtatgtacctccggcagacatatctgcggaagttcacccttgctggaccc

SEQ ID NO: 482845 - DNA, 653 bp, Homo sapiens
tccccaaacaaccgcagagggttcacaggggaaatttccgcccccagttgtaccctcggagggttcctggaccttgggtgttgggcatcgcgccaccctctctggcttgggtcccgccattgccgattgtcccgggtaaacctttatacaggggcgcggcgcgcctctccgtgtggacgcttcccaccgtgcttgtacccggctctcatatccgctgcaagggcaggagcgtgggcccccatgcgccccgggtttttggccccacctatacaggtctttggggcgaaaagaatagactgtggcgtctggagattacggctacacaaggcaaagagaccaggagatcgcaaggagatttctcgtggagacggcttgtgtaacaccttttttacacaactcttagactcttagtgtgagttttgtacaagggagacctcgggggggaggaataatactccttcttgtagaaccaagtctcccagggtatatactccttgcggaaaaaaaaatgtcccagggggccacgcctctcttgagatagatgtttggtggcggagacaatttggcgtctttgtccgggcgtccccagtgataacattccttcctcccagtgattagacttctcccttaatgggggacaaccttaaatttcg

SEQ ID NO: 482846 - DNA, 986 bp, Homo sapiens
gcaatacagcaagactgtctcaaaaaaaaaaaaaaaaaaaaaaaatttttgggccgcctgggccctggaaaaagttttttaaaccttccgttgggggcggggccccattgggttagttgaacttggcccattgttgttcccctaaggaatacccgggggtcatatggaactaagtggcttgggtttctcaaccaattaaaaaaaagcgccgggggggcaaaccggagctgttctggaacaatctccagatgggatgtcctggaggtctataacggggtatctaatcaaacgaggagtccaaggcggagctcgaattatcaaatattaacgcgccccggcccgtgggataattcgaaaggtgaaccatactatctgcgcatggaacgccattccacaaacgggcgattgattaaacacacttgaattccgaccaagcgggactttaagaccaccgtggttcgcctttggggcgatgttaatattcgcgcccagtgggttgaaacgggggggcaaaacaagttttgtccatattgggcccacgtttaaatactacaacgcggggtgtgacacctacaccacaggggaattgggttgaaaaaaaaaaacaactattctccaaaacacccctttgcgggaaataggccagaaggtttcaacccggaaacgcgccagcattttggcagacatattggtggtcaacccggccgaaaacgcagggggagtccaccaaaccgagaaaacggtccagaggcccgggaacgggggacagggggaaacattacatatccacaggcaccgtttattggcgcacgaagtccggatgagattccaaggggcacaagtggaatacgccggaacaagggatatacatgcgggctaaaggcgaacaacagacgtggtaagaaatgacaatgagacgccaagttaaccgggaataaggaagaggaaccaaacacgacgacgacgtaattaagtccgacaacggc

SEQ ID NO: 482847 - DNA, 135 bp, Homo sapiens
  misc_feature (24)..(24): n is a, c, g, or t
  misc_feature (48)..(48): n is a, c, g, or t
cctctactctacgtaccttaccgncccctacgtaccgggcgaccgcanacttacccaacacttctactgcacttttactttcttgctactggaccaccttctaccacacctgggggggactcctctacgacgtcg

SEQ ID NO: 482848 - DNA, 469 bp, Homo sapiens
  misc_feature (117)..(117): n is a, c, g, or t
  misc_feature (124)..(124): n is a, c, g, or t
  misc_feature (395)..(395): n is a, c, g, or t
  misc_feature (450)..(450): n is a, c, g, or t
taaaattgttttagaaataagaaagaatattgagatatgcatgaaactgtagttattctgagcttcaggatattactgtacaagtagtaagctaccaaaaataagtagtgaaattanacatggnaaatgagctctaggagtaacctgctgcaaaaccgtggctcacatgacctcactgtaggagttcttgactcagacctttaagctggtgatgagctgtttcacatgattgataatgcagaagctcctctctgaagtcacttttttttttttgttttttttttgggtgacagagtgagactccatctcaaaaaataataataaaataaattaaaattttaaaagataattccttctaaaagagaaggacttcactttagttgtgacttattacntgaaagaaaaatttgatatacttccagtggaggtgtgctgtaaatatatagaaantagcatatagaaaaaaaaa

SEQ ID NO: 482849 - DNA, 457 bp, Homo sapiens
gcggccctgattttatactaatcaatgggacacgtgcctatgtatatacttactaatacgtttaattccatattttagcaagaagtcacattacttttgagaaataaaactgtgtattatgtatacttccaatcatactttaatttcatacaactgaaactgtattagtatatttatcttcatttttcaataataaaaaagtatgtaaaataagaaattattctgataacccaataaatctgaattgggaaatataaggagaaaatactcatgcaatctatgcctatagctttctacttctcctattctaagatttatcaaagttcataaacataattgtttatctgtctctccagcttcaatgcaagctctaggaagataaggactaattgctattatatctccacagtccactggatgatgttcaaaactaattataaatgaatgaataaataaa

SEQ ID NO: 482850 - DNA, 1026 bp, Homo sapiens
cctgtgttgtgtattgaatacacccgtgcgtctcgagttgttgtttgtgctccctcaccgaccaaagaaattgtggtgtgccctctcaccatgttgatgtagtacgaccacgtacttagatttgtgtgaatagtggtgcggcgtcgttgtcacttcatgatgacgcgatctttgttcgaaccacaatgatgtagagaacacctgcggtggttgtacgtagaaatcaactcatcgccctcactgttgtgggttttctggttaaacatgaagccccacccaacacctctggggggtggattaacaacaaaacgtaggtgtgttctatcagtgaatgagattctccttaatatcttgtgtggaccttgttgtgggtatcacactcattcttccgcgtggtgtgattgttgtttttcttgttcgcccacacattgtagataaacatcgtgcgcccgcgcttgtatattttgttgtataccacttctgtgtggggtgtcatagagagattgttcgcctccccgttggtgcccaccttgttggggtcacacagccactgtgggtgaacagaagggagggctgctctttgttgtgtcgtcactccccacgtgggagagtgctccacagttgtgtggcgcgacttgtgtggcagccacgtctgtgtgttatcacacacacgcggggggtgtgtctgtgaataaagcagacgctctacactcacagaggtttttcagcggagaaatttatagcttgtcacactgtggagtgcctttcgagaatcgctggtcgactataaatggggcccccgccgttagagagcctctccatgacgcgccaccccctggtccgagaagagaacactggcctcgataagggtctgtcgcaacgaaagtgttttttctctataccactagtggttgctagctcaaccacaaaagttctccccccccccccccccgcgcgccttttttccatttttttccccccccaagtggggagaaacccccaaataaaaattttttgactctccta

SEQ ID NO: 482851 - DNA, 827 bp, Homo sapiens
tctttttccatctgtcatggtggatcttttctctcttttttcattcttttcgtggtacgtctgttttcttgtccttgttgtggttcgtttgtggtttgtctttttctattgcgtcttttcgttgctctcgtggttctttctttcttcttctgttttggcttttggttcttgtattgctgactttgtttgtttcgttgttgtttctttcgttgtctgtgttatggctttcttcagtagggagcttgggtcccgtatcgcgtgcggcgtgctcccatctgggccgcctaatcgggtcctgcagactcgtgttgtgtcgcccgtgttttcgcgtctttctcttgtcgttgtgtatggatcctgcgtgtgctagatattgagctgaaatgacgctctcgatcgaatgcgttgttttgagtcagtgtttcggttggggccccctcaaagggcatcctgggctacactgagcaccaggtggtctcactctgacttcttacagcgacacccactcctccaccttcgacgctgggggctggcattgccctcaacgaccactttgtcaagctcatttcctggtatgacaactggtatatttggtctcgaaggtggtggacctcatggcccagagggcctccaaggagtaagaccctggaccaccagccccagcaagagcacaagaggaagagagagaccctcactgctggggagtactgccacactcagtcccccaccacactgaatctcccctcctcacagtttccatgtagacccctttcaagaggggagggcttagggagccgcataagccagacatcataactggtcacttc

SEQ ID NO: 482852 - DNA, 399 bp, Homo sapiens
atatgcacggccataacacccgcattgattcaggctcctaatgtgaaggacaatgacctggtgttgggcctgagccatctcaacaactcctacaacttcagttttccacgttgtgatcgggactcacccggaggaaggccagtacagcctgaacttccacaactgcaacaattcagtgccaggaacaggagcctccattcgacgtcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttgccatatgcaa

SEQ ID NO: 482853 - DNA, 438 bp, Homo sapiens
tttactgccctccaagtgaggaattcatgtcaagataggactttctttcattctacctggaactgcaatgcttagtactatccctaacaacaaccatgggatgtatgcagttctcccaaatgcaatgcaaagcctttttatgtctcttccagttgtacgattgtcatagcacaagtgaatgctatgaccaaaatttatgccctcctaaataaagacgtttccttctagagagcatatctctcataacatgtcaaaactagaagagaataacaatgcaaggaaaaaacctagataaatatcctaaaatatcaaatgtagtcatttctaaatataagccataattatagctttacctatcgtacttattgttcctatgctgcttctacaatgttacatcaactatacttagctttactctcccaaaatcctggtaatgaa

SEQ ID NO: 482854 - DNA, 124 bp, Homo sapiens
cgggccgtcgttttacacgggccgtcgtttaacactgggccgtcgtttaacactgggccgtcgtttaacaactggccgtcgtttaacactgggccgacggtttaacactgggccgtcgtttaaa

SEQ ID NO: 482855 - DNA, 323 bp, Homo sapiens
ttttttttaagagacaggaacttgctctgttgcccaggctggagtgcagtggtgcaatcatggctcactgcagcctcgagctcctggcctcaattgatctcctctgggccccccaaaatgctgggattacctgcatgagccacttcaccccacccacctcgggcctgtggacatgggctgttcctccctctcccagctgctcctggggcatcctggcccccagcccagcgagctctgctcaggaaatgagcttcgcctgcgttctctctgctgttgggctctggctatatgtggagccctctcaccatgtatttcttgtcgac

SEQ ID NO: 482856 - DNA, 132 bp, Homo sapiens
  misc_feature (39)..(40): n is a, c, g, or t
ttgctcctggtggtctcctcccatgcaggagcatcaggnntgaagtgaagggcgtgtgcacagaagctggcatgtatgccctgcgagaacggcgagtcatgtcactcaggaggatccaccagagagaggcaa

SEQ ID NO: 482857 - DNA, 918 bp, Homo sapiens
agcggctcttttcctccttgagctgtctgaggatagatcgctcatcatgaacgacaccgtgattatccgcggtgacaaagttgatgatcaacccgacctacttcagattggaaacacatggtcgttgatgtccttcatgccgcgtggaaagccacagtgcctaacgacagaaatagcgggaaaaattagacccagaactgtacaataccacaccgcgatgtcatctgttgtattgtcggattcagaactcactatttggtggtggcaagacaagttggttttgtgcatgatttattgacttcccatggagtaaatgcactagatactctagtgaacctcggactagcatatgactttgccagatgacatgtgcctagtacttgacgaatgagctagaggacctcaagacaatgcaatcgaacgagtgagacgcggcactaaccatgagatgaaacgaaacgtcaagggtccaacctgtccgatggtccaaatagaattgcgtgcctggtcaacagcagagtgatgcagggaacgactagggaattcacagaccgacagagaagtaagagcgtagctgcgcatagcatgttggccttgtgcgccacatggggggattcgtgctgacaggaaagcgtttaactaaaacctaaattaaagatctatggagtacaaacggacgaacaacctgagttcagccccgaagagtaggtccggacagccggatacgaggggcagagaacagcctttggcataagtaggtgcgcccacggagtagccccatgtcgcttgagatgacttcgtcaagcatcgagagcggttgaactactgggcagttggaggcaaatacccagtgagtccaaacccggtaaccgttggttagtaacatgcggagtgagaggtcaaaaattccggataaca

SEQ ID NO: 482858 - DNA, 199 bp, Homo sapiens
tacagcggggtgagggtcattaggttaaatgggatggtaatgggcatgtgatcagattgtcagggaaggagtagaaatgtcccatatttgtgggttaaggtggggggatatgagaggaagacgcaaaggaggctttgggttggggagaagggcggcaatgagatgcggctgtagtccaggaatagtcaggaaagcagat

SEQ ID NO: 482859 - DNA, 173 bp, Homo sapiens
aaaaaaaaaaaaagccaaaagggtttttaaaaaaaagcaccccccccccctgggtttgtaaaaagtcagcttattttgggttcaatcgtttgatttttccaaaaaaaagtggaaaatgctgtatcaaggggggggttagctggccctttccaataaaaatgtgagaagcttca

SEQ ID NO: 482860 - DNA, 205 bp, Homo sapiens
gtatgcattagacatctgaacacccatagcttagaccaactgggattagataccccactatgcttagccctaaacctcaacagttaactgcaatctgattgcatttagacccctcaaaaaaaaaaaattgctacccattcctcccattaaaccctcggttagattgcggaaaaccccagcacggctgccctctcggttaactcac

SEQ ID NO: 482861 - DNA, 448 bp, Homo sapiens
tggacctccattactccatggccagtgatgatgagcatttttacatgtgttttttggctgcataaattcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttgttcacttgcttttataaaagctgtgacatgtgtcagtcttcccttttatagtattttgattttgagtcctgcttgggaaacttttccctacatagaggttaaaggggaattcattttttctgcacgtactttgattgttttatcttttttgtattgatagccatggagtaa

SEQ ID NO: 482862 - DNA, 301 bp, Homo sapiens
gatgtgccgcccgtgcccacgccgagcggagactgctgggaaaaagatcttgatgaagctctggaagcaggaagttgtgatcttgaaacgttgagaaatataattcaaggaagaccgctgtctgctgatctgagggccaaagattggaagattgctgttactgtggcaggacaaggcgatagttaggcatcatgggatgggaaattaagactttgccagaacagaccactattcacatagattgcctgcagtatatcgaccagctttgagagccagctgagaaggccccagaatcactgat

SEQ ID NO: 482863 - DNA, 783 bp, Homo sapiens
tctcccctcccccccttcaccattcccctcggaggcgcttccccgggaggggaagccggtctcaccccacagcaacacaccaggaaacaaagcaagaacaaatgcaaacaagagaagacgacacaaaaaaacacgagaacaagaaaagaagaagaaacaaccagcacaaacaaacacaagacacacaaaagagacaaaaaaacccacacgaacagaacaaaaaaaatactaacaactaacaaaaaaaaaaaagatatattaaacaaaaacatatcaaataaacaaatacaacaataccaactaatacaataataacataaagaaacgcacattaattataaacaaaatgagaacataatacaaaatatactagaatatcaacaatatataaaaacactaaaaaatcaaaaaacagaaaaaaacacacaaacgataaaacacaaagaaaagaaaaacaacaaaaaaaaaaaaaacacgactaaacaaacaaaacaacaacacacgcataacaccaatacataatatagcactcatagacataagcagaaaaagaagataaaaaatcatttatcaacgataacacaagagacagaaacacaatgaaagaccaaaccagtacggagattaaaaagagagaacgcaaaactcaaaccacaactaatagaatcacaccgcaacacaaaataattgaaaaaaacaaaagaagacaaaaaaccaacaacgtaaccctgacgaaaacaagcactaagaatggtaaacaaaagcaataaaaatagaaacacc

SEQ ID NO: 482864 - DNA, 347 bp, Homo sapiens
acgcaggcgagctctcgacctgtgtgagcagagacgcgctgtgccaccatgtgcataatattctttaagagtgagcctctccctgtgttcaccttcaaggtagctgacttctgggggaacaacaacgagatcctcaatgggctggacatggaggaaggcgagggaggaagcacatgggtgtgcattagaacacagtggaaggtgtgaggacttaccaacttcctgtgaacgcaactggactgtgaagcccgagaggccagcacagggggagacgtcatttgctactatgggaaccgaggggagcctgagcctatcggtttgacaccagagttgagcctgtgattact

SEQ ID NO: 482865 - DNA, 970 bp, Homo sapiens
gcgccaaggctctgggtgtcatggatgaggcttaagtcgggagggttccgaagagctggctaacgtgtgatatgtgcaccttccagattccggggccgccgtgtccaactggcgcccccaccgacgtgtagatggtgctatgatcctagctgcgaattactcaccccgtgctctgtccttcctgggggcctccttgccacatcatgagctgaggtgggaccacagtccccaggctgcatcggcctgactgtgtttccctcttagcgtgcatttatctttttgatttgtgtccgagtggcatgtaagtgcacaaatgataacaagaggattattctcccgttctcaagggagtcagatcaggggaactattctagggtatgttgcggggtattaagcaggagacactgtgtggtggggggcactgggcttgtttgcgggcgcagaaatgtcgcacgtcctgagcatatcatgctggagcaatgtgcacgagagtaggcagacgtacagcgtctcttgaaccagacccattctcccatgacctggatcttccagcccagggcatgagccctctcattctatacctgctccccattcccccaggtggggactgagttactgaggagaaggcgacctgtccggtggcgacacatgatactaatcaaaacgtcgggtaccacttggtctgagggccctacgttgacagttggtggcgcgccacgggggctgacctggcatcctagccttcctcctccatgttttggactccaactaaatgattactctacattgggcgcctggcagtatgtgtagcgttgcgatgggaaagtggacggggcaagctaaacccgcggttacccaggcctccgctagagaacgtgctgacggacgctggcgaggacactatctggcggactaagggaatacagaccttctaaagagaccagtgcaaggcgctttaaaaaccccaagc

SEQ ID NO: 482866 - DNA, 194 bp, Homo sapiens
  misc_feature (36)..(36): n is a, c, g, or t
  misc_feature (45)..(45): n is a, c, g, or t
  misc_feature (106)..(106): n is a, c, g, or t
ggtttgagtgggcttggcagcacccgcacgcctcgnccgcctggntctgttggggcctcgcctgcggtagtagacagccttcgctttccacctgcgcgtgctggcnacatgctgcggcaccgccctgggctcgcctcccgctcacgctgcgctgggtgcgccagacctccgccagacctctgcctcccgccgcc

SEQ ID NO: 482867 - DNA, 249 bp, Homo sapiens
ctgctcctctcagtctcgtggctcctttcatagcccgtctgcaggcagattctctcctttaatctcagaccaaagcctttatacttcataactaggaaggcttaaaaggtcacttacatctctgaggactcagttccccattcaaaaaaacagttttagagaagaacagtctttcttatattcccattgctcagtaacaagcttggcacaccaggaacatacagaaattggaagtttcccttcctcccc

SEQ ID NO: 482868 - DNA, 436 bp, Homo sapiens
  misc_feature (284)..(284): n is a, c, g, or t
cacgagggctcccggcgggtgaagaatcccaccgagcgctggcgcttccgcgaaaccctgtgtgctaccgccgggaccaccgccgaagtgtcccgggccgccacccgcctgctgcgcgaaatcgccccgccgcccgagcgcgaagacggcgggcgccgcatcctgcacggcgagaaaaccacgctgagctttaccggccccgccgccgaaatggccgatatctgggccaccgcgaaggataatcccctcgcctggctcaccggttcccgcgccgtcgcgccggncagcgtgaccaccaatgtcatcatcgagctgccggattacctgaaagttctgcgcggcgagggctccgaagtccgcctcgccatgactaacggtgccaccatcactggggccgacctcatccgccgcacgctcgccggggccggccttttca

SEQ ID NO: 482869 - DNA, 316 bp, Homo sapiens
agccacacacccccccagcaccgccaggcttggcacggcggtccagcaagctcccaccctctgggcaccaacctgcattgcagttggcaccttaccttccctgggatccccagacttggtccaaggagggagagtgggttctcaatacggtaccaaagcatataatcacctaggtttacaaatatttttaggcctcacgttaactcacatttatacagcagaaatgctatttcgtatgctgcttaactttttctatctgtgtactttttcttacagggaaagattttaatattaaacctggtgcttctcactccac

SEQ ID NO: 482870 - DNA, 298 bp, Homo sapiens
aatttattatttatttatttaaatatgcaatatatgaatgtggtttgaaatttataagacacaatgatgtatacagaggaaatcctcactctcaatcctctcaagtgtttgttaattcctcttgcatatgcaatctcgtttttccagctttgtgtttatctttccagagaagtttactgtttattaatcatatatgtatatctttattcttgctcagtattttcgctattcagcagctaagttcactgttctgaactttattttttaaatttaatatatattgctatgtagttatttt

SEQ ID NO: 482871 - DNA, 489 bp, Homo sapiens
agcggctttctcggcccccggagcggtgacggggtgaacggcgggggaaccgacagtgggtgatgtccgcctgagctcccgagactgcgagcacgcgagccgcgcagccgtaccccgggccgcagtcaacgggtcccggggtcggcgagcacagtcttgaggcctgtattcatttcctatgtatcagggttttcagctagcgatagcatatggcggcacgcaaggtcactgatcgcacagacgcaagatccggggagatagcattagggacacgtacttgcagaggtacgaagcagggaccggtaggagcaatgagcaacgggatagaggagaaagacacacacgagacgcactgaagagcgctaagcacagaagaaaagcgggagggaccgaagagcccctcagatgcagacgagctgagcgctggacacgatgatcccttcacaaggaagggaacggaggcacgcaaacagtgccaccatcacacac

SEQ ID NO: 482872 - DNA, 119 bp, Homo sapiens
cccatctattcggcactcactatcgtagagtcttaggatattaatcatagggtgttgtttgtttgttgttgttgtgtgaaacagggtttgctttgtctcccaggcttcagtgcctgacc

SEQ ID NO: 482873 - DNA, 245 bp, Homo sapiens
ggcgcctacacttcgctgtgcagaagaaggtctgttagacccaatgagacaatgaaatcgcaatgcgactccgtcatgcagatcgggaagctcatcaaagatggctgatcatcgcaagcgtgtgacggtccattcccgggctcgatgccggaaaaacaccttgggccgccggaagggcaggcacattgcgcatagggtaagcggaaagtttgctaggggggtaccgaggctcgaaattcggtaat

SEQ ID NO: 482874 - DNA, 138 bp, Homo sapiens
agcattaaagggcaggtccatactggcccaagtgacattgttagatccatgtcccctccacccaatcactgctgcttgcaagggtgcctcttcacagtatcccatgatggcagcagatagtggcagaggcagaagtgg

SEQ ID NO: 482875 - DNA, 522 bp, Homo sapiens
ggcggccgtggatataaccgcagtcgctacaaaccggtcgtaaagagtgttcctgatcaccccttccccaataaagctaaagctcacctgagttgtaaaaaagtccagtagacacaaaatagactacgaaagtggcgtttaacatatctgaacacacaatagctaagacccaaactgggattagataccccactatgcttagccctaaacctcaacagttaaatcaacaagaactgctcgccagaacactacgagccacagctgaaaactcataggacctggcggggcttcatatccctctagaggagcctgttctgtaatcgataaaccccgatcaaccgtcaccacctctggctcagcctatataccgccatcttcagcaaaccctgaagaaggctacaaagtaagcgcaagtacccacgtaaagacgttaggtcaaggtgtagcccatgaggtggcaagaaatgggctccattttctaccccagaaaactacgatagcccttatgaaaggggacctcta

SEQ ID NO: 482876 - DNA, 150 bp, Homo sapiens
ccttgagacaaatgaagtaaaaatacatatcgcacgattttggtatacactgcacatagttttaagagggaaatttatagctctgagctgttatctgaaaaagaagaatgatcgcaaaaccgtagcttaactttgcattgtaaggaagta

SEQ ID NO: 482877 - DNA, 157 bp, Homo sapiens
gacctagaggccccgtagatcctaacagaaacttagcaaacatttacccaaataaagtatatggcgatagaaattgaaactggcgcaatagatatatgtaccggaagggaaagatgaaaaattatatacccagcataatatagcaaggacataaccc

SEQ ID NO: 482878 - DNA, 605 bp, Homo sapiens
  misc_feature (422)..(422): n is a, c, g, or t
tatcgggaggtttcatgtaagccatttgaagaaggcaacacttggacaaaatgatcgcttcatactttgggaatttgtggcatgttcacgatctatggctagggcagttctaccacagagcactcaattgtgaatatgctgacacctctcttaatagagcgatcctgtagactcacttaataaggcacctgtgagctatgcctcagtcgatcaacgcggatgaagtaccgtcaaattctcatgatatgccatctgtcctcaagtgtgatctacatagggaaatacaatgtaattgatgtacagttccatttctgtgcagctggcattttacttaacactttgggtcaaacgataatgtgattcttatgattgatttctcaacactagactattctccgctccacaaagtccagggaccccantttaaattttccctgaaggccaatgtcaggaaacatactattgtcccaaataactgctaaaaaattaagcttacaatttctgctggaccctactagttaaagaatctgggatgctggactcattgacaagctttccagaagcaattttataacagatttcattttaacaaaatactgatccaa

SEQ ID NO: 482879 - DNA, 196 bp, Homo sapiens
gtagcccccccagttttgccccccccctccctcccatggacccccgcaaagtgaacgagcttggggcctttgtgaaaatgtgtaagcaggatccgagcgttttgccccccgaggaaatgcgcttcctaagggagtgggtggaaagcatgggtggtaaagtcccccctgctcctcagaaagctaaaaaaacaaaaaa

SEQ ID NO: 482880 - DNA, 345 bp, Homo sapiens
taggtgaagaactggatgagaggattggtgttctgggtagaaaatattgcaagcaggccgggtgcggtggctcatgcctgtaatcccagcactttgggaggccgaggcaggtggatcacctgaggtcaggagttcaagaccagcctggccaacatggcgaaaccccgtctctaataagaatacaaaaattagccgggcacggtggcgcatgcctgtagtcccagctactcaggaggctgaggcaggagaatcacttgaacccgggtggcggaggttgcagtgggctgaaatcgtgccactgtactccaggctgggtgacagagcgagactccatctcaaaaaaaa

SEQ ID NO: 482881 - DNA, 533 bp, Homo sapiens
  misc_feature (424)..(424): n is a, c, g, or t
gtgtttgtattacaggcgtgagccactgtgcacagcctaactcatattatttaaaaaacaattaatcaaataagttggttaggattagtttcagtggcataaacagaaacttaaacaatgtgaaagcttatttctgtctccttctgccaggtgaacacacagtgttcatccccttcaggaggacaacacccaaaaaaaatgccccttttttttctgtggaggtaccatcgttggacagcagagaccagccctcattatacacaaacttcctggcacgttgatttgggacttcatagcctctagaactttattcagaggctgctctactgagaagatgaacaaatttcttgtccaaaacaatgtatttttccaagacgtgccactcgggggggcccctcctttcccgtgttgcttcccaactggngattttgggccctggcgaagacaacacttctgaactatattttgacagagcaacataaggtaaaaaaacaaaaggagttagcgggtcatttaaaatgaatctggggaag

SEQ ID NO: 482882 - DNA, 424 bp, Homo sapiens
  misc_feature (13)..(13): n is a, c, g, or t
  misc_feature (62)..(62): n is a, c, g, or t
ccctttttaaagnccccctttttaaacccccccagaagttgaaccaccacactgtgctgcgnctgtgttgtgcaaaggatgagagaagcataaagcaaataacgggctcccttagtgcaaagaacttgccacaggaatagaatgaatgatttgttttgccctttctgtttagttcatttaaaaaattcccagccgcttacatgataatagggtataagctataggagaaacattcacagggaggatagtttagagcacactctgaagaacattaggttgtgggagaaaagaatagaagagtgggccgggcatggtggctcacacctgtaatcccagcactttgggaggctgaggtgggcagattacaaggtcaggagatggagaccatcctggctaacacggtgaaatcccatctctactaaaa

SEQ ID NO: 482883 - DNA, 117 bp, Homo sapiens
accaatatcgtaatacggtggcttccatcaggacagtggtggaggaagtactgagaaagggtaagattctgtattccttttgaacggtacacttgataggatttgctgcaaggctga

SEQ ID NO: 482884 - DNA, 956 bp, Homo sapiens
  misc_feature (90)..(90): n is a, c, g, or t
aagccaaggtaaggcgaaggggaatggggtaggggtgagatgggctgattcaggagtctgaatgagaggccttgagctcatgctactctnggaattgattttagttattatcacccattgttgaatgaatgactcctcaactcaatcatgcaaaatgaatacacttattttatggataaggaaaataagattcaaagaagtcaagtaacctacccaaagccatgtagccagtcagaactaagactgaactggctgaatccaggtctgtccacctcccaaacccctgcatttccattcctccaagatgcctttctcaccaaatatccaataacctatggaagtagttcaagatctgcggagagagagcttaagatacccatcaaagcctttcccaggaccccaggaggatgattttattcagggactctggaagggaactggttgcagtttatttaacacctgctgaagaattccagatgtcttattttggatctccacaggcaggaattcctcagggacacatgtagttcaaacttaagggaggatcagaaaaacagaagtccttctgtggtaggatgttatacgcatagccacatcaagtccttctatccttatgtgcccactccttttacacatgtgaacttgccttttttccccaaccaagaggtaggggtctattttgctaaccccttcagtctgaactaagcccatgacttgctttgaccaatccagtaagagcagaagagatggctgtgtgacctctctaaggcctcaactttcaagaaggtggttgccgcttccgatcctcggtactctatacaaacctctggcatccacgttaagaaacttcagccggacatactatggataagatcttcccaaagatgacgcagagagtttccaatggaggcccggacacattgccgaattgtacgaaagcctttaacaagcaggca

SEQ ID NO: 482885 - DNA, 819 bp, Homo sapiens
gacctcgcaggcagcgcgtttacgtcagagcgcccgagtccatggacctcgcaggcagcgcgtttacgtcagagctcccgagtccacgcacctcgcaggcagtacgtttacctcagagctcccgagtccaccgacctcgcaggcagcgcgtttacgtcagagctcccgagtccacgcacctcgcaggcagtgtatttacatggaaattggatcgaggcactgacgtttaaatcttggctcctgctcctgccgtctagacaaagggcgcacccattgccgtctcagacaccagaggctcccacttgaccagaaacccactcctgcgatgaaggatgaatcttcctgagggcagagctcttaccgcccactcgcccctctaagttcccacctcccaaggccgtgtctctggggatgaagtttccaacacacaaacattgggggcaccttcaagccacggtgtcctgtaaaccagcgttccagcatttgccaaatggtgtttcttttaccaggagataaggactctgatcaggtcctttggaaagagcaagggaagctgttcatgttctatcctgcgtgttctcgagaaagtttgatgaccagaaaacatcacacagaaaggggaaggcatcgcaagtttccagctccatggatttttgcaaactgagcacatttgtgggccaggagtggggcccacagcgagaatatccttcctgctgctcctgccgtccatccaccagcacagccagttcccagctgtggaacacacagagctgtgcactgttgagttgatcacgatgagaacagtgagtgtctctcagc

SEQ ID NO: 482886 - DNA, 264 bp, Homo sapiens
aaggtcgagtgtggcatagtaaaaagagcgatatgatacaccctgtctgagatggaaatatcagtatcttgattatatggatgtcaatatcctaatttcgttcttattgtgttatcctgatgttaccattgtcctcaatagtcaacgtgtatacgtgatctctggtattatttcctataactgcaagtgagtctacaattatctcaaaataaaaattttaattaattttacgaaatattttccccaaatggtggaagttaagtg

SEQ ID NO: 482887 - DNA, 827 bp, Homo sapiens
  misc_feature (6)..(6): n is a, c, g, or t
  misc_feature (68)..(68): n is a, c, g, or t
  misc_feature (76)..(76): n is a, c, g, or t
  misc_feature (88)..(88): n is a, c, g, or t
  misc_feature (90)..(90): n is a, c, g, or t
  misc_feature (92)..(92): n is a, c, g, or t
  misc_feature (137)..(137): n is a, c, g, or t
  misc_feature (147)..(147): n is a, c, g, or t
  misc_feature (159)..(159): n is a, c, g, or t
  misc_feature (274)..(274): n is a, c, g, or t
  misc_feature (278)..(278): n is a, c, g, or t
  misc_feature (331)..(331): n is a, c, g, or t
  misc_feature (333)..(333): n is a, c, g, or t
  misc_feature (683)..(683): n is a, c, g, or t
  misc_feature (746)..(746): n is a, c, g, or t
aatcangcatgccctgctgagagtgtgaggagttgcaacagtatcacgatgcacacattgttgttcanactgcgtntcgcgtatacanancnacattatttctctcacacgtacgcgcacgggtgtgggcgcgtacntatagtatgnctagacatgggntgcgcgcatgtactaataataacgcactctcaacagctcatctgacattgtgtcgtgagtccagtgacagcatatgcatatgtctatcgatgtcacatctcaccgcgctatatcntcantgatgcgttgctccagtcatcactgccgtgctacacacgatgacatatcatcntntacatgatgatatgcataggacacgactacttcgtgtaatagcgccgcacacgatactgatatggaatcgagaggcatcagtaacattgtgctaggctagactctaactatctactctcagtcgtgacattatctggtacgtcggtctattactatgcagtatgagagcgagagtcacatgatgtgcgtgatgtaggatatgtactatcagcatcgtcgaatcgtgtgcgcgcaacatagtcagacagtagtcgcatcaggtatctggatgtactgtcaggacagtgtcatttactatgatacagtcgctagtcggagtctaactactgagtgtgcgtcgtgcatatcangagacgatgcgtcggcactcgctcgtgtgagatatcgagcgtggaagtacacgatacatcganagtactctagtcatatcgcatgaacctacggtatgtgagtcgcctaatctgtaatacgcgtgctagttgattcagtctgcg

SEQ ID NO: 482888 - DNA, 628 bp, Homo sapiens
  misc_feature (353)..(353): n is a, c, g, or t
ttaagcgggcccaattcttggtagaaaaagcaaagaaggaacagcggcagaaaattgtgcagcccgagggtgaggccgaggctgcacaagatgcttggagaagcactgagcaagaaccctggctacatcaaaacttcgcaagattccgagcagcccaagaatatctcacaagacgatcgccacatcacaagaatcgtatctatctcacaagctgacaaccttgtgctgaacatacagggatgaaagtttcacccaggggaagtgacagcctcataaaggttaagaaatgagcctagttaccaagaactccacccccagaggaagtgatctgcttctccagtttttgaggagcnagccaggggtccagcacagccctaccccgccccagtatcatgcgatggtcccccacaccggttccctgaacccctcttggattaaggaagactgaagactagcccccttttttggggaaatactttcctcccccctgtggtaactgggggtggttggggcaaggggggatttttcaagtattttccacaagggtggtcccttcctcaagggtgggaggaaattaacccccacccagggattttccattaatttttttttctttaacttgaaaaaa

SEQ ID NO: 482889 - DNA, 697 bp, Homo sapiens
taaaagtcgatttgattccctaagcttgttataccggtacgcgacggtcgctgggtggtcgtgggtgtgatggggaaacgcaacgccaatgatgtgtgcttgcgagccgctggtactagagtacgttgccagtgctctgcctgggcggttggcactaagctggtcctgagtgctgtggctacttgcatgctccggagctggtggctgccgcgataggagagccgatggccaagtgggtgtgagtgtgagacccacgctggatcgtggaggagcgggcggacgcacaacgcaagtgtgaacaactggcacctggacggagagagatgcttcaaatttggtccacggataagctgaaaacactgttcctgtgcagtgcaggttcaaaatgaagaaggcaagtgtgaggtgactggaagtgagtacgcttgatggagaggcatccattaacgaatacgcaaagggaaacttatcataacttagatgaattggagcgtcaaactacactgagaaggtacgttctagagtcaggaggtacaagtacaaatgtgacatgtggagaataccgcaaatatgtcgtgagttaaaaacagggtggattaacgtgtgagattagttgtgagcccattgccaaaagaatgaggcgtgaagagaaagagtgtaagttgggcgttaagttgaaggggaagaaagtgggtga

SEQ ID NO: 482890 - DNA, 626 bp, Homo sapiens
gcagcactcaaccttctctatatctggcacgaaacgggatcaatataactcaccacttaggaatcatcctccctatatccagagtatacgatctagccttcacaacctctactacatcaagtcaaagattcgcccctcggcatatactatctcttccttactctccttaatgacattaacactattctcaccagacctcctaggcgacccagacaattataccctagccaaacccttaaacacccctcgcccacatcaagcccgaatgatatttccgtattcggctacacaattctccggatccgtcgcctaacaaactaggaggcgatccttgccgctattactatccatcctcatcctagcaataatccccatcctccatatatccaaacaacaaagcataatatttcgcccactaagtccaatcactttattgactcctagccgtcagacctcctcattctaacctgaatcggaggacaaccagtaagctacccgttgttaccatcattggacaagtagcatccgtgactatacttcacaagcaatcctaatcctaataccaagtatctccctaattgaaaagaaaatactcaaatgggcctaaacaaaacacaacagaaaca

SEQ ID NO: 482891 - DNA, 361 bp, Homo sapiens
gacgcagtaaccaggtagtacatgtcatgggccttgggtaagactctgagatctgctagcttcaagctgtgactgagcgcactcccagctgtggtggctatggacagaaactccttctgcttgagaaaagcagagggaagagtaaaggagactttgtcttgtagcttagataccagtttggccatagtggagtacagtaccaagtgggctcttggagtccctaattttaggccttgggacttggacaggatttctgcacctgccctgggccagaggggagccaactgctctaaagggtgggtcccaggtctggcagcattcaccacaagctgactacagaccagttggtcctcggtcgacg

SEQ ID NO: 482892 - DNA, 233 bp, Homo sapiens
cggtcactctaaggatcccgggatgtcgcgtgcatgttgagattggcttttgtgtgaaggcgtgctgcggaactccacatacgtgtgtgctctcattcctgtgcttggccttgatgtgcatctgcagagcattccgtgtcgaggcccggtgcccacactcctcacacacaaacaggttctcaccacggtgcttgaaagcttcactgcaagctggagatctgtccgagacagag

SEQ ID NO: 482893 - DNA, 305 bp, Homo sapiens
catggacgctgttataattatgcctcataggcgatagtacaaggaaggggtaggctatgtgcttagtcaggtggttgagaataagtgtgaggcgtattatatcatagccgcctagtcttaagagtactgcggcaagtactattgacccagcgatgtgggcttcgagatgggcttacagggagtccataagtagaggtccgtaaagaggtatctttactatgaacagctattgtgtaagctagtcatattaagttgttggctcaggagttagatagttcttgggcagaccaggtgcagcgtagaat

SEQ ID NO: 482894 - DNA, 1438 bp, Homo sapiens
  misc_feature (1)..(1): n is a, c, g, or t
  misc_feature (1080)..(1080): n is a, c, g, or t
nggggttcgacgctcggtgtccgcaggcagggctttcttgttcactgcggcctccggttgtttggttagcttctctgttatcggtgtgcctgtggtgcgccgcggtgtgtctttttgctgcgggtcctgggtacccgaggggcccctccgctgggaggtgccgtgtcgtccgcgcgctcgctggtaggtgtgggctgttgatttctcccgactcctccatagccccgggccgcttgtccggatagcccccctggtggggggcttgccaaccctccctcagcactgggctgccaccgcctttccggaggccctgtcggggctcttctcgctttgggtggaggaggagggcgcttccccccgggggtacctccccgggggggcacgccgtttttctgtaaggggaccaacccgttcgacgccgcttgagaacaacccggggctcggttgctaacccaccccggtttgcggtcgcctgtcgtggcggttgtgtgcgggtgttttgtggaaaaagggggaagccccgtcgtgtgcccacgggccaagacgcgcaccgcccctgggtgtgggggctcttggtggttcccctgtgaaacccactcgatggttaacgttgtggtcaaaacaagagaggtctttgtcccacagagggctgttgcgtacccactggtttctcggaggttcttcccgcgtgcgctcgcccattcccccccgcgggaggtttgtcttcgcctgcttgtgtgttggagaaagtttcccggtcttggtgggggattttttgaggacccactgtttgtcgaacactccacgcggtatatattggtgtccaacacctctggggccacggccctttcgcttcgcgaagaaaagctttgttttccccccgctgttgtggagagggagacgcgagggccgcgagactggaaccactcgagtcacactcacggtttccgcccctgccacaggtgttctcccccacatggagccttgagctcacagtgggctctcttgcacattgtgtgtggcgtataaatgtgaggagctcttctccggagttccctgttcacagagggttgtctctcnccacatgtcctgtgagaagaaggagagctcggttggctgtccacgcccctcgggggcccggcacacacaggcctcgggcctctcccctgtgtcgcctccacaagccacgggctcctcgcctccctcgttcgttgggctccactttggggagccacactcggcctctcttctacacgcaccggcctcgtggcctcgttcaaaggcagagaccaccgaacccttgaactcccgcggtggggaaggtggcccaaggaatgctggagctgaatcacgacgctgacacgtttcttcacggcatttttatttcacccatcgaattggacaccttggcccaataaagttgaaattttacccccca

SEQ ID NO: 482895 - DNA, 700 bp, Homo sapiens
gctcttaccttgcctaacgaaaccatggttcgtggtcccaagaaccatctgaagcgggtggctagctccataagcattggatgctgcgattaaattctgaccgagtcgtgttttggctgcctcgtaccaatacacgatccggtccctcatctatagtatcgagaaatagtcgtgcatccgcccctctattcaatatatctcactggagatgaagacagaacttgaaagttatagcatcctgtacgaggcagatagtaaacgctacaagaagcattgtaagctatacgccggacgagttgctatataaataagaatcgtgatgagtgcgcataagggttcgcgtgaatctgggcatcattaataccgtaatccccctcgtctgaggaattcccatgagcgattggtggctattgccaaggcattttggactaagaagaccgagcgacgagacaattgttccccagtcactggaatttctttaattggaaagcaaaaccccaaaattggggggctttccggccttgtttgggccgttagtttaaccaagtctggtgtgatttaacgagccttagtagtggaaggtccccaaggtagcaaaacgtttcgcttgccatagtggtaggaggcacaaagactccttgtgtgaggacacctaaaacggaaatgcccgtacagtctgagtgaacctcgatgatggccc

SEQ ID NO: 482896 - DNA, 153 bp, Homo sapiens
gacactgtactcatatcataattctttatctccaataactccttcatttcacctaagccagcaatttcttttttttttttaattatacttaaagtttaaggatacttgtgcacttggtggcgtgtagttacttatgtttacttttgccaggcg

SEQ ID NO: 482897 - DNA, 351 bp, Homo sapiens
gccccccgatttttttttttacaaaaaccgggggttcatttggtctttttcccctgaggggggcccttttgttgggccctttcgggggggtccttcctttccagcgggccatggggtgaaggggggttccaaaccctggccctgttttcccgggggggcgggttttagaattataaccctttttcctttttgggagggggaccggggccctttgggatccctgtttagaccccaaccccccctgccccggtttttttggggttgggaaatttgggaggccagggttttggaagggtttttaatgaaaaccccccttagcccgtttttttttctgcccataaattttttata

SEQ ID NO: 482898 - DNA, 323 bp, Homo sapiens
gcactgatgagttttgtgaaacacagccttgttttagacaaagcttccctctctctggtgctcttggagaactcttgctcatccctcaggacccagttctgaggttacctcctctgagaagtcttcgcagctccatgaggcagaggattagcccttgcctgatttgtccctctaattcagctcttgccattctgtgatagtaaatgcctcttcctgctgtctccccattgagaggtaaataggtctaatctatttgcctaatatagggtacagtgggttgaattgtgaccccccccaaccccccacccaaaaaaaacaacaac

SEQ ID NO: 482899 - DNA, 143 bp, Homo sapiens
tgctgggattactaggcagaagccaccgcctggccagactgtacttctacaatcagggttaaacctatgtgacaactacacctcacattactctttcactccttttaggcttacccactgcagctctgttacctgctacccag

SEQ ID NO: 482900 - DNA, 220 bp, Homo sapiens
ttcttactggatctcacggatcttctatctggtaatatgcagacaatttgaatacattttaaagaagttcataatcatctgaagcaccaaatgaggtccatggaactgatactaaagatgttgatattaagcaacagccaatcccagagatcattctttttataatgtatacagaaacaaatccatactgcaaatagttgccatgtgcttcatgttggtt

SEQ ID NO: 482901 - DNA, 254 bp, Homo sapiens
caacagagcccggagtacaacagtgccttgtggtaagaagtgggctatggcatttttaatcttatagcgaaagcctataatcactgtgcccgctcataaagggatggccatggctaggtttatatatagttgggtgggtggtgtaaatgaatgaagcaagagttccaagaaggtagttgtggccattaaaatgattaaagatactaattttacagatcaaggtcggcctttaatggtgtgtatgggtatcattt

SEQ ID NO: 482902 - DNA, 100 bp, Homo sapiens
  misc_feature (34)..(34): n is a, c, g, or t
caagccaaaagtcttccagtatggatgcttgatntcccagttgggtcctgcttcaaaggcttccactgcaaaacactaaagatccaagaaggccttcatg

SEQ ID NO: 482903 - DNA, 123 bp, Homo sapiens
aatcgagctcggcccatcctatgaacaataccaggtggattttgtttaaccacatctcttctactgtgtaacggtatattatagtaaatattttgcatatattaattggactcaggtggtgtg

SEQ ID NO: 482904 - DNA, 170 bp, Homo sapiens
tttgagacagagccttgctctttgcccaggctggaatgcagtggtgtgaccttggcttattgcaacctccacctcctgggttcaactaattctcctgccttgcgctcccaagctcccaagttgctgggattacagcacatgcaccacaccggctaattttcttgtattct

SEQ ID NO: 482905 - DNA, 1024 bp, Homo sapiens
  misc_feature (178)..(178): n is a, c, g, or t
  misc_feature (181)..(181): n is a, c, g, or t
  misc_feature (183)..(183): n is a, c, g, or t
  misc_feature (192)..(192): n is a, c, g, or t
  misc_feature (199)..(199): n is a, c, g, or t
  misc_feature (298)..(298): n is a, c, g, or t
  misc_feature (300)..(300): n is a, c, g, or t
  misc_feature (312)..(312): n is a, c, g, or t
  misc_feature (342)..(342): n is a, c, g, or t
  misc_feature (354)..(354): n is a, c, g, or t
  misc_feature (368)..(368): n is a, c, g, or t
  misc_feature (382)..(382): n is a, c, g, or t
  misc_feature (391)..(391): n is a, c, g, or t
  misc_feature (393)..(393): n is a, c, g, or t
  misc_feature (403)..(404): n is a, c, g, or t
  misc_feature (430)..(430): n is a, c, g, or t
  misc_feature (493)..(493): n is a, c, g, or t
  misc_feature (499)..(499): n is a, c, g, or t
  misc_feature (605)..(605): n is a, c, g, or t
  misc_feature (643)..(643): n is a, c, g, or t
  misc_feature (687)..(687): n is a, c, g, or t
  misc_feature (689)..(689): n is a, c, g, or t
  misc_feature (721)..(721): n is a, c, g, or t
  misc_feature (836)..(836): n is a, c, g, or t
  misc_feature (844)..(844): n is a, c, g, or t
  misc_feature (852)..(852): n is a, c, g, or t
  misc_feature (901)..(901): n is a, c, g, or t
  misc_feature (960)..(960): n is a, c, g, or t
  misc_feature (978)..(978): n is a, c, g, or t
atggaggacctggatgccctgctctctgacctggagactaccacctcgcacatgccaaggtcaggggctcccaaagagcgccctgcggacctctcacccctcccccatcctatggccaccagccacagacagggtctggggagtcttcaggagcctcgggggacaaggaccacctgtncancncggtatgcnagcctcngtccccaaagcctgcagccccggtcggcccctctcattctcctcttccagcggtgtcttgggtaccggtgctctgtgagctagttcggttgcttcaggnanttaatgccactnagttcaacatcacatatgatatcttgtttntgttcccatctntctaggtggcttcntgagtgcagaaggnggtccagtntnaagtttagannttacccagcctcccttccagcccgtntcctggcctcccaatggcttctgccacctcagccactctggttctggttagtctgatggtctnactctnttacttccgcgttcaaaaccattcttccagcctctgggtctcttctcagccaccggtggtgagctccacaaatgagggctccccatccccaccagagccgactggnaagggcagcctagacaccatgctggggctgctgcagtncgacctcagccgccggggtgttcccacccaggccaaaggctctntngctcctgcaataaacctattgctgggcaagtngtgacggctctgggccgcgcctggcaccccgagcacttcgtttgcggaggctgttccaccgccctgggaggcagctgcttcttcgagaaggatggagccccttctgccccgagtnctactttnagcgcttntcgccaagatgtggcttctgcaaccagcccatccgacacaagatggtgncgccttgggcactcactggcaccagagcatttctgctgcgtcagttgcggggagccctnggagaagagggtttcacnagcgcgaggccgccctactgcggcgggacttcctgcagcgttcgcc

SEQ ID NO: 482906 - DNA, 243 bp, Homo sapiens
cgtagcgcaacagctatgtatagtcctccttgacctcctgctacggtgacgagtcacaatgccctcccgcatgaacaggccgtaatctatacaaaaaactttgcatactatactcagcatcttaaaacactctggtcaatagaagaattagatcacgcctctgctgtcaaaacgtcccggagtaaacctgatgagatgcgctctcctagcagcagctcccggactgaggtacaggggcaatct

SEQ ID NO: 482907 - DNA, 458 bp, Homo sapiens
  misc_feature (27)..(27): n is a, c, g, or t
  misc_feature (52)..(52): n is a, c, g, or t
  misc_feature (457)..(458): n is a, c, g, or t
caaaaatcaattacctccctcctttgntaattcattgaaatcccttactgtnatcaaccctgtaataatcagggttctcccaaaaaaacagaccctgtaggagatatacaggtatataagaggagacctatcatgggaaattacttacatgattatggaggtcaaaaagttaaacaggcccaggcgcggtggcttacgtctgtaatcccagcactttgaaaggccggcgggggggtggatcatctggggtcaggagttcgagaccagcctgaccaacatggtgaaaccctgtctctactaaaaatacaaaaattaggtgggcgtggtggcaggcacctgtaatcccagctactcaggaggccgaggcaggagaatcgcttgaacccgggaggtggaggtcgcagtgagccatcacaccattgcatgccagcctgggcgacaagagcaaaatccgtcnn

SEQ ID NO: 482908 - DNA, 267 bp, Homo sapiens
ccgtgcgaatataacttcgaagtagtctgtcacactctagatatgtattaatgtcccccaatattaaagattcacatgatacatatttagggaacacatgctactttgttactgtttgaactctcagggaaacaatgttccccttgggtgcgtccgaatagttactattctctggcaacctggaagataactaatacgtacctatctgtgttcaatctcagctttagattattggcactggtgtgttgataaaccaacctggggttc

SEQ ID NO: 482909 - DNA, 426 bp, Homo sapiens
ttttttttttttcccatgccccattatttaatattatctggacgtatatcgctggtccttaatcggtagtgcaggtaggtgaatacgccccagggggttttatagcttaggtttgggggagtgtagtacttgttgacctgacccagttgcaagtcatactggcagttgttatgactatttggatcccgatcgaataggttcgaattctatagaaaccatatggttcgtacgctaggtctgcggagctagtgtataagccctataggttatgccgacgttgacgctagtgggaagtgtgtcccggtggcgaatagacaccggaatatattacgcatctaattaatacgccctgtgccctaagttttgtaagcctgatgtatagccagacacggccggtatggtatagacatgaaatagggaacgtag

SEQ ID NO: 482910 - DNA, 127 bp, Homo sapiens
ccgagcagaaacggaaggatgctgaagcctggtcaggagccggactgaagaattgaaccgggaggtcgctgggcacacggagcagctccagatgagcaggtccgatgttactgacctgcggcgcacc

SEQ ID NO: 482911 - DNA, 381 bp, Homo sapiens
cagaggctagaaattgtttccagtcatcgtcattaaaaaaaagttattaacgccaggcatggtgcctcacgcctgtaatcccagcactttgggaggccgaggcaggcggatcacctgaggtcaggagtttgagaccagcgtggccaacatggtgaaaccccgtctctactacaattacaaaaaattagctgggtgtggtggcgggcacctgtaatcccagctacttgggaggctgaggcaggagaatcgcttgaacccgggaggcagaagttgcagtgagcgaagattgtgccactgcactccagcctaggcaacaagagtgcaactccttcccaaaaaataaataaataaataaaataaatgttattaacatgttttagc

SEQ ID NO: 482912 - DNA, 304 bp, Homo sapiens
aggatccccacgcgttcagagtatctattacctagtgagttttctaaaactcctaccattaataatgtattactcttttactgcgttttgagcttgtatattctattcggcttttccatggtggtaccaaaaataagggttttctgctactgtccaaaaggtaaaagccttgcagataacaattatggctgtgttcctctgcttgaagacagtgaaacaagaaagaataatttgactcttgatcagctacaagataaagtgattacaggaatagcaagagaaaaactaccaaaggtagacattg

SEQ ID NO: 482913 - DNA, 3284 bp, Homo sapiens
  misc_feature (54)..(54): n is a, c, g, or t
gacaggatagtctaggacaggcctgtgttaatcaggagaggccagccgtctgtnctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataattttttttttttttttggagatggagtctcgctctgttgcccaggctggagtgcagtggcgcgatttgggctcactgtaacctccatctccggggttcaagcaattctcctgtctcagcctccctagtagctgggactgcaggtatgtgctaccacacctggctaattttggtatttttaagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatg

SEQ ID NO: 482914 - DNA, 301 bp, Homo sapiens
ttaaaagcccccccctttttttttaaggagaagggcccagtcttttcccaagtccccccagggggggtgaaagcattgctttggggtaaataatgaaaggcaaaatttttttaattttcgcccaaaaacttttttatttggttttattttgaaagaggagccttggggcccccccttcccccttttttgtcccccaacttgaaaggtataagggtttttggtttccctgggggggggggggggcagccggggtttccctgtaccttgatttgagcccagttgaataaaggggcccccctta

SEQ ID NO: 482915 - DNA, 667 bp, Homo sapiens
agagagagagagagagagagagagagagagcgagagagagagagagagagacagtgagtgctagagacgagtgcatgtggaccatatacgcatacttcgctgtatcgctgtctagcgcgatgactcccttgtgcactctggatctcaccctcatcagagtgatgggtattcgatccgaacattgacatgttgtctatcctgacgcacttcacgagactctatggatcgtgtctgtactccgtcatcatgggcgacacatcaggtgacttccctgaagcgactgctaggactctgcggcagagatgtttaaactcacgatccctgaatgacaggactgcactcatcactttgcagacttctaccgttatgtttctacgctgctattatcatcatgtcatgacgcttactaccatgtctaacgcctacagctgcctactagactgtagactgtctgtattattattcatctattagtagccattaggctgctataaagctgtacatggtttttaaagcatctacgatataaacgtaggtcctaaagtcgaaatagttatgtattccatgcttctcagagactgcagcctactttggcgcgtgacagaccttgactatcttaagctatgccgcatttcgtctacgctgacgtttgcttgggagaccgtct

SEQ ID NO: 482916 - DNA, 3270 bp, Homo sapiens
  misc_feature (16)..(16): n is a, c, g, or t
  misc_feature (23)..(23): n is a, c, g, or t
  misc_feature (30)..(31): n is a, c, g, or t
  misc_feature (33)..(34): n is a, c, g, or t
ggacgcgtgggcgacnacgcgtnggtcccnncnngtcctgctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataattttttttttttttttggagatggagtctcgctctgttgcccaggctggagtgcagtggcgcgatttgggctcactgtaacctccatctccggggttcaagcaattctcctgtctcagcctccctagtagctgggactgcaggtatgtgctaccacacctggctaattttggtatttttaagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatg

SEQ ID NO: 482917 - DNA, 3286 bp, Homo sapiens
agcagagagacacatggctaggtctgaggctggggtgaatcggccgaggcgtctgtctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataattttttttttttttttggagatggagtctcgctctgttgcccaggctggagtgcagtggcgcgatttgggctcactgtaacctccatctccggggttcaagcaattctcctgtctcagcctccctagtagctgggactgcaggtatgtgctaccacacctggctaattttggtatttttaagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatg

SEQ ID NO: 482918 - DNA, 3177 bp, Homo sapiens
gctcctctgctgcgacccacggagtgcgacgggacagccacgttttcacatcgggccccgtgaaattgccgccaatggaaaggacttggtccagaaaaacgttagtttcatatggttcgcccggtacttaaatgttttattttctcccccaacagaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataattttttttttttttttggagatggagtctcgctctgttgcccaggctggagtgcagtggcgcgatttgggctcactgtaacctccatctccggggttcaagcaattctcctgtctcagcctccctagtagctgggactgcaggtatgtgctaccacacctggctaattttggtatttttaagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatg

SEQ ID NO: 482919 - DNA, 538 bp, Homo sapiens
tttcaaggttaagccaaccccctatccgaggtttaaatctctttaggtctcccagggaaggggaaaaacccctggccggggtagggattggtgtataaacaattgggcaatgaagaaaaacttctctttatggtcaggtccccccgagataaacttccatggggcccctttagcccctttgaccattggccctgggtttaaccaattcccctaaagcccaaaaccccatgggtttttaaccccgggttattttccaaaaagggcctttaaaaaagcggggggaccaaaccggaaaaattcccctccctttttttttgaaaggttaaggctaagaaaggcttttttaaccctttaccccccaacctggaaaccttttggggtttcccccaaaaaaaaaagggggttttttttccccttttggcccccttaaaaaaggccctggggtttcccaggaaaaggaaacctttttttttggggggaaaagcccaggaaaagggggggtgttttttttaaccaataaaaaatttttttttccgga

SEQ ID NO: 482920 - DNA, 3551 bp, Homo sapiens
gccgccgagaccctcaggggctgcggccctggtcccgcgggacctgtgggggcctgggcggcggcgcccccgacccagccagcggacgggccggggggggaaccgggaggtcccggggggcgtccacgggggtgtccccgggggtctccggaaggcgccggcggaggctcccgcgctgcgcttgtcgcgcgcggccccgcggccagcctgggtagggcccaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagcccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataattttttttttttttttggagatggagtctcgctctgttgcccaggctggagtgcagtggcgcgatttgggctcactgtaacctccatctccggggttcaagcaattctcctgtctcagcctccctagtagctgggactgcaggtatgtgctaccacacctggctaattttggtatttttaagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatg

SEQ ID NO: 482921 - DNA, 312 bp, Homo sapiens
aacacgatcacaggctcacagatccaggctttcattgatgacacctcaaatatacaaattcagtcgtagcctgtagacgttgcctacagggaaaaggtgccttgtccttagcctgaaatcagtagtacctattgccagagcatacccgaggctgatcgccagcctggaaaaatattgcgcgctgtcagcaaggattgaagcaggccccttgatgggtgcattgtgggcccctgttttgcgaaggatctggccatgaagaaacgtgttgccttagtgctgggctccggtggggccaggggctacgcccatagt

SEQ ID NO: 482922 - DNA, 3078 bp, Homo sapiens
ctgccattttataaatgtcagcagttggaaaaatcgtcacgcctcagacataaatgcacttggaggttcccgttggcaaggggggctaactgtggggcatagtaagtggtccagcatacttaaagtttgagtgctcagtgtgagtcctgtaggctttactctcttccttttatgctaaaattgtgacttccgaacctcaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataattttttttttttttttggagatggagtctcgctctgttgcccaggctggagtgcagtggcgcgatttgggctcactgtaacctccatctccggggttcaagcaattctcctgtctcagcctccctagtagctgggactgcaggtatgtgctaccacacctggctaattttggtatttttaagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatg

SEQ ID NO: 482923 - DNA, 134 bp, Homo sapiens
atataacgttgagcaagctgttgcactgaggattttcttaactatattgaaaaactgaagtatgaacaccacctgaaagaatcattgatagcaaatgaatgttggtaaaggtttagaaaataaacgattttgac

SEQ ID NO: 482924 - DNA, 1300 bp, Homo sapiens
  misc_feature (1118)..(1118): n is a, c, g, or t
  misc_feature (1172)..(1172): n is a, c, g, or t
  misc_feature (1191)..(1191): n is a, c, g, or t
gccgccgagaccctcaggggctgcggccctggtcccgcgggacctgtgggggcctgggcggcggcgcccccgacccagccagcggacgggccggggggggaaccgggaggtcccggggggcgtccacgggggtgtccccgggggtctccggaaggcgccggcggaggctcccgcgctgcgcttgtcgcgcgcggccccgcggccagcctgggtagggcccaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattgggaccaagaggctacctatggtgacgtgttgtagccttgctgccgtggaggctttctttccggncttgcgcgcagtctgcccagaacgggactgtgctggcccccatttatgactttngccgcacaggtcccgggtntgcgccgcgtcccccggtccaacccggggagaggaaacaccgggggaaaagcccccgggcccgggggcctacacacttggccacggcgccccggtagattgggcgcctt

SEQ ID NO: 482925 - DNA, 389 bp, Homo sapiens
aaaataatttaaaattttttggaaaggaagggttggttttcaaattttaagaacataaattttggagggcccaggggtgaaataaaatggtttggttgtgtccccccccaaatcccaatttaatttgtttttcccaaatttcccatattttgtgggagggtcccaggggggggtaattaattcaggggggcttttttcctgggtttttcctaaaaaagtaaatgattttcatgagttttgaggggtttaccaggggtttcccctttggtttttccctcatttttttttcccccccccaggtaaaatgtccttttcccctccccccaattttttgaggcctgcccacccttgtggaagggtaagtccaattaacctttttttttttccca

SEQ ID NO: 482926 - DNA, 819 bp, Homo sapiens
  misc_feature (506)..(506): n is a, c, g, or t
  misc_feature (525)..(526): n is a, c, g, or t
gaggcccgtggatctcatcgaagatggtggcgcgatctgtgtcgggcattaccagaagagtctgcatgtggacagtctcaggtacaccgatgtagagaagttttggtctcgcattcagtaaaagagaaagagtccagtgtgcttgtccgaggacagtagcaagatgaataaacggtaagacctatcctagttgtgtccagctattacgaaagccgtagcatatacatgcacctgaatgatctccagtcgtcgtttggtacatgcttacgtataaaggaagtttattggatttcactctcattctctagctaatgtggcaaggacaagttctccctggcaagcatagttcggtctaacaggttcatatccttcgtggcctcagtatagagctgatgaacttggggttcagtgtacgtcccataacgtgcacagacgtcacagcacagactcgtgcaagggattatgcagagtgttctttgagtattcctatgaaatgtgcccgtatntcagagactaggatgcgtnnataatgtgtgatggcatactcagatgcccagcttaaactagtccaccccgaattctgtaaacattcaaccttgcgaagttagcatagatgcactgttcgcgaagaagaagaccagcattcgaaagatcacgtgtcctttgccctgaagcataggcgggcatggctgcgattagaatctttgcgcatacgttgtacctattgtgtaacactactatcatgaacttgtttctctgaaagcccagcttttgctggtaggaggaaggtgtatcgaatcttttaaagctcgatattcc

SEQ ID NO: 482927 - DNA, 2002 bp, Homo sapiens
gttatggaggggagaagtgggacaaaaaagatgcagttttcccaatacaaaggaaaaccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataattttttttttttttttggagatggagtctcgctctgttgcccaggctggagtgcagtggcgcgatttgggctcactgtaacctccatctccggggttcaagcaattctcctgtctcagcctccctagtagctgggactgcaggtatgtgctaccacacctggctaattttggtatttttaagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatg

SEQ ID NO: 482928 - DNA, 233 bp, Homo sapiens
cttagaatatggaaggtcatggagtcctcattttcgtcttgtaactgagttatatgaaagtctggttgagatgtctgtcacttttctgatggagaccaaagtacactgcctcacactagatgagctgtgccatgtacgtattgtgacccctgttgttgtcatatccgcacatcagcgtaagacgctgtccaaggcaaagccataaatgccgagatgaagtctcacgagagggg

SEQ ID NO: 482929 - DNA, 1103 bp, Homo sapiens
  misc_feature (16)..(16): n is a, c, g, or t
  misc_feature (23)..(23): n is a, c, g, or t
  misc_feature (30)..(31): n is a, c, g, or t
  misc_feature (33)..(34): n is a, c, g, or t
ggacgcgtgggcgacnacgcgtnggtcccnncnngtcctgaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataattttttttttttttttggagatggagtctcgctctgttgcccaggctggagtgcagtggcgcgatttgggctcactgtaacctccatctccggggttcaagcaattctcctgtctcagcctccctagtagctgggactgcaggtatgtgctaccacacctggctaattttggtatttttaagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatg

SEQ ID NO: 482930 - DNA, 315 bp, Homo sapiens
tctaactctaaatagtaagtaacatccatatcactatgtccaagagacattcagatactttagtaatgtaacgacaggaatgggagcatgtgatgcacaggagagtgacactaatccataaagtcttagagaactaaaccaataaacatatttgtacagctgaggtttccccatcctaatatacatatattaataattcagtcctatatgaactaaatattttacatttttttgacaggaaactatatatatataatttattaaggggaagagtcttgctctgtcaccaggtggagtgagggcatgatctcagct

SEQ ID NO: 482931 - DNA, 1112 bp, Homo sapiens
gccgccgagaccctcaggggctgcggccctggtcccgcgggacctgtgggggcctgggcggcggcgcccccgacccagccagcggacgggccggggggggaaccgggaggtcccggggggcgtccacgggggtgtccccgggggtctccggaaggcgccggcggaggctcccgcgctgcgcttgtcgcgcgcggccccgcggccagcctgggtagggcccaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtgagtttccaaaacatctttcattcatttgacgttgacgatctgaggtcgaactagttcgctttcctcgtcttgtatgtttttccatgctgagtgcatctgtgtgtgtaagctgggttttatattacatggcatttcctgtttgtaacactttgcagttctttcttatggtattttcccgactctagagaagctgagacaatattaagtggtagcaatgtgatgactctttgtggcaccacatctgcccctcttttttgttgagc

SEQ ID NO: 482932 - DNA, 1170 bp, Homo sapiens
ggcccttcgcgcgcagtcccttagggggcgcctggaagcccgcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtgcaggagggggcggccggggtggagagtgagcaggcggctttgggggaggaggcggtgctgctgttggatgacataatggcggaggtggaggtggtggcggaggaggagggcctcgtggagcggcgggaggaggcccagccccgacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaaggaaaaaaaaaaa

SEQ ID NO: 482933 - DNA, 555 bp, Homo sapiens
  misc_feature (318)..(318): n is a, c, g, or t
ggggggggatactatttttcccgagggaaggctaggccctttggcctttttggtgcccctttagccaggttgtgcccaaaaccgggtgttgccggtcggggtttccggggaattgtgcacccccgggccgttcttaagaaatgggccgcccccccccaaggtgtgccaaaactccgagggattccgggcccgctacgcctttttagccctcctttcccgggggggggtgccagggaatgggggttttgttttccccccccccctccctgccccctgggtttttccctgtggcggggggggggctggataatttagacngccttttgaaaggcgccagctttttccccccaggtttttttctgggaagggtgggttcccccccaattgggcctgggatttggtacccttttccccccctggggcattatacatgacccccgggtccggggggggacctggggccccccttcccccaagccccccccgcctttgtttgttttggctttcccggttacttttggcccccccccttatttttttttgggttttttggga

SEQ ID NO: 482934 - DNA, 1271 bp, Homo sapiens
ggcccttcgcgcgcagtcccttagggggcgcctggaagcccgcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtgcaggagggggcggccggggtggagagtgagcaggcggctttgggggaggaggcggtgctgctgttggatgacataatggcggaggtggaggtggtggcggaggaggagggcctcgtggagcggcgggaggaggcccagccccgacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacaggtgacaggtggctcccaggatgggtagtgggaggaagatggtgggtggatcattgccaacgggatccagcccccttcccacaaaaactcctgtctctgtagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaaggaaaaaaaaaaa

SEQ ID NO: 482935 - DNA, 140 bp, Homo sapiens
tccagatgctgtgagcgcatgatttgattccagctgataaccaaatggcttatttattggacaaataaacaggatgaacaattcattttcattgggaaattaggtcaattaaaatatgtcctctgacccattttcaggcc

SEQ ID NO: 482936 - DNA, 1166 bp, Homo sapiens
aaaaaacacaaaaagcaaacgtacacaggcaacaaatagcacaatgaatggaatagtacctcacatctcaatactaatgtttaatgtaaatggcctaaaaaatgctccacttaggctgggcacggtggctcacgcctgtaatctcagcactttgggaggctgaggtgggcggatcacgaggtcaggagttggagaccatcctggctaacacggtgaaaccctgtgtctactaaaaatacaaaaaaattagccgggcatggtggcgggcgcctatagtcccagccacgcaggaggctgaggcaggagaatggcgtgaagccgggaggtggagcttgcagtgagccaagatggcgccactgcaactccagcctgggggacagagtgagactctatctcaaaaaaaaaagctccacttaacaggataccagaattgcagaaatgcgataagaattcacctgtcaactatctgctgccttcaagagacttacctaacacagaaggactaagcaaaacagcacaaaaatctggaggcatcacattattctgatttcaaattatatacttataaggccatagtcaccaaacagcattggtactggcattaaaaataaggaatttacaccaattggcaatagaattagagaaccccagaaataaagccaaaatacttccaagacaactggatctttggcaacaaaagccaaacaacaagaaacgtgggccgaaaagggcacaccctatttcaacccaatggtgcacggatagccacatgttatgagaagtcacactggagcccagaaatcttcacccttttacacaatcttcccgagagagtcaggacgtacaattgaaaccctgcgaccttaaaaactttaagaaaatgcgtgttgtaaaacccccttctggagcggtggtcaggaaggcgtatcatagacagaagcaccaaagacacagcagaagacaaaatgatcagggaagactagccacaagcgtgcgcgaacggacacgagcggatacaacaacagggagagagaaacaaaatcagagagcaccaaaaagcacgagcacagaaacagcggaggagtaacgatgaaaagatgagataagcgagaatgtggtcgcccttggcctccgtcttgggtccgcgcgagcgcacaggacgacga

SEQ ID NO: 482937 - DNA, 902 bp, Homo sapiens
cgcggtggctcacgcctgcaatcccagcactttgggaggccgaggcggggggaccacgaggtcagaagattgagaccatcctggccaacacggtgaaaccccgtctctaccaaaaatacaaaaaattagccagatgtggtgacatgtgcctgcagtcccagccactcgggaggctgaggcaagagaatcacctggacttgggaggaggaggttgcagtgagtcgagaccgcgccactgcactccagcctgggtgacagagcgagactccgtctcagaaaaataaacaaacaaataaataataaacacctgagccctctgactgactgaacagagccctcttggccaaggtgacccccaaaaaataaaaactaagtttcccggccgtaaggcagatgggaaattgcgcctccgtataccccttcctcactgttaccagggttaaacaaggtctggtttcccaaattaaaccagaaacaagccctggaaaaacaaagcactggaaacaccccctccgatgaccttcaagcaattgcctgctgatgcggcctgactccagaccttttgcagtttcgaagtgacaaactggactaggctacaaaggtattcaaccaatggggctggttctgggctggttcaccgaaggcctgctgtccacagttgtctccgtgtcctgtgtaacaccttttcacaccactacaagaacgcctagcgtgttacgtggcagcttgaaacggtgaatttcttccactcggaaggggtgaacgtggggcactgtatctgtaaccacactaatgattgggtaaatcaagccaaccattattgaccccggttgcactgacatagtcaataagtccccccctttgaaccttgtttgaataatgcgctggtatagcccaccctg

SEQ ID NO: 482938 - DNA, 630 bp, Homo sapiens
  misc_feature (14)..(14): n is a, c, g, or t
  misc_feature (67)..(69): n is a, c, g, or t
  misc_feature (101)..(101): n is a, c, g, or t
  misc_feature (109)..(109): n is a, c, g, or t
  misc_feature (134)..(134): n is a, c, g, or t
  misc_feature (154)..(154): n is a, c, g, or t
  misc_feature (192)..(192): n is a, c, g, or t
  misc_feature (267)..(267): n is a, c, g, or t
  misc_feature (285)..(285): n is a, c, g, or t
  misc_feature (288)..(288): n is a, c, g, or t
  misc_feature (303)..(304): n is a, c, g, or t
  misc_feature (323)..(323): n is a, c, g, or t
  misc_feature (389)..(389): n is a, c, g, or t
  misc_feature (395)..(395): n is a, c, g, or t
  misc_feature (412)..(412): n is a, c, g, or t
  misc_feature (433)..(433): n is a, c, g, or t
  misc_feature (474)..(474): n is a, c, g, or t
  misc_feature (564)..(564): n is a, c, g, or t
tcacctcgtaagangccctcatctctgaaatggccacaccgcccatgacatacacgatgagccgggnnnccgcccgggcttctatgccagccttgttcttntgccagtnaccgaagcgggcactgacagcggcntgggagttggccgtgggggnggggtcggatacgaagggccacaggttcctgtccagcnggtcctccacggcgtcctccattacatccttgatgaccggggtccagcgggacagctgataggtgggctccatgngttctctcggttccagcnggntggaggtccccgagnncccggggttggtgaaagtncctcctagctgctccaggttacggatgaggctgctgtgcgcctgtacattggcatgctggatcagnttgganaggtttttttcactcanaccattccgaagaagatgtanagcaacaggacccggatttttttgtaggcgggcaccgcgcngttccagcagcaccggaacgatcagcttcatggagtccttgatcttctccccctctgcgtcggagcccatggccaggtcctgctccacantacacagcttctccaccgagcccttgaagtgcttcatacaatcatctgctagatgcaggtgcgtag

SEQ ID NO: 482939 - DNA, 373 bp, Homo sapiens
  misc_feature (2)..(2): n is a, c, g, or t
cntcgtaccttctgctctgtttgccacgaaggactagaatttatgacaccccagtagcaatgaacatacccagtgcccagattttggtttctatataggattctccacgtaaaaagtacaaagagctcctatggataaatggctgattctgcggctagggcatggaaaatacaagatgaatctgaaacatcctatatgtagcgggaacgaaagtggtcggcagaacaaaaggataataggcgtgtgacagagacatatattaacaaaacaggaagaacatttcactgggccaaaaactgggaaacaattcgagcccacattataaataacataagtttttaaagttcacaaatccaaagtataaaataaacat

SEQ ID NO: 482940 - DNA, 142 bp, Homo sapiens
gaggtatgaagtcaatatttatttcgagaaagaaaacattattcatatatgtgtaccgattttattacccatactaacagagtgctgaattgcctgtggactttaaaaataaaaattcctagtctggcattaatactaattt

SEQ ID NO: 482941 - DNA, 503 bp, Homo sapiens
  misc_feature (399)..(399): n is a, c, g, or t
  misc_feature (404)..(404): n is a, c, g, or t
  misc_feature (424)..(424): n is a, c, g, or t
  misc_feature (444)..(444): n is a, c, g, or t
  misc_feature (450)..(450): n is a, c, g, or t
  misc_feature (487)..(487): n is a, c, g, or t
tccgtggcttcgggcggggaggtcacaatcacattgagccaaaacgcatccagtgttttctccagttacaaataaaacgaatatgcccatgctgctaccacatcctcaccagcatttcctaaaaggccttttaagagcacctttccgatgttaccacttcatctttcactcaagtactcatctcggatcaggaatcccatgtgctcagccgtttaattctcttgggactgaaaacgccactttgggatgctgctgtcagatgggcttaaagaggaaaattatggtgtacaaacaacctttaaagggaccacacaggaagggactttctggattaaaggaggcaaaggtttgttggggattaaacttttattacttgggttttaattcccagggggcaanggggnctgttttagggcaggagggncattactctttgttgggggntccacnttacagcagggggaaagggggtttggcccgggggggntttttttcagggagtg

SEQ ID NO: 482942 - DNA, 203 bp, Homo sapiens
aggacggacggacggacggacggggccccccgaggtgccccccaacgagccacgctacgagccacacgaagcgccacgcagagagccccacaacgagccacgcaacgggccacacgaagagcctcatagggtggctcatggggtggcgcatcgggtggcacgtcgagtggctcttcgggtggcccttggggtggcgctaaggg

SEQ ID NO: 482943 - DNA, 108 bp, Homo sapiens
  misc_feature (14)..(14): n is a, c, g, or t
  misc_feature (61)..(61): n is a, c, g, or t
gagcacaatcatgngcaagcgcaacagcacacctttatccgagtgagaccactatgcagcngaacagagacttcttatctcttcttcttgatacttgaatactgcccc

SEQ ID NO: 482944 - DNA, 1660 bp, Homo sapiens
  misc_feature (284)..(284): n is a, c, g, or t
  misc_feature (289)..(289): n is a, c, g, or t
  misc_feature (295)..(295): n is a, c, g, or t
  misc_feature (360)..(360): n is a, c, g, or t
  misc_feature (362)..(362): n is a, c, g, or t
  misc_feature (383)..(383): n is a, c, g, or t
  misc_feature (446)..(446): n is a, c, g, or t
  misc_feature (450)..(450): n is a, c, g, or t
  misc_feature (608)..(608): n is a, c, g, or t
  misc_feature (677)..(677): n is a, c, g, or t
  misc_feature (828)..(828): n is a, c, g, or t
gggctatggcggtagcgcatagtccggcgagtcgctcgctgaggcggtcggggtcttcgtggaacggggagtggaacgcctttcagaaatgcgcgcagaatcatggcctagtagtgcgacatcccggatagccagtgctgaacgtcttgactctcctgacgagttcaactaactatcttgatcttcggactcatgtgcatgaggacagcgcatctgagcgcgcatctgttgagcatcgaggtggtagcattgcgctgtgaccgtgtggagagaggcaggacacncagtnttcgcncacggtggatagacgctagcgcagtcccgtttgcgcacgcagaattgggtctttaccagctttcncngttacagcagacaacaaattngcatggtaccagcagattggccttgctgaccatgcgcacgccatcgggcctccgagtgtcccncacngagtgagtcctggggcactccagtcgtcagccggtggcctctgtgtgcgcgctgtgagcccctctgagagagccggcttctgggacagacacccaccagtcgactgtgggcgcttgctgatccagcgagtgatctcccgtcatgtcaccacgcatgangtcatatccgagatgcgtttgttgagctctctgcgagcgcgacagatgagcaagctgattgcatgggcntcggtgaccgtgcgatgacccctgtatggggttgaccgcgtcccattgtgtccacgcctaggggcatggtcccctgccttgtcttctccttgtccatctggcctttcctcttttctcgcgcacactgactttcatatccctcggacgtccngtcgccacagggatcgcgctcacggacacactgattcacaattgccgacagaggattgacacgcgccacgttgcgctgcccgggtcgggggtagatggcgcggggctatgatgacggcaatgaaggtcgttcgtagtcgccagggttgctttagcttgtcacgttgggaccggtgttcgggggatgggctttaggtagcgtccgggtgttcgggattcttggcagcttggttagctcctaagggttgggccggaaggggccgttgggcgccaccggcggccctaggggccatgtcttcagccgagaggggacctatcgggaaggtcgtttggggtcggcccgccgttggtgtggtccccgtgaaggctgcgcgcgcggcctttacaaagggagaggggcgttggaggacaacagtcccccacagagatcaccttgagggccgcccggtttggaagcggagacccggcagtttgtgaacacaaaggccttaggaagggagggtctagtcggattgttgccgcgcacggtcccacagggggtggcaaacaatggtgggtgcccttcattttatggaaagggtgcaggccctggtaatacacaaaccgggcgagaacaggggtgataccccggtgtggttttgtaaaaaatttattatgagcacccaccccgggtagtaggaatttcatcagagccacgagatagtggcggctacaaacaacagaggagaggagggagagaaactcactatatatatccgccccccagtggatcactagactggagcaagcaagaacagagcaccactacctagttgtagagcagccaattcacg

SEQ ID NO: 482945 - DNA, 658 bp, Homo sapiens
  misc_feature (55)..(56): n is a, c, g, or t
aattactgcccagcagccgactaagttgcattccttgaatcttcgcagaaaagannattcttttaatcagagttagtaatgtggacagtacaaaatcgagagagtctggggcttctctctttccctgtgatgattaccatggtctgttgtgcacacagcaccaatgaacccagcaacatgtcatacgtgaaagagacagtggacagattgctcaaaggatatgacattcgcttgcggccggacttcggagggccccccgtcgacgttgggatgcggatcgatgtcgccagcatagacatggtctccgaagtgaatatggtgagtggcctcccgaggggcccggcggttcggcttacgcagatgggaaatggacaggtccctttgccctctgcgtttcattggcggtcacctcgcccctggcccctgaggtcccactccgcacccgctccccgctccggcacacacacccggtcgcccctggtttgtaatttcgacacacacgggctactgcggtgttccagggaaacgtgctcggcactattttgggaaggacgagtgactgttgcgccgtggatctgctggggcggagtctgagcgttactttagctgggtttccctgcgtgtttggatgaggagggcaccatctgctggcagccgg

SEQ ID NO: 482946 - DNA, 475 bp, Homo sapiens
  misc_feature (426)..(426): n is a, c, g, or t
gccagagtagctgggattataggcgcgtgcaccacaaccaactaatttttgtatttttagtggagacgggttttcgccatgttagccaggctggtcttgaactcctgacctcgggtgatccactgccttggcctcccaaagttctggaattataggtgtgagccactgcgcctggccttataagagtattttattatatgggcatgccatagtttatttacctgggcccttttgctcttttggttttttattgagacagagtctcactctgtcaccaaggctggagtacagtggcgtgatctcgctcactgcaccctccgcctcctgggaattaagcaattcttctgcctcagcctcctgagtagctggcactacaggcacactccactgctctctacccagaccttttgagggaaatttagttcnttctgtttaggttgcttctaaggtttttaaaacattgaccatcctgaat

SEQ ID NO: 482947 - DNA, 498 bp, Homo sapiens
cacgcgtccgctcgaactcctgagctcgggtgatccacctgcctcagactcccaagggctgggattacaagtgtaggccaccgctcctggcctttattttcttttccttttttatttttttttttagacgaggtctcattctgtcatccaggctggagtgcagaggcatgatctcagctcactgcaggctctgcctcccgggttcatgccgttctcctgcctcagcctcctgagtggctgggactgcagacacccgccaccatgcccggctattttttgtatttttggtggagatggggtttcgccatgctggccaggatggtctcaatctcttgacctcgtagtccgcccgccttggcctcccaaggtgctgggattgcagtgttgaagcccaccgcacctggcctattttcttttaatgagaacctcagccaggcgcggtggctcagccctgttgtcccggccctttgggaggccgaggcgggaggatcacttgag

SEQ ID NO: 482948 - DNA, 220 bp, Homo sapiens
gacaaaaagaagaaagataagaagaaaaagaaaggagaaaaggaagaaaaagagaaagagaagaaaaaaaggacctagcaaagcccctgttaaagctatgcaagaagctctggctaagcttaaagaggagaaaaaaggacggaaaaaagaaaaggaaaaccgtataaaacggttggaaaaataaaaacccaaccgtaaagaaaaggaccgatgggaccag

SEQ ID NO: 482949 - DNA, 1020 bp, Homo sapiens
  misc_feature (360)..(360): n is a, c, g, or t
  misc_feature (378)..(378): n is a, c, g, or t
  misc_feature (458)..(458): n is a, c, g, or t
  misc_feature (548)..(548): n is a, c, g, or t
  misc_feature (573)..(573): n is a, c, g, or t
  misc_feature (641)..(642): n is a, c, g, or t
  misc_feature (646)..(646): n is a, c, g, or t
  misc_feature (654)..(654): n is a, c, g, or t
  misc_feature (727)..(727): n is a, c, g, or t
  misc_feature (779)..(779): n is a, c, g, or t
  misc_feature (798)..(798): n is a, c, g, or t
  misc_feature (809)..(809): n is a, c, g, or t
  misc_feature (827)..(827): n is a, c, g, or t
  misc_feature (842)..(842): n is a, c, g, or t
  misc_feature (858)..(858): n is a, c, g, or t
  misc_feature (862)..(862): n is a, c, g, or t
  misc_feature (877)..(877): n is a, c, g, or t
  misc_feature (896)..(896): n is a, c, g, or t
  misc_feature (909)..(909): n is a, c, g, or t
  misc_feature (949)..(949): n is a, c, g, or t
  misc_feature (999)..(999): n is a, c, g, or t
  misc_feature (1020)..(1020): n is a, c, g, or t
gattgagcactgaatcccaaccgctccactggcattgcagatctgacgtggattaggaagaagatatgaaagagcgtctagattgcatcacctgagacataaacgtacttttcatagggtatggagagagaccgacgttggatgaacatgcatagaggcggggtgtagcaacgacattgagaagaaacctcgattccaggttaaaccataaatgcagtaggtagctaagacatcgttatgcatgtctgagcaaaagagagtcctgactgaagtgaatcgtctctcacctgagacgactccagtaggttcgaggtaagacgtagacgctttgcagtggacgtacttatagaccacacgttntaactaatcttactcaangatatattaaaaaagaggtaatccacagaggacaacatatatcaaccatccgatggagcacgtagagatacacgaaaatnatcgctagaagaatacatcgtagacaaactgctcattagcagaatgttctctaacaattcgcatgctggaggacaaaatcgtcgcggctngatactgagaactatttgaaccttntatcacatctcaggttaaatgactcgtgttcgtggttgtccctggtattggttggcgagggattagcnntcantactactngattaacgcaatgataggaccaaaacaaaaccctgttaacctctatctccataattataattaacaccacaancatggaacgacactaactattctccagtgagagacgattcggtaaagctaanttatcctatatgacaactntcctacattanttcacctcgttggggaantagtactcccatggngcttaggttgcttacnttcntaactataccatccntggtgccaggtaaggcttntctgaccacattnttctactgcaagaatctgctgggaccatattctggctccnatccaggctatgcgactgtgtaacctttctggaacctagaaatccattcntccattaacaggcacacggcn

SEQ ID NO: 482950 - DNA, 139 bp, Homo sapiens
ggcccgcattcatatgatgaacacatggcagccatgacaggtaatttttcctcacaacagtgcatggctcaaaataaagatctaacaacgatctagtgaacactgcactgcaacgtcaaggtacgtatctatccctgaa

SEQ ID NO: 482951 - DNA, 260 bp, Homo sapiens
tgatctagaggatcccttaatcctaagattgcgtgccctctatggggaagtagaacagttggcaaatgaaactttgtggcatacatttaccagaagaggttcacccgtgctatgaggaggctttattaggtagctctgatgaatatgcagtcttaattaaagcagcagatacgatgtcagcatttatgaaatgcgtcacagaaaaagctgcgggtaatgatgaatttaatgcagcctatgacagtatttataaacgttgg

SEQ ID NO: 482952 - DNA, 571 bp, Homo sapiens
cgaggatctcatggtagtagatataatcccttccgttataaagtactagtcaagaacttacactataccaggcattcttgttaggtatccaggatgcctcaagctcagtgctatggacagttcggaataaatcattctctgtagtgaggaaactgttctgtgcatgacaggacattcagcaccatccctgggctctacccactaaatgtcagcagtacccctcgatcctcgctaagttatgagaagcgaaactgtctcctgacttagccagatatccccaggaaacaaactggacgtctggttacgaagccactggactagatacacaaaaagtgccctgcctactagttgcaatatatgttttatgctccttaaggacagtcagtcctcaaaaactcagtgcattatctggcgtacaggttgtcaaacctcctcttctccatggctgggctactgctgacttctgaccaagtggaggaggttgcgggggttctgggagcatccagttccttactctcagttatgctgtctaagtctctcatcatatccattagcattctgatctttaaga

SEQ ID NO: 482953 - DNA, 143 bp, Homo sapiens
cccccctattttttaaaaaaaccaagttttaaaaatttggtttcaaggggacatgtgtgaaaccaaaattgtatccccccaaagtgacccctgattttttaaaaaaaaaaataaatgttttgggggggttctgttttccccca

SEQ ID NO: 482954 - DNA, 82 bp, Homo sapiens
accctctgccgatggcatttgtgtttttgatatttgtgtctgttactacttttttaatacaaaaagataaaaacgccaaaaa

SEQ ID NO: 482955 - DNA, 930 bp, Homo sapiens
  misc_feature (121)..(121): n is a, c, g, or t
tggaaacagagtttcactcttgggtcacccagggctggagtgtgcaatgggcacgatctcagcttcacgtggaaacttctgtgccttcccagggtccaaggtgattctccgtggcctcagnccttcccaagttagcgtgggattacggggtgcccaccaccagcgcccagcttaagttttttaggggattttaagatagagacaaattttcaccagcgttgggccagggcgggtcttaaactccgtgacctcaaggtgatccacccaggtttagcctcccaaaggggcggggattccggggcggtggagccaccaggtcgggggctcaaatttcctcttcgtggtaagaaacaccgagtcatattgagactcatccattctaagagaacttcatttaaatttaatttacctcttataaagacccgggtatcccaaataccatcacactcagaagtactggggggtaagggcttcaacataggacagtggaccaagggtgaggggataggcgtgcaacacagtacatcccaattggaggctcttaaccagtccatgcaggacatgggacacaggtcagggaaattcctgggaagtcggggacacttggaagacacatttaaccatgaaagccttgcgcatgcccctatagagagtcaccacggggccacaaggtagaacacaccgcgggtgggaaggggggaaagagggatcacaagaaacactcgggaaacctgtagagaggcctcaaatgggttgacaacactctcataaaaaaacatgactccgcgtgaatagcagacccgtgaagcacgagggtataaagacggtgtggcaccaccaaagagaacggagacagcagggagagatagcaagaacagtatcatgcgacaaacaggtgaaacaagggaagggagcccacgaaagagtgcc

SEQ ID NO: 482956 - DNA, 296 bp, Homo sapiens
  misc_feature (179)..(179): n is a, c, g, or t
  misc_feature (206)..(206): n is a, c, g, or t
  misc_feature (209)..(209): n is a, c, g, or t
gggttcacacgccggtccccgcgcggacagtggacgcgagcgtcccccccgcgggcggcgccccttacagggccgagtcggagtcgctggagtccaggctgttcatcagtttgcagctgttgagctgctcccgctgcagcgacaggctatgcgtgctgcggcgcaggcactccaggctntgcaggaacgacttcttggccttctcntcntccatgggggacaccccctcctcctccacctcctggatctcgtcgaaggtcaccggatgcgtcttgaagcgagactggcgcggccgc

SEQ ID NO: 482957 - DNA, 714 bp, Homo sapiens
  misc_feature (132)..(132): n is a, c, g, or t
  misc_feature (164)..(164): n is a, c, g, or t
  misc_feature (257)..(257): n is a, c, g, or t
  misc_feature (283)..(283): n is a, c, g, or t
  misc_feature (298)..(298): n is a, c, g, or t
  misc_feature (304)..(304): n is a, c, g, or t
  misc_feature (308)..(308): n is a, c, g, or t
  misc_feature (311)..(311): n is a, c, g, or t
  misc_feature (347)..(347): n is a, c, g, or t
  misc_feature (359)..(359): n is a, c, g, or t
  misc_feature (379)..(379): n is a, c, g, or t
  misc_feature (405)..(405): n is a, c, g, or t
  misc_feature (428)..(429): n is a, c, g, or t
  misc_feature (441)..(441): n is a, c, g, or t
  misc_feature (482)..(482): n is a, c, g, or t
  misc_feature (498)..(498): n is a, c, g, or t
  misc_feature (506)..(506): n is a, c, g, or t
  misc_feature (517)..(517): n is a, c, g, or t
  misc_feature (580)..(580): n is a, c, g, or t
  misc_feature (615)..(615): n is a, c, g, or t
  misc_feature (624)..(624): n is a, c, g, or t
  misc_feature (714)..(714): n is a, c, g, or t
taaataataggccctcagttaatacccttcagttattgaattaatctagtttgtggaatgaggtgtatcctgccaacttccctctgctcccaagtacactctgagaggtaaaatgctctgggaaatggaacnagaatcgagtggatgctgactctgtgtgcccncctcctcccctgcttgataatggttgaccttgggcaagtcacttctttccatgcctccgttccccatctgtcaaatggggttaataatactgncctacctccccggggtgttgttgtgnggccttgtcaatccnagttantagnctncttccgggtcctctgtggaggctgtcttgcgcccgngtttccgcctgncccccaggctttggtcctcnctgagctgtctccccgactggcactncttagtgactcggcccattttcnncccccccccccncctccaagctgctagttcagatgttgaccgtgttttcctgnatgttggcatcttacnagtcccgncttccttcggntgttgtttgggaaggcacttgggattttctgtgtcttgccttcacagagggaggccatttcanattcaagagcattggattagggaatcgtgaggcanggatgctantgcgtatttctctctgcaggttggggattaaagttcctttccccatgggtttgaagcagactcagactgtctcaggatcaaagcaacccn

SEQ ID NO: 482958 - DNA, 271 bp, Homo sapiens
cgggttggatgttggggggaaatggggacgggttaccattttcccccgggaaccggtttgacatggtttcggattttaatcggccccctaaaagggaattgggcccccagggccaaaatttgggcccagggttcccccacttccaagaggagggaggctaattaaaggccggtcctaattcacgttttcgtagaagggggttccaacctccccttaaccggaaacggggtaggaccccccttaaggccggtgggcctttttaaagggccaa

SEQ ID NO: 482959 - DNA, 328 bp, Homo sapiens
ggcgtgaacccgggaggtggagcttgcagtgagcagagacagcgctactgcactctggcctgggcaaaagagcaagattctgtctccaaaaaaaaaaaaaaagaaagaaattgcagatttccacccggcacgggggctcatgcctgtaatctcagcacttggggaggctgagacagggtggatcacctgaggtcaggagttcgagaaacagccgttggccaacattggtgaaaccccgggttctatttaaaaattacagaaatttagccagggcgtcggtggtgagagtgtgacagcattgctgggcagcccttcgcttcgctctcgg

SEQ ID NO: 482960 - DNA, 2965 bp, Homo sapiens
tctctgagcatcggaccctctgccattccaacctctcatgccgaggcccgtcctgtcagtcactgctttttgtcatcggcttggcaaacgggagagcaaacgaagcttcatgggaaacagcagcaacagttgggttctccccagggaggaagcacaaggctggatgggccaggctgtgcagggagggaccaggacaagcaggtcccatgcatcattccccaagctggagctgggcctgggacaccgtccctccccaacccgggagccgcccacctgctccatctgtctggaaaggcttcgagagcccatctcgctggactgtggccatgacttctgcatccgatgcttcagcacacaccgcatcccaggctgtgagctaccatgctgtcctgaatgccggaagatctgtaagcaaaggaagggcctccgcagtctaggggaaaggatgaaactcctaccacagcggccactgccccctgcactgcaggagacctgtgctgtgagggcagaacgtctgctgttggtacgaatcaatgcctccggaggcctcatcctcaggatgggcgccataaaccgttgcctgaagcatccactggccagggacacacccgtctgcttattggctgtcctgggagagcagcactcaggaaagtccttccttttggaccacttgctcagtggcttaccaagcctggaatctggtgacagcggcaggcccagagcagaggggtctctgcctgggatcagatggggcgctaacggcctcacgaggggtatctggatgtggagtcaccccttcctgctgggaaaagaggggaagaaggtggctgtgttcttagtggacacgggggatgtcatgagcccagaactgagcaaggagacaagggtcaagctctgtgctctcaccatgatgctcagttcctaccagatcctgaatacctcccaagagctgaaggataccgatctgggctatctagagatgttcgttcacgtggctgaggtgatgggcaaacattatgggatggtaccaatccagcatctggatctcttagtccgagactcttcccatcataataagtcagggcaagggcacgtgggtgacatactccagaagctgtccggcaaataccccaaggtccaggagctgctcctcgggaaacgggcccgctgttacctcctccctgctcctgagaggcagtgggtaaacaaagaccaagccagccccagaggcaacacagaagatgacttctcccaccatttccgggcctacatcttggacgtgctgagcacagcccctcagcacgctaagagccgctgtcaagggtactggagtgaggggcgtgccgtggccaggggagacagacgcctgctcacagggcagcagctagcacaggagatcaagaatctctctggctggatggggaagactgggcccagtttcaactctcctgatgagatggctgctcagctccatgatctgaggaaagtggaagccgccaagaaggagttcgaggagtacgtgagacagcaggacatagccaccaagcgcatcttctctgcactacgagtcctgcctgacacgatgaggaacctcctctctacccagaaggatgccatcttggcccgccatggtgtggccctgttgtgcaaggagagagagcagaccttggaggccctggaagccgagctgcaggcagaagccaaggccttcatggactcctacacaatgcgcttctgtggccacctggccgcggtagggggcgctgtaggtgctgggctcatgggcctggcagggggtgtggtgggcgcaggcatggcagcagcggcgttggctgctgaggctgggatggtagcagctggggccgcggtgggggccaccggggctgctgtggttgggggtggtgtgggtgctggtctggccgccactgtgggctgcatggagaaagaggaagatgagagagttcaaggaggggaccgagagcccctactccaggaggaatagcagcaagatgtcgaagcgtgaaatacgtgaaaggcagtaggaagggtgcggacatcagggactcagaggggaccacgtatatactggccttgttgaatgccccatgtcaaacactggctgagctgggggtttacggtgggtccagaaacctgaggaggctttctggccacgaggctgtacttggagtacagcggatagggtgcaaggcctgtttctggctctggataattgctactctctggaacctaggatctcccaccacataaggccccacctcctctacccagttccagtttatttccctggagggcctgggctggaaatttgcccctggatccagaaccccattcgttttacagttgggataggtcccagcataactgactttggagctaggagccccgctaacagggaagaaaaaggaggggtcacagagcagggatggggatgatagacagagctataattctggagtggtgacttgtttccaaaactgctccagaaggccaggcttggctggcctccctgctcttcagttgggtgtccagatgtgtgtcctgaaccgccctgtaccccagcctcctgcagtcctcctaagcctgtgccctgtgccaagcccatttggatggatcaacacagattacatgccaaagaaccacacctccgattgcattctgtgctaaagcagtccgtgccaggttctgccaaagtgtgggaagggaaagtgcaggaaacgagctccgtcttttaacataagcttgagctgtggggcctctgcgccacactgtaagacccccttgatgcagccctctgaacgccaagcctccagaaagcttgtgggcagggggcctctctcgggggatggagatttctaaagagacttctgggctgttaaactataaaagatgttgggcatatgaccctttattttatataaaaataaaatgtgtgcgtgtgaatggt

SEQ ID NO: 482961 - DNA, 120 bp, Homo sapiens
gatggtgctgagagtcaatgacacggagaggaaacgcttcgtgcctgctgacggacagctgccggcctgtgcagtgtagcatgctgcacacgagtgagtggcagctgtgctgtgtgccca

SEQ ID NO: 482962 - DNA, 419 bp, Homo sapiens
aggtcagccgagctcctccatgaggcagcatctggatctgccgaggagtataggtgggccagcagctcgtggtggatgaaggccttcgtatggtatgatcatgaggtgcatgaaggtctttgggatgaggtcgcggatggacttgttgattatggccacgtatgagtccatcaggttgcgaatggtctccagctgccgctccagttgggggtccatggagaaggtgttctcctgggccccatcctcgtattctgcctggtccttctcggggtagacgccagctcggaggaccgaggccttccagctgtccacgtcttcctgggagtcaccggccagctcgatctgccgcatgtccttgtagacgtttctctgctccgtgtagaggatggcgaatacgtgcttgttggacgtgaagccct

SEQ ID NO: 482963 - DNA, 402 bp, Homo sapiens
  misc_feature (298)..(298): n is a, c, g, or t
agctaccttccagacctacttctctgcggagtggcacacatcattttctcacttaggaaaatactaaatgtgtcaagagcccattgcttccaggaagtcacagtgagctaaaagaaatataggctaaagaataatccactggcttgtttaccttttgggcagctcaccacaggactctgggtttatttggagaaatctgcctttgataaacttttggtcttggggtgatattaggtgctattttcaagaggtccagaatgactgggagaggcacgataagatgacaaattttgagccncacaacaattttttggttactacagaggtaaccaaagatttcacttgcaaatgctttttgtgagccagtgtataaaagtagatatttttaaaataaatgtttac

SEQ ID NO: 482964 - DNA, 232 bp, Homo sapiens
cgctagcgcttaagtgaacggccctgccagggccccaatctctccaccagccaggcttggcctgggggacttttaattatgctgaggtccagtgcaccccagatctacaccagaatctctgagggtgggactcaggcatcggccttttggaaaagtctacacgtagtaataacactcagctgaagcatggggagacatgtgcaagccttcgttcacttaatgccgctagcgc

SEQ ID NO: 482965 - DNA, 11720 bp, Homo sapiens
  misc_feature (603)..(603): n is a, c, g, or t
  misc_feature (618)..(618): n is a, c, g, or t
  misc_feature (676)..(676): n is a, c, g, or t
  misc_feature (685)..(685): n is a, c, g, or t
  misc_feature (1078)..(1078): n is a, c, g, or t
  misc_feature (1116)..(1116): n is a, c, g, or t
ttttttttttatagtgcatgcaggaaattgcaattttatttatgtttgtattgatacatatttgtacatatttatggggtgtggtagtttgatatatgcatacaatgtgtaatgatcaaatcagggtgtttaggatatctatcacctcaaacatttatcatttttgtgtttggaacatttctaatctcctagttattttgaaatatataacatattgttaactatagtcaccctactgtgctatcaaacacttgaacttattccttctatctacgtttgtacccattaaccaatctcttccctccctcccccaactccaccttcccagcctctggtacttatctctactccatgagatcaactttttaagctcccacatgagtgagaccatgggatatttgtctttctgtgccagacttatttcacttagaataatgacctccagttccgtaagatgggcagccaggaaaggccttacttagctgatgtttgaattgtgaagttatgtaatcattaagatgagtatacatacaatgggccagctgagtgcacagcaagattcaataaattcaaactaacattactcttattgccaagagagtncctgaaatgacagcncattggaaactggctactttccttccctttccttaggggtttaaggaaagcatgagtnatttcagtnttttgctggagctcctcactgacactcattgcagagcctgagccctcaactctcaatctttgcttaggtcctggcttaggctccactttgtaagaggcaccttcctagtattcactactctctctctcacaatcatgtccttacagacattgctgatcctctttcatactgacaccgggttctagtccgagttccatcactaagtcgctgtttgactttgggcaagttacttctgtggttaattatttttcatcaacaaaatcaaaaggtgaaactagacgaacaactaagaggctccagtattttttcaatctaagagtcccatatcccccactcccttctcacagctcattcaacaatcctaatggcagcgggtgcccgcagtctcaagtntctgccgaagcccaagccgctgtctcggtcagtcacanccgacgaagaggaggaattggaggaagccagcataaccacctcacactgagaacatctgacctttcccagaacgcccgcccactcgacacttcctgtccctccccagatcttgttccggggcacctactcgggtctaatcactcccctcattcactctttagggtccattgctgtttctttgaggaagcggagcatcttctgtcgttgattggtttccgtcattgttgataggttggtaacaaacaaggtgtgcctggtctcctggtaacgtcctgccgatagtcctgattggtcggtgtcttaatcccatcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcag

SEQ ID NO: 482966 - DNA, 11748 bp, Homo sapiens
  misc_feature (603)..(603): n is a, c, g, or t
  misc_feature (618)..(618): n is a, c, g, or t
  misc_feature (676)..(676): n is a, c, g, or t
  misc_feature (685)..(685): n is a, c, g, or t
  misc_feature (1078)..(1078): n is a, c, g, or t
  misc_feature (1116)..(1116): n is a, c, g, or t
ttttttttttatagtgcatgcaggaaattgcaattttatttatgtttgtattgatacatatttgtacatatttatggggtgtggtagtttgatatatgcatacaatgtgtaatgatcaaatcagggtgtttaggatatctatcacctcaaacatttatcatttttgtgtttggaacatttctaatctcctagttattttgaaatatataacatattgttaactatagtcaccctactgtgctatcaaacacttgaacttattccttctatctacgtttgtacccattaaccaatctcttccctccctcccccaactccaccttcccagcctctggtacttatctctactccatgagatcaactttttaagctcccacatgagtgagaccatgggatatttgtctttctgtgccagacttatttcacttagaataatgacctccagttccgtaagatgggcagccaggaaaggccttacttagctgatgtttgaattgtgaagttatgtaatcattaagatgagtatacatacaatgggccagctgagtgcacagcaagattcaataaattcaaactaacattactcttattgccaagagagtncctgaaatgacagcncattggaaactggctactttccttccctttccttaggggtttaaggaaagcatgagtnatttcagtnttttgctggagctcctcactgacactcattgcagagcctgagccctcaactctcaatctttgcttaggtcctggcttaggctccactttgtaagaggcaccttcctagtattcactactctctctctcacaatcatgtccttacagacattgctgatcctctttcatactgacaccgggttctagtccgagttccatcactaagtcgctgtttgactttgggcaagttacttctgtggttaattatttttcatcaacaaaatcaaaaggtgaaactagacgaacaactaagaggctccagtattttttcaatctaagagtcccatatcccccactcccttctcacagctcattcaacaatcctaatggcagcgggtgcccgcagtctcaagtntctgccgaagcccaagccgctgtctcggtcagtcacanccgacgaagaggaggaattggaggaagccagcataaccacctcacactgagaacatctgacctttcccagaacgcccgcccactcgacacttcctgtccctccccagatcttgttccggggcacctactcgggtctaatcactcccctcattcactctttagggtccattgctgtttctttgaggaagcggagcatcttctgtcgttgattggtttccgtcattgttgataggttggtaacaaacaaggtgtgcctggtctcctggtaacgtcctgccgatagtcctgattggtcggtgtcttaatcccatcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgtgagtagttctgttctgatttaaactggaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcag

SEQ ID NO: 482967 - DNA, 837 bp, Homo sapiens
gaacagtatctgactgtggcatgaatctcagttaacaaaaaagcatatccaaatcaccctttaatattaaaatatctgtgcccttaaagggctgatgaaaaccagaagacagcaaatacaactgggaccaaaacaaacacatatcagaatgtctggtattcacatgtttcctctgtatctcagggtgaatcacatgtagtactattctagggacttccaaaatagcatggttaactgttacactgtggcatgggaatccaacctcttggcattaactggtatgagagggctatctacacgggtacatatttctgattaccctggtttcacagaaacctccagcagtcttggaacacatctacagatgactctagtacatggactggctttcaaatggtaaacagggtacctggtcgatcagctcatagtgggctgcctcatagaaccaatccttccaaacctggagaccatggctacatacgagcggcacggcgaacaaagagcgcgcataaaagctcacaacgacaccggatagcggacaaacacaacgagacagcatacaccccctaggaacacacaagaaacaaaagtcccaaaccaggaaacagggcacggcccgataagccatacgggtcatcactcaaccaggtaaaacgagcacacagcccggccataccgcagacattgaccacacgagagcacacaggggcagaacgcaccacacgggcggggacacaaacaattacaaaagcgcaccaggcacggcatttgaagacaccatcgcacagacgacaacccgccgcgaacacacaaccaacatactacccccaggccaca

SEQ ID NO: 482968 - DNA, 2058 bp, Homo sapiens
  misc_feature (603)..(603): n is a, c, g, or t
  misc_feature (618)..(618): n is a, c, g, or t
  misc_feature (676)..(676): n is a, c, g, or t
  misc_feature (685)..(685): n is a, c, g, or t
  misc_feature (1078)..(1078): n is a, c, g, or t
  misc_feature (1116)..(1116): n is a, c, g, or t
  misc_feature (1893)..(1893): n is a, c, g, or t
ttttttttttatagtgcatgcaggaaattgcaattttatttatgtttgtattgatacatatttgtacatatttatggggtgtggtagtttgatatatgcatacaatgtgtaatgatcaaatcagggtgtttaggatatctatcacctcaaacatttatcatttttgtgtttggaacatttctaatctcctagttattttgaaatatataacatattgttaactatagtcaccctactgtgctatcaaacacttgaacttattccttctatctacgtttgtacccattaaccaatctcttccctccctcccccaactccaccttcccagcctctggtacttatctctactccatgagatcaactttttaagctcccacatgagtgagaccatgggatatttgtctttctgtgccagacttatttcacttagaataatgacctccagttccgtaagatgggcagccaggaaaggccttacttagctgatgtttgaattgtgaagttatgtaatcattaagatgagtatacatacaatgggccagctgagtgcacagcaagattcaataaattcaaactaacattactcttattgccaagagagtncctgaaatgacagcncattggaaactggctactttccttccctttccttaggggtttaaggaaagcatgagtnatttcagtnttttgctggagctcctcactgacactcattgcagagcctgagccctcaactctcaatctttgcttaggtcctggcttaggctccactttgtaagaggcaccttcctagtattcactactctctctctcacaatcatgtccttacagacattgctgatcctctttcatactgacaccgggttctagtccgagttccatcactaagtcgctgtttgactttgggcaagttacttctgtggttaattatttttcatcaacaaaatcaaaaggtgaaactagacgaacaactaagaggctccagtattttttcaatctaagagtcccatatcccccactcccttctcacagctcattcaacaatcctaatggcagcgggtgcccgcagtctcaagtntctgccgaagcccaagccgctgtctcggtcagtcacanccgacgaagaggaggaattggaggaagccagcataaccacctcacactgagaacatctgacctttcccagaacgcccgcccactcgacacttcctgtccctccccagatcttgttccggggcacctactcgggtctaatcactcccctcattcactctttagggtccattgctgtttctttgaggaagcggagcatcttctgtcgttgattggtttccgtcattgttgataggttggtaacaaacaaggtgtgcctggtctcctggtaacgtcctgccgatagtcctgattggtcggtgtcttaatcccatcttccgtcccaactgctagtggctgagtccctggcggggcgcggcggtggaaggtgtcgcgtacgggcttcccgagctgacgtggcttgaattgggaggggggcagctggagcctcaggcggcagcgcttctaggtgagtaggggacgctacccaactcttccctctgcgagtccaataacggtcacccccgccagaggggccgcgggagctgcccaagcagctacaccggagtcccctcctcgccccagcctctcccggattcagtcctggatccggcccttcacccgcctccttcacctaccaggcctagttctagtagcccacaagcctcggcctctccggtgggccttcggggtcaccctgcgcagacttggaccacttgctcacggtctgtcccctccccggtacgtttctcctctgggagcgacggggaaaagcgcctaggtcagtcctgtccgcacgcnttgttcctggagcggcctgcctaagtcggcctccgtacgcagccgctgacgtcggaaagaacctgctgggcccctgtgctcaggccctaaacaaacttggtgtcccgaaggggaggcgcgaccaaaagaaatcaaaggtctttagggcggagatcacagaatcat

SEQ ID NO: 482969 - DNA, 443 bp, Homo sapiens
aaattgccactactgcttctgtcttcttctgacaaataaaattttgataatgcatgcaatttccttttgggttcaatggaaactagaaggaaatatggtaggcatttaggttaagcaagaaagggaggtcaaagaattaataatgctcattcttttgcttaaataattttttttccttctatgtcttcggtttgataagagttctacagagatggaagaatttgtaatgatgaagcaacagctccaggagaaggaagaattcattagcactttacaagcccagctcagccagacacaggcagagcaagctgcacaggtagggacctcacaaaattaggataaagagctatgaagtccagtgggttattacgcacaagtcaattcagtgagccgagatggcaccattgcactccagcctgggcaacaagagcaaaactccatct

SEQ ID NO: 482970 - DNA, 1558 bp, Homo sapiens
taaaaaactttggaaaataaaaagggaaatgttgcccttttttggggagtgtgtgtgaaaggtgtgtgtgtgtggggactttgtctctaatatttataggtttctcccaataggaaggtggtaaaactctttgtgttggttatttctctctacaatataaaaaacactatttggggattaattaaaagacgtgtaattagaggggatatttctctttatgagggcgttctataaataaattgtgtgtggtgtggtacacgagtatagagtgttgtgtgagggtgtgcgtttataacatatatatctcctatattcttatataaagagatgtagaaaatgtgttttgtgcggattttataaaatgtgtggggcgaaaatgtttagtcaacatatatagagtatttataaagactctatataaatatatatatgagaaaagagtcattaagtgtgtgaaaaaagagaggggggtataaaaaataacagattaataaaatgagtgtgagaggaggggtgtgagaaagagaatattatgggagagaaagatatataaaaagtgtgatgtttatttaaacacccacgcgatgcgagttgttctcgctggggatgcacaacaccgcggcgagcaatattacgagcaagaaccataatacatttatccacaaatatagaagctactcagaggagaaaatatatttcgacgcgagaatattttctgagcgaaacaacaagcaattattatttgaagggggggaattaatctctaatggggaacacgccaggagcgagcgagaaaataatacccccacaaatataaaaaaatctcttacaccaaactcctttgggccaaaacaacacaaaacatacatcaataaataaaacaaaaaaaacaaacaaacaaaaaaaaacaaaaactaacaagaaaacaacataaaacacaaaaaacaaccaaaacatacaccaatcgacaagagggggcgagtcgcaatcactcacataataacaatacctacactcagtcgaagaacgtaaaactaccagcaagacaatagagcagacaagacacgaaagtactccgagtcaagcagcgaggaagagagagtcacacagaaagagaagaaggagagaagaataaaaaaaacaaagggaagagaggatggcgagacacaattaacaacaaagcagcgagagagagagcagaaaaatctgtaaaaaactacaatgagttcatgatgaagacagagacagcaactatcggggaggaaggaataacaagaaagaagaaagaaagacagcacagggggcaggcagagctagcaggagaggaaataacaacacgtgagctgagattgaggagcgacacaccagcctgtctcggcgcggagagggaggacagcggagcgtgataagaaattaaaggggcaaagagagcaacgaaaggagggcggcaggcggcgggtgtgctgcaggcgcacggcgccgacgcgaccaccacttgtcactacccgcgacccgccggtagaccaaccgagcactaaccgcgcaactgcgtactgac

SEQ ID NO: 482971 - DNA, 10154 bp, Homo sapiens
  misc_feature (603)..(603): n is a, c, g, or t
  misc_feature (618)..(618): n is a, c, g, or t
  misc_feature (676)..(676): n is a, c, g, or t
  misc_feature (685)..(685): n is a, c, g, or t
  misc_feature (1078)..(1078): n is a, c, g, or t
  misc_feature (1116)..(1116): n is a, c, g, or t
ttttttttttatagtgcatgcaggaaattgcaattttatttatgtttgtattgatacatatttgtacatatttatggggtgtggtagtttgatatatgcatacaatgtgtaatgatcaaatcagggtgtttaggatatctatcacctcaaacatttatcatttttgtgtttggaacatttctaatctcctagttattttgaaatatataacatattgttaactatagtcaccctactgtgctatcaaacacttgaacttattccttctatctacgtttgtacccattaaccaatctcttccctccctcccccaactccaccttcccagcctctggtacttatctctactccatgagatcaactttttaagctcccacatgagtgagaccatgggatatttgtctttctgtgccagacttatttcacttagaataatgacctccagttccgtaagatgggcagccaggaaaggccttacttagctgatgtttgaattgtgaagttatgtaatcattaagatgagtatacatacaatgggccagctgagtgcacagcaagattcaataaattcaaactaacattactcttattgccaagagagtncctgaaatgacagcncattggaaactggctactttccttccctttccttaggggtttaaggaaagcatgagtnatttcagtnttttgctggagctcctcactgacactcattgcagagcctgagccctcaactctcaatctttgcttaggtcctggcttaggctccactttgtaagaggcaccttcctagtattcactactctctctctcacaatcatgtccttacagacattgctgatcctctttcatactgacaccgggttctagtccgagttccatcactaagtcgctgtttgactttgggcaagttacttctgtggttaattatttttcatcaacaaaatcaaaaggtgaaactagacgaacaactaagaggctccagtattttttcaatctaagagtcccatatcccccactcccttctcacagctcattcaacaatcctaatggcagcgggtgcccgcagtctcaagtntctgccgaagcccaagccgctgtctcggtcagtcacanccgacgaagaggaggaattggaggaagccagcataaccacctcacactgagaacatctgacctttcccagaacgcccgcccactcgacacttcctgtccctccccagatcttgttccggggcacctactcgggtctaatcactcccctcattcactctttagggtccattgctgtttctttgaggaagcggagcatcttctgtcgttgattggtttccgtcattgttgataggttggtaacaaacaaggtgtgcctggtctcctggtaacgtcctgccgatagtcctgattggtcggtgtcttaatcccatcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcag

SEQ ID NO: 482972 - DNA, 437 bp, Homo sapiens
  misc_feature (425)..(425): n is a, c, g, or t
tccactccgatcagcacacatggttcgaactaaagcctgccgctcagggctaaattcctggggcaaactttttagggtttcctccaaacaatttggattttaaaccttcccccccccgcccttttgttcccccctggttaaccccaatttcaaaaaaaaaaccccccccccaaaaaaaaacttgcaaaattcccccccgggaaaaccacacaggggcccccaaaaaaaaaaaaaaaaccccctttttttttaaaagaaaaaagaaaaaaaaaaccgtggggaaaaatttcccctttttttaaaaacaaaaaacaaccctttggtgggggttttttttttttttaaaaccccggtggaaaaaaatccgggttttaaagaggggcccccccctcacccacccgccaaggggggggggtcaattttcncggggggggggg

SEQ ID NO: 482973 - DNA, 10266 bp, Homo sapiens
ctcggtacccggtgtttatcgatgccacgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcag

SEQ ID NO: 482974 - DNA, 184 bp, Homo sapiens
acagtgcaggagaaaactcgagtagtctgctttgcggactctaacccaccggcagagtattcttggacaattaatgggaagtttcagctatcaggacaaaagctctttatcccccaagagttactacaaatcatagggggctctatgcttgctctgtgcgtaactcagccagtggcgaggctag

SEQ ID NO: 482975 - DNA, 350 bp, Homo sapiens
  misc_feature (350)..(350): n is a, c, g, or t
aataaggttgttggtaatgttttggacatcatcagttatgagtagggattgtggagtgaaaataattctgtcaagccactgataactaagagaaacatttaattgtttggtagttttattcctcaggatcatgattcttattttactcatacatgaagacatagtcagaagatatacatacactcattttatgattgattgtagatgcatttatatgtcttcaatcacgacaataatcatattttctcattatacctataatcaatagtctgatgacaatatgcttggtgacattagctttgctgtatcttttagcagatctctgagtttctttcagctagcttctaccn

SEQ ID NO: 482976 - DNA, 11915 bp, Homo sapiens
  misc_feature (603)..(603): n is a, c, g, or t
  misc_feature (618)..(618): n is a, c, g, or t
  misc_feature (676)..(676): n is a, c, g, or t
  misc_feature (685)..(685): n is a, c, g, or t
  misc_feature (1078)..(1078): n is a, c, g, or t
  misc_feature (1116)..(1116): n is a, c, g, or t
ttttttttttatagtgcatgcaggaaattgcaattttatttatgtttgtattgatacatatttgtacatatttatggggtgtggtagtttgatatatgcatacaatgtgtaatgatcaaatcagggtgtttaggatatctatcacctcaaacatttatcatttttgtgtttggaacatttctaatctcctagttattttgaaatatataacatattgttaactatagtcaccctactgtgctatcaaacacttgaacttattccttctatctacgtttgtacccattaaccaatctcttccctccctcccccaactccaccttcccagcctctggtacttatctctactccatgagatcaactttttaagctcccacatgagtgagaccatgggatatttgtctttctgtgccagacttatttcacttagaataatgacctccagttccgtaagatgggcagccaggaaaggccttacttagctgatgtttgaattgtgaagttatgtaatcattaagatgagtatacatacaatgggccagctgagtgcacagcaagattcaataaattcaaactaacattactcttattgccaagagagtncctgaaatgacagcncattggaaactggctactttccttccctttccttaggggtttaaggaaagcatgagtnatttcagtnttttgctggagctcctcactgacactcattgcagagcctgagccctcaactctcaatctttgcttaggtcctggcttaggctccactttgtaagaggcaccttcctagtattcactactctctctctcacaatcatgtccttacagacattgctgatcctctttcatactgacaccgggttctagtccgagttccatcactaagtcgctgtttgactttgggcaagttacttctgtggttaattatttttcatcaacaaaatcaaaaggtgaaactagacgaacaactaagaggctccagtattttttcaatctaagagtcccatatcccccactcccttctcacagctcattcaacaatcctaatggcagcgggtgcccgcagtctcaagtntctgccgaagcccaagccgctgtctcggtcagtcacanccgacgaagaggaggaattggaggaagccagcataaccacctcacactgagaacatctgacctttcccagaacgcccgcccactcgacacttcctgtccctccccagatcttgttccggggcacctactcgggtctaatcactcccctcattcactctttagggtccattgctgtttctttgaggaagcggagcatcttctgtcgttgattggtttccgtcattgttgataggttggtaacaaacaaggtgtgcctggtctcctggtaacgtcctgccgatagtcctgattggtcggtgtcttaatcccatcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcgtggagacagggtttcaccatcttggccaggctggtcttgaactcctgatcttgtgatccacccacctcggcctcccaaagtgctgggattacaggcttgagccacggcgcccggcccagacttaacttttaagaggagaaattcaagaatgagaatctgggagaaaaatctaatcaagacaagagttttatgtaggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcag

SEQ ID NO: 482977 - DNA, 145 bp, Homo sapiens
tcacatttgcggcgggctttgtatgattatgggcgttgattagtattattatactggttgaacattgttacgttggtgtatattttgtaatttgaaattgctcgggggaataggttatgtgattaggagtacggtcttggtgatg

SEQ ID NO: 482978 - DNA, 579 bp, Homo sapiens
  misc_feature (45)..(45): n is a, c, g, or t
  misc_feature (50)..(50): n is a, c, g, or t
  misc_feature (69)..(69): n is a, c, g, or t
  misc_feature (86)..(87): n is a, c, g, or t
  misc_feature (89)..(89): n is a, c, g, or t
  misc_feature (97)..(97): n is a, c, g, or t
  misc_feature (103)..(103): n is a, c, g, or t
  misc_feature (114)..(114): n is a, c, g, or t
  misc_feature (131)..(131): n is a, c, g, or t
  misc_feature (135)..(135): n is a, c, g, or t
  misc_feature (142)..(143): n is a, c, g, or t
  misc_feature (145)..(145): n is a, c, g, or t
  misc_feature (154)..(154): n is a, c, g, or t
  misc_feature (158)..(158): n is a, c, g, or t
  misc_feature (162)..(162): n is a, c, g, or t
  misc_feature (179)..(179): n is a, c, g, or t
  misc_feature (186)..(186): n is a, c, g, or t
  misc_feature (190)..(190): n is a, c, g, or t
  misc_feature (201)..(201): n is a, c, g, or t
  misc_feature (204)..(204): n is a, c, g, or t
  misc_feature (213)..(213): n is a, c, g, or t
  misc_feature (225)..(225): n is a, c, g, or t
  misc_feature (236)..(236): n is a, c, g, or t
  misc_feature (238)..(238): n is a, c, g, or t
  misc_feature (247)..(247): n is a, c, g, or t
  misc_feature (270)..(270): n is a, c, g, or t
  misc_feature (280)..(280): n is a, c, g, or t
  misc_feature (283)..(283): n is a, c, g, or t
  misc_feature (297)..(297): n is a, c, g, or t
  misc_feature (301)..(301): n is a, c, g, or t
  misc_feature (311)..(311): n is a, c, g, or t
  misc_feature (329)..(329): n is a, c, g, or t
  misc_feature (339)..(339): n is a, c, g, or t
  misc_feature (348)..(348): n is a, c, g, or t
  misc_feature (378)..(378): n is a, c, g, or t
  misc_feature (401)..(401): n is a, c, g, or t
  misc_feature (407)..(407): n is a, c, g, or t
  misc_feature (412)..(412): n is a, c, g, or t
  misc_feature (422)..(422): n is a, c, g, or t
  misc_feature (429)..(429): n is a, c, g, or t
  misc_feature (434)..(434): n is a, c, g, or t
  misc_feature (451)..(452): n is a, c, g, or t
  misc_feature (459)..(459): n is a, c, g, or t
  misc_feature (467)..(467): n is a, c, g, or t
  misc_feature (476)..(476): n is a, c, g, or t
  misc_feature (484)..(484): n is a, c, g, or t
  misc_feature (523)..(523): n is a, c, g, or t
taggccaactgaaaagtaatactaatattaatcaaccaaaaatangaganaaaaggaaaaaaatgaaanaaacaaacgaaaaaaannanaacataanacaaanagtaaaaaaanttaaacaacagtacggnctgnataaaannangaaaaaaanctanaacntttcttattttggggcnttgaatnaaanaaaaaaacaanaantacaggganttgttcacaaancatgtaggccnanaaaaaggcnccctgaaacccccaacggcaacnggggaacggnaanacaagattgcccanaacnggtatttccnttgcagaggccaacagcnttgaacaaangattcgccnacaacttttttctatatttttttcttttcncttttttcttttttttattttcntttaangcaanaaacaaccgnggccagngaaangaaacaaaaccggcagnntgtccanttgaaaancagacccanttacttcntaatttccacacaaattcccccaaaaaccctaaacatcntggcatccttcatgccttacagccacccagatgcaaaaaaggcattgtacaggaat

SEQ ID NO: 482979 - DNA, 11720 bp, Homo sapiens; identical to SEQ ID NO: 482965
  misc_feature (603)..(603): n is a, c, g, or t
  misc_feature (618)..(618): n is a, c, g, or t
  misc_feature (676)..(676): n is a, c, g, or t
  misc_feature (685)..(685): n is a, c, g, or t
  misc_feature (1078)..(1078): n is a, c, g, or t
  misc_feature (1116)..(1116): n is a, c, g, or t

SEQ ID NO: 482980 - DNA, 928 bp, Homo sapiens
atcctgataggcatccagcagtcattccggccaagattccttgagtgtgggtgaagaattacgacaatgaaaggtttcaagctgtctgccacggaagtccacatctgactggctcaacgccgtgtatgtccctgtccgactcccagtggacatggtggcgtgctccactgaaggacagaatcccagcctctcttgcatcagaaaattggattagtagatggatagcaattgtactctagtggatataaccttacgctcaaacaacgagaactactaaagttctgtcgcatgataattatgtgattcggaggacagctgttgtatagtggtacatcccatctcgcatcacataaattttcaggtgacctataatctttttgcatgaagtctgttgcagacatctcgtcaatggctggacttcctaagtagttcttttccacgtacaggctagtacagatgcttggtaaaagctgccatagtacatgcagacacccctaggctccattattcaatcataccgtgagccactatgttatctaaaggatctgattcatcgatattctcagagatgagtatggataactagaactctcatttcccgttgactcttgttatgccttaggtagtctctgtgtcttttgcactggacatttgtcttgtcacttctctcgaacaacttagagtccttcctaaagtgactctttcatgagaatttcatccagtttagtaatactgaattcttgggtggactagtgacttgcctagtgtgctgatgtgtagcgtattagcgtttcaaatggtgctgatagggggtgatccaagtaggaaagtggggttctatttctggaggcttgggtatacttaagaaaatgtaatataaaaccctgtttggaactcggaactttaagggggaaatttaaaacttgaa

SEQ ID NO: 482981 - DNA, 217 bp, Homo sapiens
tcctagtctgttggaggcgagacagaaggattgctttgagcccaggagtttgagaccagcctgggcaacatggaaaaacaccatctctacaaaaaatacaaaaattagccgagctggtggcacacacctgtagtcccagcaccttgggagggtgaggcaggcaggatctcttggaacccggtgaggtggaacgccgcagctgggcaactgatcactg

SEQ ID NO: 482982 - DNA, 11661 bp, Homo sapiens
  misc_feature (603)..(603): n is a, c, g, or t
  misc_feature (618)..(618): n is a, c, g, or t
  misc_feature (676)..(676): n is a, c, g, or t
  misc_feature (685)..(685): n is a, c, g, or t
  misc_feature (1078)..(1078): n is a, c, g, or t
  misc_feature (1116)..(1116): n is a, c, g, or t
ttttttttttatagtgcatgcaggaaattgcaattttatttatgtttgtattgatacatatttgtacatatttatggggtgtggtagtttgatatatgcatacaatgtgtaatgatcaaatcagggtgtttaggatatctatcacctcaaacatttatcatttttgtgtttggaacatttctaatctcctagttattttgaaatatataacatattgttaactatagtcaccctactgtgctatcaaacacttgaacttattccttctatctacgtttgtacccattaaccaatctcttccctccctcccccaactccaccttcccagcctctggtacttatctctactccatgagatcaactttttaagctcccacatgagtgagaccatgggatatttgtctttctgtgccagacttatttcacttagaataatgacctccagttccgtaagatgggcagccaggaaaggccttacttagctgatgtttgaattgtgaagttatgtaatcattaagatgagtatacatacaatgggccagctgagtgcacagcaagattcaataaattcaaactaacattactcttattgccaagagagtncctgaaatgacagcncattggaaactggctactttccttccctttccttaggggtttaaggaaagcatgagtnatttcagtnttttgctggagctcctcactgacactcattgcagagcctgagccctcaactctcaatctttgcttaggtcctggcttaggctccactttgtaagaggcaccttcctagtattcactactctctctctcacaatcatgtccttacagacattgctgatcctctttcatactgacaccgggttctagtccgagttccatcactaagtcgctgtttgactttgggcaagttacttctgtggttaattatttttcatcaacaaaatcaaaaggtgaaactagacgaacaactaagaggctccagtattttttcaatctaagagtcccatatcccccactcccttctcacagctcattcaacaatcctaatggcagcgggtgcccgcagtctcaagtntctgccgaagcccaagccgctgtctcggtcagtcacanccgacgaagaggaggaattggaggaagccagcataaccacctcacactgagaacatctgacctttcccagaacgcccgcccactcgacacttcctgtccctccccagatcttgttccggggcacctactcgggtctaatcactcccctcattcactctttagggtccattgctgtttctttgaggaagcggagcatcttctgtcgttgattggtttccgtcattgttgataggttggtaacaaacaaggtgtgcctggtctcctggtaacgtcctgccgatagtcctgattggtcggtgtcttaatcccatcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttttgcatgaattatcaggagatgatgacactgatcagaatatgagggctcccctagaccctgaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaagcatgacaagagttctacagaggaagagatggaaatagaaaagataaaacataagctccaggagaaggaggaactaatcagcactttgcaagcccagcttactcaggcacaggcagaacaacctgcacagagttctacagagatggaagaatttgtaatgatgaagcaacagctccaggagaaggaagaattcattagcactttacaagcccagctcagccagacacaggcagagcaagctgcacagcaggtggtccgagagaaagatgcccgctttgaaacacaagttcgtcttcatgaagatgagcttcttcagttagtaacccaggcagatgtggaaacagagatgcaacagaaattgagggtgctgcaaaggaagcttgaggaacacgaagaatccttggtgggccgtgctcaggtcgttgacttgctgcaacaggagctgactgctgctgagcagagaaaccagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaagatcagctccagcaaaaatccaaagaaattagccaatttctaaatagactgcccttgcaacaacatgaaacagcatctcagacttctttcccagatgtttataatgagggcacacaggcagtcactgaggagaatattgcttctttgcagaagagagtggtagaactagagaatgaaaagggagccttgctccttagttctatagagctggaggagctgaaagctgagaatgaaaaactgtcttctcagattactctcctagaggctcagaatagaactggggaggcagacagagaagtcagtgagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcag

SEQ ID NO: 482983 - DNA, 469 bp, Homo sapiens
  misc_feature (23)..(23): n is a, c, g, or t
  misc_feature (390)..(390): n is a, c, g, or t
  misc_feature (443)..(443): n is a, c, g, or t
  misc_feature (461)..(461): n is a, c, g, or t
attctcataggggtgtgaacctnattgtgaaccatgcatgtgagggatctaggttgcccgtatgagactgtaatgcctgatgatctgtcactgacccccatcacccccagatggaccatctagttgcaagaaaacaagctcagggttcccattgattctacattatggtgagttgtagaattatttaattatatattacaaagtaatgatagtagaaataaagtacacaataaatgtaatgtgctagaatcatcctgaaactatcccctttcatcctcccaaatccgtggaaaagttgtcttccatgaaaccagtcccgggtgccaaaaagactaggggaatgctggtctacaaagtacagttcaataaatctaaaatcttacctgttantagttaaaaatgagggggtatccctatggcaggaggattgaaactaggacccngttttgggtcagggtttntttagggg

SEQ ID NO: 482984 - DNA, 352 bp, Homo sapiens
agggccccgcggagcctcagccctaggctccctccttctgcccctggggcctcgagtagccatggcaacggggccagtgttccgtcccttagaagtttcccccttgggccaaaaccccatttccctttagagctggtgttgtttgaagtttttgtatccccgtggttacctgggctttttcctgccaacctacccccccaagctttttttttttccttcccgtatccatggtaccccgtgttgttcccagcgccggggggggttgggccgaaaccctcggggatgctttcgggccccctgttggggttggggagaaccccgccccccttattaaggtgctgcttgggtggga

SEQ ID NO: 482985 - DNA, 7907 bp, Homo sapiens
tctcctcatcagggcgatcctcctcctcctgggcgaaacctcctcctcctgcgactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaagataatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactactgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggcatccccagagacatcagcttccccagatgggtcacaaaatctggtttatgagacagaacttctcaggacccagctcaatgacagcttaaaggaaattcaccaaaaggagttaagaattcagcaactgaacagcaacttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggggccactaaatatagatgttgctccaggagctccccaggaaaagaatggagttcacagaaagagtgaccctgaggaactaagggaaccgcagcaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggttagagcacagtgaatgggactcttcccggactcctatcattggctcctgtggcactcaggagcaggcactgttaatagatcttacaagcaacagttgtcgaaggacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcag

SEQ ID NO: 482986 - DNA, 87 bp, Homo sapiens
gatccgctcatcagaatcacatgagaaacagtcataatactgtgccctagacggtagccagactagttctcagggaatagaccatcc

SEQ ID NO: 482987 - DNA, 129 bp, Homo sapiens
cactatgcgcgagtgcatgggatttccgattagcagctggcgcgatgctcagacgtgcatctttgatatttctgttctacaacccttcctggggcggtgttcggctacggccacgtcgtcttcgagtct

SEQ ID NO: 482988 - DNA, 125 bp, Homo sapiens
  misc_feature (50)..(50): n is a, c, g, or t
  misc_feature (122)..(122): n is a, c, g, or t
tcaggagagagaactggagcagtggatcgctgagagggaggtggtcgcanggtcccatgaactgggacaggactatgagcatgtcacgatgttacaagaacgattccgggagtttgcccgangac

SEQ ID NO: 482989 - DNA, 157 bp, Homo sapiens
actaggtagttatgtactcgtatcaaaccctccatcaggtccccagagtctatctggttatctgccacatcgtgaccagaagttctgaattatgggctcacaggctcacatcagcaaggcttctatttgaatatcctctgattctaactcagagagg

SEQ ID NO: 482990 - DNA, 283 bp, Homo sapiens
catttgagccccttgatgctctatttctattcactgtactatggcatcacgcttatattcccttaatttgcaatgaactctataagctcacatgtctagaatataatcactttggtctatctattcatgtttgaattgtttttcaaccatgtcagatcgagtggtcttagtctaggtgctctgttattgactgttctgtataatgttgaggatacttctatttaacaaataattaatactaataatagtacatcttactgtattatctatatagccattatgc

SEQ ID NO: 482991 - DNA, 522 bp, Homo sapiens
ataaataatagagattcgcataatagatattctttacaatacaatagttataacagacttctggtctaaaaaatagtcagaatcctagttgtgatattacataactagtacatcagcaccacaatttgtggttaggcaaggaaaatcacagaagagattagaatcactcagtggttaactatccatgggggcagacggaccattaaggagccatgatcactttaggcatcatagttctgtgacacattattgattgatcagctattactgtcaacttgaggtcttccaagctgccctcaatgacaacgaaaatttggtgagaagcatggggtgaagaaggaaggtggctggttccttcacaagatacaaggctagagtgaagatgggcagggtccaaccatgtattatctccaatgtgaagatttacattgtatggcgaatctaagattgcatagacatgaaaatatgcacttggtatctccagagtaagacaacatcatactgtgggggaaagagccttga

SEQ ID NO: 482992 - DNA, 1026 bp, Homo sapiens
  misc_feature (1)..(1): n is a, c, g, or t
  misc_feature (67)..(67): n is a, c, g, or t
  misc_feature (92)..(92): n is a, c, g, or t
  misc_feature (94)..(95): n is a, c, g, or t
  misc_feature (127)..(127): n is a, c, g, or t
  misc_feature (129)..(129): n is a, c, g, or t
  misc_feature (135)..(135): n is a, c, g, or t
  misc_feature (137)..(137): n is a, c, g, or t
  misc_feature (151)..(151): n is a, c, g, or t
  misc_feature (153)..(153): n is a, c, g, or t
  misc_feature (171)..(171): n is a, c, g, or t
  misc_feature (182)..(182): n is a, c, g, or t
  misc_feature (202)..(202): n is a, c, g, or t
  misc_feature (226)..(226): n is a, c, g, or t
  misc_feature (286)..(286): n is a, c, g, or t
  misc_feature (289)..(289): n is a, c, g, or t
  misc_feature (295)..(295): n is a, c, g, or t
  misc_feature (299)..(299): n is a, c, g, or t
  misc_feature (315)..(315): n is a, c, g, or t
  misc_feature (331)..(331): n is a, c, g, or t
  misc_feature (337)..(337): n is a, c, g, or t
  misc_feature (340)..(341): n is a, c, g, or t
  misc_feature (343)..(343): n is a, c, g, or t
  misc_feature (348)..(348): n is a, c, g, or t
  misc_feature (351)..(351): n is a, c, g, or t
  misc_feature (357)..(357): n is a, c, g, or t
  misc_feature (367)..(367): n is a, c, g, or t
  misc_feature (381)..(381): n is a, c, g, or t
  misc_feature (386)..(386): n is a, c, g, or t
  misc_feature (413)..(413): n is a, c, g, or t
  misc_feature (417)..(418): n is a, c, g, or t
  misc_feature (421)..(421): n is a, c, g, or t
  misc_feature (423)..(423): n is a, c, g, or t
  misc_feature (427)..(427): n is a, c, g, or t
  misc_feature (435)..(435): n is a, c, g, or t
  misc_feature (438)..(438): n is a, c, g, or t
  misc_feature (444)..(444): n is a, c, g, or t
  misc_feature (449)..(449): n is a, c, g, or t
  misc_feature (464)..(464): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (495)..(495): n is a, c, g, or t
  misc_feature (499)..(499): n is a, c, g, or t
  misc_feature (502)..(502): n is a, c, g, or t
  misc_feature (507)..(507): n is a, c, g, or t
  misc_feature (510)..(510): n is a, c, g, or t
  misc_feature (521)..(521): n is a, c, g, or t
  misc_feature (526)..(526): n is a, c, g, or t
  misc_feature (548)..(548): n is a, c, g, or t
  misc_feature (551)..(551): n is a, c, g, or t
  misc_feature (556)..(556): n is a, c, g, or t
  misc_feature (560)..(561): n is a, c, g, or t
  misc_feature (565)..(565): n is a, c, g, or t
  misc_feature (567)..(567): n is a, c, g, or t
  misc_feature (569)..(569): n is a, c, g, or t
  misc_feature (576)..(577): n is a, c, g, or t
  misc_feature (579)..(579): n is a, c, g, or t
  misc_feature (586)..(586): n is a, c, g, or t
  misc_feature (589)..(590): n is a, c, g, or t
  misc_feature (592)..(592): n is a, c, g, or t
  misc_feature (600)..(600): n is a, c, g, or t
  misc_feature (613)..(613): n is a, c, g, or t
  misc_feature (631)..(631): n is a, c, g, or t
  misc_feature (668)..(668): n is a, c, g, or t
  misc_feature (671)..(671): n is a, c, g, or t
  misc_feature (755)..(755): n is a, c, g, or t
  misc_feature (761)..(761): n is a, c, g, or t
  misc_feature (780)..(780): n is a, c, g, or t
  misc_feature (798)..(798): n is a, c, g, or t
  misc_feature (803)..(803): n is a, c, g, or t
  misc_feature (814)..(815): n is a, c, g, or t
  misc_feature (830)..(830): n is a, c, g, or t
  misc_feature (835)..(835): n is a, c, g, or t
  misc_feature (932)..(932): n is a, c, g, or t
  misc_feature (942)..(942): n is a, c, g, or t
  misc_feature (958)..(958): n is a, c, g, or t
  misc_feature (1024)..(1024): n is a, c, g, or t
ngcattggttcatttttgtattttaatcattgtacatttacttttgtgaaaacactgcctgcatttnctagtacaaaaaaaacctaaaaatngnntcggggatgtagggaaatatccaacttaaatngngaaaangngcaccataattacngnggcactgcagtcatttcngcaattcccangtttcttaaataactatctngtcagataacacacaatataaagngcaattatgaaaaacagacatttacatatacttctaaagtcttattgggaatatcctgtnggnattggntagncaatcatgggggcggnggcggtggcggggtangcatangcnngnggggncanaccatngggcatattngggacattacttcnggatngcggggggcgatcataaccattcgggnaagnnccngngggnttaccagnccnaaaacnggtcngtataccagcgggcncaaaattccttccaangcncccatnggggtnattngcngcacngtnaacaccattcngggtntttgccccaaaatctcttttangcnggctngggnnaccncngncataatnngncgcgggngcnnangggattanatccacccctttngcccgcagagtatctgtncgcgagcggcgcgtccttcatgcctcctctacccctnggnacgacctgaacctctgtcttcgaccaactgaagcaacttgggattaattgcttgattagcttcacgaagcacagagataaggtngctcanttgctttatgttattaggngtaaagaaagtgtatgcngtgcntgtattggtanngcgagcagttcttcnaattngatgaatataatcctctgaggagttagggtagtcataattgatgacaaatttcacatcttccacatctagccctctggaggccacatctgtagccancagaataggngcttttccatgtttgnattcattagaaccagtcacgctcctgttgactcttgtcacatggataccatggcaggcacccactntc

SEQ ID NO: 482993 - DNA, 210 bp, Homo sapiens
ggtacccctagcatcaaaataccaattcgagttcccacaatttttgaccaaggtaaacatcgcagcacaatgtgaatcggaaagaaaaagaaaacttttagccaagaaattgaaatcccttagagcagaatcacaacaaaacgcaccaaaacctaaaccaactgtaaaaatcatcgacgattatgttgtcaaccaatcaacacagcaatt

SEQ ID NO: 482994 - DNA, 226 bp, Homo sapiens
  misc_feature (1)..(1): n is a, c, g, or t
  misc_feature (23)..(23): n is a, c, g, or t
nttaagcgggagaagtatagggntttatcttattatatatgtccatatagactaggactctttttgttggggtagggttaattgattattttgaccccgcatagcttttttttttttttttttaaacttgggctggttctaactctccagcggctttacaaaccatttttaaaagacattcccacatccctgtgaaatttttttgggaaaaaaaattttggcccct

SEQ ID NO: 482995 - DNA, 183 bp, Homo sapiens
  misc_feature (152)..(152): n is a, c, g, or t
acggaccttctctgatatagacttttgattagcactggcttagagtgtgggtctgagaggggttggtgggagattacgtgggaggagttccagacagtactgtgggagatgggtgagtatataggagtggagtagaatagtcctatagtatntattgagcaactaccactggcgcggttagga

SEQ ID NO: 482996 - DNA, 344 bp, Homo sapiens
ggtgatgatgactagtccaagaatgacttcattgagcagagtaccatgcggttgaacagcctcaagctaggataccggcatgtacacctcacggctaagaacggggaccaggattcattagccaccctctgtgtgaagatctccctccaggactaggctggaggaagccaggggtgtcccgactgagagggctgggccctctgtccacaagacgggaccggcctggggtggctggtcccagcctcttgctcagagctatggcccacgctagaccagcccctgtagctgtccttcattgcgcaaggaatcactgcagccctgtacaccattcggccagagagggt

SEQ ID NO: 482997 - DNA, 455 bp, Homo sapiens
ttaccgttatgtacgttgtgttaagcgagtctgtgtgagagaatatccgtgttgcgctaatgaatgttcttagttctagctgggcactttagtctctgtttcccccatttgtcttacaaggccatcgttggacaaaacctaccagtgtaatttatcattatttgattgctgagtagtttgataaattctggatgcatctccaaaagtctctaatgcctatacgcagagggggaagagtttcacaatttactgagcatcgagcgcctaaagtaaagaattcactctccaggaagagctcgagagtaagtaaagattgactccatggaccttttcatgaagcaaaacttttctcctttttccagcaggtctttgcaacctctttttgacattgcctttgcttaaaaagaaaattatagtcatgtatccaaaactagagtatatacataacggtcacg

SEQ ID NO: 482998 - DNA, 389 bp, Homo sapiens
agtgtgattgaggtggagtagattaggcgtaggtagaagtagaggctcttggggtgaagagttttatggcagtcagaaaaaagagaaaagaaaggacacaataaagaaaaaaaaaaaaaaaagaataagaagagaaggcaaaagaagcacaaagaaacacaaggacacagaacacagcaacacgcacagaaaaacagaacaaaaaaacaacgcgaagggagaagagaagaaagacagatagatagtaagaagaaagagaaagagtagaggacaaagatacggcgatagtagagaagaggtagataaagaggacaaagcgagaagaagagagcaaagaaagaaagagaaaagagatagcagaagaaaagataatcagaaggaatatgaac

SEQ ID NO: 482999 - DNA, 666 bp, Homo sapiens
gcgtgatgtaccttgcgggtggtccgaagcataaatctgcttgaactggcgaggtggcactcgctagggcgcatgttcctgtccacccgtgtacctctaccatgctgtgcgtgcagtgccgtgacatcatgcgatcatatcggaccaatctgcagttgcttgtcactgagggacgccgattctcctcaaagatacaattcggctggcggaatcacgacactgcgcaaagttgctggcatgtggaccaaggagtgcgcgcaatttatatcagcgagtatagtgcaaccgttcatatcggatcatgtacagaagacgtgaatgactagtaggcactttgtatagagtagataatattcaggttggctaattggttgttatctcttagtgatttgggcctgaagtgtcgattggagaaaaattgggatagtctgaagaggacatgctaaggaattttatgatgtggagtcgtgatggggactattgactactcttggatggcctgactatgcccttttgaccttggtgttaatgctgcaagataacgacctgggggttcgattcactctgatacatcgcctcttgtcgcgacttgaactttcgcagtaatcataccgatcacctactgtgatggcgtgcaaggaacggtctcctgggcactgggaccta

SEQ ID NO: 483000 - DNA, 141 bp, Homo sapiens
gatcaccggaggtcagtagttcaagaccagcctggccaacatggtgaaaccccaacctctactaaaaattggtgtatatcctttgtggtgtcttcctgtttatgtgtcccaaggggagtattttccacaaaggtcaaaaca

SEQ ID NO: 483001 - DNA, 713 bp, Homo sapiens
gtggcgccgagcctcccaagatggcggggtgcaatcgcggtgatggccaggagaattaccccctctacattcggaggcacccctagcggagaacgagctgaagttccactacatggggcacacatctctggaggtggtggatgagaagatcgccgcaggggggaaggccctggggcgaccagagggagctggacctgggcctgcgctaccccaacgggggactacaaggaatacggtacgtacaagccaatgtccaaggctgacgtgggtcaggggggtagattcctccaagacagccctgcgagacaacgaaatgcgcagcatgtttccggaagctatcacggactcctgacacagaagcgtgatgtgcatcccttcgtacaagccgggggaccgcaatccagtccagggcctttgataacatggtgacgtcgagtgatgcactgacaggtgtgcatgagtgagctgtgctggcagccatcgtagaggagcccggcacagattgtgggtggggccgtcggtctgctcctggtctgcctcttcctgactgggacgccctggggcttcacaggggcaggcaggctgtgcatgttctcttcaaaatacaggtctggtgagagggcaacaaaccaagatttcagcccaaatacacattcttcgggccaattagcaccttcgaaacctttcttaccaacctggttgatggcgccctg

SEQ ID NO: 483002 - DNA, 779 bp, Homo sapiens
gggtcgtgcggacgtcttgcctgtcgctggagtgagaggtccgggctctccagtgaaggtgtgctgctggcgacaaaatgaacgatattcgtgggcaacgtcgacgcgggcggatacgactccggaggagctggcagaccctcttttgcgccctacggcgacggtcatgacgctgcgccgatcactgaaacagttcgccttcggtgcacatgcgcagaagaaacgcaggggcgcgctgacgcgccaatcgaagccctgacacggccacgacgcctgcaggcctgcgggcagcgcagctcgtggtcggacgatgtccgccgcccacaatggcctcctggaataactgtggacagattggtcgttggtgccaaatgtcgtcggggctggcattgccacccgaacgccaggcaaccttgtcagcgagctgctcctttgcggacgacagcccggatgagaatcggccgatccatgcgaagctcgtcgaaccgatgggttggcaacacggggctacctacggtctaacggtgaatggcgtcgaccagccctgacaccaaactctgggaaaaatcgggaccgcccgcggaggaggcgccttaccaacgacggccaacgcgcatcgaacttcgctgccatccaagctgcctctccgaacggcgaggcacactgcgcctaaaacggggttggctttgggaaactgtggtgtaccaagttgaggttgagagaaaacttttgaccgtggactctatggtcgcacaccattccgggagatgcacgacgga

SEQ ID NO: 483003 - DNA, 850 bp, Homo sapiens
  misc_feature (20)..(20): n is a, c, g, or t
  misc_feature (725)..(725): n is a, c, g, or t
  misc_feature (845)..(845): n is a, c, g, or t
atgggacgagaattagtcgngtcactctgtcaattcctgctcaacgcggtataggtacttggagcgcacgcacgtgagagatgatattacgtcaggtgcgtgacttgactcaggtagcacgattatgcggagctagagcgcgaggcccgcgggccttgcagtacagtaggtcactgtcgaattcgtcagcggtatccttagagaggtgaaaacagatcataatgtacaaaaacaggcaagctcttgcgtgcgcggtggcgaccggagctcaacggtgtacttcttgtcacacatacgcgttctcatagttgcaaagtagttatgccacttgataggggagggggggcaggcagggagcaggcggagggagacaaccatgaatagatttattatatatctttgtggtgttcgtatcagtgctcgcgtggtcgcagctgcctcgcgttctggggcggtgtgttcaatgtaatgttcagctattccgagctatacggatatctatgcgcctcggtgagaactaaatcaactatactaaaaattaagacccagatatactctgccaagtgaaaacgagggagttaaaagtaaactacgtaattataaccgcgggcccaccggtcgctgccggtggcgcggggtgatgtttttagtctccttcccccacgccgttcccgtcccgtcttcttggtttgcgctgtggggggcgttgcgcctgaggtttaaantatataatgtggagtggaggaggtaaaattgataggttcagtagttagaggaggggtagttggcgtgtgttgggggggtgcgggggtgggccgattgattttaaaagaaaaagagagagnggtat

SEQ ID NO: 483004 - DNA, 112 bp, Homo sapiens
gagtggaagctgcatctcgagttgaacagtgagagtccgggcggtgaggaggactcagggggagggcgggcaggactgagaaggggagtgcgaggcaggagttatatgccat

SEQ ID NO: 483005 - DNA, 273 bp, Homo sapiens
cctaggtgaagtagtttgcactatttttgcaatatattcatggaaaacctaccagttacttgttttgtttcttactgtgtgtatatatactaatgctgagagtttggcatagtgttttttcgcctccttacataacccctaacttgcgcaggatgctgtttttctgataaaatatgatgtgaatgatattttatgatgttcttttgtatggtgtcaattttgttttgcctcatagtatgtcagcaaaaaattaaatagaaggacttttattta

SEQ ID NO: 483006 - DNA, 1496 bp, Homo sapiens
  misc_feature (122)..(122): n is a, c, g, or t
gcctagcacctcaacatgacggctctcattgtcctgcggcttgtcctcctcttctgctctacgtgctaccagtggcataggttcatatgcagcacggtgctgcagttgtgccacgaacctcnttcacaagacgatttggcgaagtggcagtggtctcacagggcgacctcatgcctacccaaagctggactgttctctggactacagattgggagacctggttacacaccagacgatgctacgaagaggtactagtgtctggaagaacatgacctcatctggattagtgcggactactctcaagactcagaactaagcgcgcttacttgggcctgctaactggattgcgcccaaatagccgcaagcggagcaatgcgtctcactcgcccctgtgtcactccgtactccctgttcccggcatgcctctttgccctgccccaacgcactcaatccttccggccttggaatgcccatgcctcatagccttttgcttgcccaacaaagacaaagcgtatcgctccacacatagaattgccaatgaacaccgcgacacgttcacccaacgcttatagagcgctcgcacagttggtcaacaacacagctccaactctcgatttcactataaaccaaccaccagaattcagtctgctgtatcaaccctacactccgttccacaaccacgcaacccaaagtcacactcagtaaacaccactcaaccccttaatttccacaccgacacttacactaaccctaagtaccctccacacactcaacaccgctcccttccgttcgtcaccaccccacttaccccacaccacgtacgcaaccatacatgcagcaacactacatgaacgcacctcgtcacacacagagccgttcaaaccgagtatattcagaacctccaaacataactcttgactttcatcccaaaatacatcaaagaactaacgttcggattcaatgcggaccaatgcaaacgcgtaattgaccgccataccccacttgtactgcttcctatgtgcatgcccatatcccctcctaggcgaccccagtgagtaaacccatatggcaactcactacaacaacttaatagcgattccaacattacaaccgacaattcctacgtttcaagcacacggaccacctacacagccacacgtaacttcatctacgggcactttatctaacgcgtcacctaagacgtagcgaccacacgcaacccgcaggtgtgtgaagacagctcagagcatcgacagcattcgaaccccacatctacaaaacgagggacaggacaagacggttgagttcgccccaacgcgtagctcaaagcccaccctagagcaccatatcataagtgcgagcagcagccacactaccagccgaccgcgggcgtgtgggctcacaaggcggcagaccacgccgtccattgagcaccggacaagcatggtgtgttgggaggtcgagtgtcgggctagcaccatacccccaaccgccgt

SEQ ID NO: 483007 - DNA, 1262 bp, Homo sapiens
  misc_feature (421)..(421): n is a, c, g, or t
gatctgtggccagggacaggaacagaggatttgaccccaggtaatattataaaacaatctgatgggcagctaaatgagtatattatccaatctgctatcagctaaaataaatggcttaggttttcatagcagtctatacaagtaaaggaacccctctatttgttctcaggatcatcctaggtctgtttgttcctgtcactgcccaacctactctcctggaacatttttctccttacttatatgtctatgtgtgctttgaatatttgtccaaatttaacctaacaaataacaattgtgcagcaaaatctttaatcctgaaggagaaagtggaaaacaaaaaaaagaggaggagaaggacaagaactcctcattcccttgatgaacttaagaagcagaagcaccagcactgtctgaaaaccanactttaagaagaaataggattagatttattaaaaccttttgagtgtggtatgggactcagcttattcactgggaatgtgcctcaaactcagaaaccaaatccctgtaaatcttaccaatcaactacattgttatgctctttccatttaggaagttaaaaaagtcgtttaggacactatcaaaccacttttaggtacttattttaaaaacatatggataagagttctagaaaacaagagaaaaattggaaagaataaagcagcgtatgtttgttcacagccttgagtttgattcctgttttgttactgtaggaaaaatgtcctatttcagagcagggggggatgggaaggcagccatgggtgccacactggaattcaacccatgtggaggttgaaaaaaacgggtctggacagtggagaagtgaaggtagaatatgaagagccccacgggagaccagctctcttttcctccagtctcctcaacttggctcagtgggctgcttcaaccccatatgcaagctgaagtcaaagaggaaaaaattgtcccaacctcagcacacgaccaggaaagataccagcgcagcttctctagtgtgacctgtgcggctcacatggtgtcatggcgacggcgatgcagggacaggtggtcagaacgagaaaagctgcggttgcagtctgtgcaccgaaaaggcttgatgcctgtgtgcttgcggaaatggcgagtgagctcatctgagcgagcaaatttccaggagcagccatcccaggtgcatttataaggcttctctcctgtatggattctgcggtgagctttcaggtgagagcttttggtgtacactttgc

SEQ ID NO: 483008 - DNA, 476 bp, Homo sapiens
  misc_feature (103)..(104): n is a, c, g, or t
  misc_feature (118)..(119): n is a, c, g, or t
  misc_feature (242)..(242): n is a, c, g, or t
  misc_feature (273)..(273): n is a, c, g, or t
tttcgggagccttaccctgggcatggtagtagaagattagtagcctaaacataagttgtataagtagaggcgatccctgtttgacactctggaagcccacccnnccatctttaccatnncaaactttaatgtgcaaactaactacatgaggataaagtgcagactcaggttcaatgggtctgggaagaggcatgagatcctccgtttctaccaagcctcccacctgcccagtctgttactgngatccaggggccacacggcagctagaatgantaatgtggtgaacagaaataaacttctggaatcagaggctaggcatcaaatctctagaggtctccataacttcttcaacttcaccagggagcagattagactactgagtgttcaaatgagaactacgggctaacatctggtctgacttttgaaagcagtcagaagtctctgatcaaggagagagggttcacgtctcacgggga

SEQ ID NO: 483009 - DNA, 656 bp, Homo sapiens
agcggttgttaatacttgtgattgcattatgaaattcttgtggtgtgttttccaactctagccagtcaatttggttctgttttatactggctatttcaccgatcagcacctgaattattttttgtgtttgttccttagtgatatggtttggctctgtgttcccattcaaatcttatctggaactgtaatccccatgtgttgagagaggaacctggtgggagttgattggatcatgggggtggttcccccgtgctgttctcatgatagtgagtgagttctcatgagatctgatggtttaaaagtgaccgtcccccttcactctctctctcttctgccaccctgtgaagaagttacttgcttctccttcaccttcagctatgattataagttttctgaggcctcccgagcaattcagaactatgagtcaattaaatctttttcctttataaattacccagtctcagaagttctttatagcagggtgataacagactaatacacttagcttccttgaattaggtttcgatgttcccctgaatttcaatgatctttgttcctatctatattctgaaatcaatttatgtcatttcagccatctcagcctagttaagaacccttgctggggaaccagtgtgatctttgggaggacaggagga

SEQ ID NO: 483010 - DNA, 723 bp, Homo sapiens
gtgggctgtcaatgtgcaagaatgtgtctgtcaagggattgttcgtcgatggcaacgtttgctggtgacaggaaaaatgagccacacaactggaagctagtcatggacttcatccatgcatcagtgtgactgatccggtgagatcatccacggccaatataacgcgcgcggctactgccaccggttgattaggagtttgcacatccacggcgtacacactggcaggtgcaagtgttgcatgagctggaagggaataaggatccgatcggccgtctactggtagaaaaagagctgcgaagcatggctccctaacatttcctttggcacagtactgggttagactgactagcgacattcgtggggataactagcgggttttcccctgggaggcctaagggcccacaactggctggtggtttcgaccgaggctttcatctagtacttaataccacaccttctcgggctccgctctcatggcgtggttcggtgatgatcgacgacgagatcacgtctgcggcgtcggcgtgtcactcacaatcgtgcaggtgggacctacaggaacggcatgctggaggctgcgcgcaaggctctagacaaagctcattggtcccaagtaaaacggcgtccagggaaggggccataagaattggaacattaatttagattcccggtacacttagcccttgcacgcgactccccccaaggctcccttttacaaatcca

SEQ ID NO: 483011 - DNA, 475 bp, Homo sapiens
tagatgagcgttgtggacagccggaatggagggttcctaggagggtggaacactggggaggagcttgggaaggacctggaagttccccccccttccctcatatctcaccctctgcagctcttcatctagtgttcattggtatcctttctaatatattttataataaactagcaaccataagtaagtgtttccctgagttctgtgagccactctggcaaattaactgaacctaaggaggaggtcctgggaaccctaattcatagctggttgatcagcagcacaagtaaaacagcctggggcttgcaactggcctccaaagtcaggggcaggggcagttttggggactgagtcatcaacctgtgggacctgacgccatctccaggttgagagtgtgagaagtgaatcagattagagtgcacccactggtgtcagctgcagaatgactggttgcctggtgtgtgggggaaaactcatg

SEQ ID NO: 483012 - DNA, 768 bp, Homo sapiens
ctccccctctcgctctctccctcttcccggctccagctccgccgcagctccagcctttgctccccctcccaaagtcccgctccccggagcggagcgcactagggtccctcatccgacaaccacagagcaaaaagacggtcagaccagaagacacggagaggcacccaccagagaaccagctagccatcacgaatcagcgccatgaccgagggtaacccagagcatgaagactctacacgataccaggagagagcatcatacacaccaaaaacgccaatcatctaatgctacatgctcacaaagtctggaaggtcccaggtcgatagcagcccggacatttcagcgaagaagccaggagtccatagtaataagctcgtgcgtgtgcacctagccgcgagtatctaggacccgtcctgtcaccccaactaccagtctcagctcgtaccaacacgtgttcatgaaagcgtgcgcacctagcagtacgccctgacgtccctgacaaccgaacggacaccagggatgagcacgaaagaacgtcacacgggtgtcaaacgaggccaaccatgtaccgaaaaggggggaacgcccaatggaagccacgggtgcccagaagcgctgacacggcaccccgtggggctccgtataccccaaacaaggcccaatcacgagggacggcataccaaagagataaccaaacaccatgacggattcagccccgcggctggggcaagaacgcccgtcatgggacccaagtcgacaaggcaaaaa

SEQ ID NO: 483013 - DNA, 968 bp, Homo sapiens
agcgggttgacggctgcggttcgaagtggctgtgggtattgctgcggctggtgcgtcgtcgctctaggttttcttccgccgtctgtgacagcttcttgatctgtccccaggaatcctgctttttttttttctttgagacacggtctcgctctgtcacccttgctggagtgcagtggtgcaatcacagatcacggcagggtctaattccggggctcaagtgaacctttggcatcagcctcctgaatagctgagaccacagacagagtctcgctctgtcatccaggctggagtacaatggcacgatctcggctcactgcaacctctgcctcctgagttcaagtgattcggttgcctcggcctcccagaagctgggattacaggcatgtgccagcatgcctggctagtaataaggtattttacatagagatggcgtttggccctgtgggccaggcgggcctgaatcctgacctcaggtgatccacctgcctcggcctcccaaagtgctaggataacaggcgtgagccaccctaccaggatatgaaagatggaagtccagatagaagtaacggaagatattaaaagccaaaagaaaatgccctaagttgccgaagcaagtagagaaggcgtgaaataaggcacaggaatgtggaagcggctgaaagaaggacaatgggaagtagcgcttacccagcgggaatcagagattcaaacctaagaggcgaacataggatgaatacccaatgttgcccctaggagaagggtaaccactggaaatcaaaaaatcataacacgaaaaaaggagctcacgaagaaaacaggaaaaaaaggaagtggaaacacaggaaagtgaacgacaagcacgaagaagccacgcatagacaaggcaagagacaacaagaagacgagaacacgaggggaagcaacacacacggagagcgaaggacacaaaactaaaaagcagaacaaat

SEQ ID NO: 483014 - DNA, 633 bp, Homo sapiens
  misc_feature (633)..(633): n is a, c, g, or t
agttgtgtttacttgatttgaggaagaaaatatttgacttgtgtaaagagtagggtatcagggtgtcttttctgccggggagatgtgtatatatatagtattttggtgtatagtagaaaataagcttgtgcatctgtatttgagatatgttaatgacgtggagtaaagtcagctgtaagactctggaggcaaacaagttgtatatggttcatatggctctatggggaatttaattacctttctgggcactttttttttttttttttttttaaagtaagggggaaagggctcccatgggaaagtttcctaaatagactttccaggaaaaccgagagtcaaaattttgggtgatagtttggaaaatggagggagtagcttggttggggaacgcctttcggggggggggttcccggtggtcggtggtggtctggtgggtgctaactatatggtaatacaacgcctacagatattgggcgacataaaagaaacgctggtcaagaaaaagcgctggcttgctagcgaacgaacagacgcatacttaaaagtctcttcccctggagaactaccaggggggaggggggcgtaaagcatccacatcttcagctagaatacactcgggacaataaacggacn

SEQ ID NO: 483015 - DNA, 133 bp, Homo sapiens
tacgtcatactgcacacgccggcacacgccgagtacccatacctgtgtcaccaaggaggtctgtatggacgaagcaacaacttcgtccacacagacctaggcctggctcgctctgtttggtctgggcactcgg

SEQ ID NO: 483016 - DNA, 329 bp, Homo sapiens
agctaccactcacccactttatgagaatgatcttctgtcttcctgtggagtctgaagagtcatgggcaagttcttatcaggtctaaagctccactctcctttgcattgcattacctggtctctttggctttgggggttcaaggaattactttgacctattagagaatttgaccttgtgtatgcaatggctggtgggtcactggtgagggctgcagttttggaggtagctgacagtggttgcaattaatagttattactgtatgtaggctacttgttgctttgctctattctataaaacgggcatagttgaatacatggagctgtggaat

SEQ ID NO: 483017 - DNA, 877 bp, Homo sapiens
  misc_feature (127)..(127): n is a, c, g, or t
  misc_feature (275)..(275): n is a, c, g, or t
agcgggttattgctccaagacatggctgcagcttcccagggaggagcccacggagccatactccatacactgcagtcgcatttcgcctcacgtgccacgcctctttatagacagattcgaaccaggncacgcgctgctctcatccagctctgcccatccttaggaatcgcatgaagtctcgccacaaggtgcactgtgttcgtgaatagctttgcgtttaaaggggacccactcgccagggcgcacagagagtgaatgcccagtggagaggaagnagacgtgagacaataattacagaggagttcattgaaaatgatgaggatgcacgacactgggcaagacagaataagaactcaaaggttcgaagcacgagccagagaaagaaacagccaccaactgctgtccccaaggcaaatggtgtccgaagaaatcccaccttggcaaaccccaggagcctgtgcaggaggagccctaagacgccgcgctccgtgagtatgacagtccggaggcccacggagagagctggtcgttcaaaagagcctgggcaggccaggcacggtgactcacgtctgtcatcccagcactttggaaggccgaggcgggtaaatctacctgaggttgggagttcacagaccagcctgaccaagcatggagaaaccccatctctactaaaaatacttgacgaattagccaggcgtggtggcgcatgcctgtaatcccagctaacttgggaggctgaggcatgagaattggttgaacctgggaggtggaggttgcagtgagccgagatcgggagcactgactccagcctaggcgacagagcaagactccatctcagaagacaacaagcagaagaaaccaaaatcttccgagccgt

SEQ ID NO: 483018 - DNA, 553 bp, Homo sapiens
  misc_feature (135)..(135): n is a, c, g, or t
  misc_feature (147)..(147): n is a, c, g, or t
  misc_feature (271)..(271): n is a, c, g, or t
aggagagtacatggggttcgtccttcccttgcttgcagaacgggattccttcattagtgccaggaagcctccacccagtgggggaaattaaagtccccagagacagactgggtggcccaagcccactcctgccantggctgccccantctccttgacttccccacactgtttttagcaagagaaggaggtgactttgacctgaggcctgtcttcgaaaggaagaagggacttgagaaggcaggaaagtgtcattcatctggatctcacccntcaggagtgagaaggagcctggggcagctataaactcatgaccacaagaaaagggggaaccattatcttaaataccaagcgctgcagggaaaagctgacaactggtagctccctccccaccgccaattataaaactttctttggcttaaaagaaactcttttgcggccgggcgccggtggctcacgcctctaatcccagcactttgggaggccgaggcgggtggatcatgaggtcaggagatcgagacgatcctcgctaacacggtgaaaccccgtctctac

SEQ ID NO: 483019 - DNA, 418 bp, Homo sapiens
  misc_feature (395)..(395): n is a, c, g, or t
  misc_feature (407)..(407): n is a, c, g, or t
tagagactgggtttcatcatgttggtcgggctggtctccaactcctgacctcaggtgatccacctgccccgccccccaaagtgctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctggggtttcataaggatctggaagtggtgggattccttgtttttgctagtatctcatttaggagttggagatgggaccttaaantcatctgttttnaacttcacttt

SEQ ID NO: 483020 - DNA, 515 bp, Homo sapiens
ggccacccggcctataaagtacgtttaattaaaaaaacagctttgttttaattaaaaaaaaaaaaaaaggccaagcacagtggctcacgcctgtaatcccagcacttcgggaggccaaggtgggcagatcacctgaggttgggagttcgagaccagcctgaccaacatgaagaaaccccgtccctactgaaaatacaaaattagtagtggcgcctgcctatagtcccagctactcgggaggctgaggcgagagaatcacttgaacccaggaggcggaggttgtggtgagtggagatcacaccattgcactcagcctgggcaacaaaagcaaaactccatctctaaatagataactaactaaataaataaataaataaaataaaccaaaatgaagacaggtacagtgactcacgcctgtagccctagctattcggaggctggggcagaggatcgcttgagcccgggagttcaagtccagcctgagcaacatagcacaccccatcctaaaaaaaaaa

SEQ ID NO: 483021 - DNA, 265 bp, Homo sapiens
catcggcaaatcagatctagcaactacacatcaagctcaaagaagtataagggatgctatctcactgacgaacatacctaatagcttcgataactactctatgctgcttgaaaagctagaaattccaaactccaagaaggacaaggaaaacaagaatcctggttgcactgctgttattttgcatcgaatcaaaactctgggttccatgctgtcatttgttaacaaagcggcagtgttctgagcaaagcgcatgaggcctaatacc

SEQ ID NO: 483022 - DNA, 105 bp, Homo sapiens
cataaaataagacaaggccggagggggaacaactatggtatggctctatgtccctattcaaatctcatcttgaattagtactacctatcaggtatgaacacacag

SEQ ID NO: 483023 - DNA, 154 bp, Homo sapiens
agtgtacccacaaacagcgtataaccagtggactgtgactgttataattaaggagatttgtaaggagataagtatagcagaggtagagtatttcctcgtgatagtggttcactggataagtggcgtttgcttgcctgtttgtggaggtagcact

SEQ ID NO: 483024 - DNA, 622 bp, Homo sapiens
ccacgcgtcgaaaaaaaaaaaaaaaaaaaaaaaaaaaaaaaaaaaaaaaaaaaaaaaaaaaaaaaaaaaaaaaaggggggagcaacaaaaaaaaatacacaaaaaaggaccagagaaaaaccgacgaccacaaatgtaatagtaggcgacaacaggggacgcccaaaaagagaggcgcataatataaaaaccgaacaggcagcggggcgcggagtgtaaaacaacgtgcaagcgcggggaacaacgcggcgcacagaggagactctgtgtggaagagggagagcagacctcttatttctttgtgggcgggggtggaaaacataagtagtgggcgacacacagtatcctaccttagaaagagatatattatataaagcctgttgtagagggaaataatattattcaaaattattaaccagaagaggtgtttaataggggggtaaaacaaacaaaacggagcataatatggttgaggaggagggtaagaaaaattatgaggggaatacaagggagagtatatgtgaatttatgtgaaaacatttatttatacccaggggatagtatttgtgaaattaagagaaaatgatagaacacgggagaaaaaaaagaataaagaaaatag

SEQ ID NO: 483025 - DNA, 1002 bp, Homo sapiens
gacccacgcgtcgcggacgcgtgggtcgacccacgcgtccgaaagaaaagaatccccgaagagggcggtttgtgatgctcctgccatcgatcaacgtcacaccacttccgattgctagtccgcaacgcgccttgcaacccagtaggccagtttccatagactccacgccgttcctccaggaattatcgggggtgaatatgaccaaagaccaagcacttccctatgtaggagacccaagtcagttcactcattcctggtcctggggagacgcccagccagtttcctccactgagaccacgctttgatccagttggcccacttccaggacctaaccccatcttgccagggcgaggcggacccaatgacagattaccctttagaacccagcaggggtcggccaactgatggacggactgtcattcacgtgattgattagtaatttcatttctggagctccattagtaagggtttctaaactacagatgtcaactccttggggtgctgatctcgagtgttattttctgattgtggtgtagagagttgcatcccagaacactttaagagatacattatagccacataggggtggtatgaccaaaggttcctctgtgacaaggtaggacttgggaatagtaggatgacaatatcactgcttcttggtacatctctagatcgcaagtagacactgactgctgaacataccaggataaaagaagtgtaatacaacacaaaaaaaagggggacaacaaaagaaacaacaagggcccagacaacagacccaaaagaggaccacaatggaccaataagaagcgaacagcaagccccggccctgaccacccattccccaaaccacacgcggacacaggcaagcatacacgcggcaacgaacccacatcacggagtccccaaaggcaacaccaaggagaaaacaaccagagaccacaacacagccaagcgcgacccacgcctgcgcgccaaaatcaccacagcgaaatgccactc

SEQ ID NO: 483026 - DNA, 385 bp, Homo sapiens
cagtcaacggggtcctatgccttttacgatcccgactccagcatcgtctacctgttgtggcaagggcgacagcagcattcggtactttgagattaccgacgtagcctgcctttcgtgcactacctgaacacgttcagtcagcaagatgagccgcatcggtgcatgggtttcatgcccaaaaggggactggatgtcagtctagtgtgatatcgcccggttctactatctacacgagagaaagtgtgatcctatcatcatgactgtgccccgctatacctcttcctggacgatctgtacccggatacgccaggcccggagccgtccctagacgcggtcgaatggttatccggccaggacgccgaacccgtgctcctttcggtgaagg

SEQ ID NO: 483027 - DNA, 211 bp, Homo sapiens
aggtttggttccccccgttcccccccagggggggggggggggggcgtctaaaacagaccccctccttttcccaacggggttccggagtaacggttttggcgaggggcctttcccaaccccaagggccccatagttttttttttttccaatacccccccgtccctccagtttttcagtttttttaaaaagaggagggggggaaaaaggggga

SEQ ID NO: 483028 - DNA, 235 bp, Homo sapiens
ggcagcgatgctgtggtcgatctgaggatccccgcggcgcagctgcgagccccagccaaaggattatggggacgtttgccaggactgcattcatgattgtgactgacatccagtactgctgtacggaccaatctccacctttgtccaggcctctgatggaacatgtcaaggagtgagtgtgaccgcctgggcccttggcagtggctcgacatatgtccagaacttatatcagacc

SEQ ID NO: 483029 - DNA, 292 bp, Homo sapiens
ccccacttgaggcgcgttctggtaggagtcactagccaatttggacaggtcttgcacgtacgggcccaggatggggtgctcccgagacccgcagagaaccccgcactcttgcgggttcaatgagactctcgctatcccgctcacagtactatctccagtataagcctcaccttccacagtagttaggcatacgctgtagtcatctctggcttctcgactaagcgcatagcagacagcaggtccttcacaagaggctggcggcactgattgcctctgtctgccccttgggctc

SEQ ID NO: 483030 - DNA, 257 bp, Homo sapiens
gcggcgtctagcatgatgaaatggataacctgacacattatgctgagtgagaaaaaccacacacaaaggcacaaaggccacacattgtatgattccatttatactaaacgtccagaacaggcaaagccatagagacagagagtaaattagtggtttccagggactgggggaaaagggtaatgagtgagtgattgctaatgggtgtgggatttcttttgggggtgatgaaaatgttctgaagctagattgtggtgatg

SEQ ID NO: 483031 - DNA, 427 bp, Homo sapiens
ggtcacattttggagactgagctgagcaagtgctggtcacattttggaggactgagctgagcaagtgctggtcacattttggagactgagctgagcaagtgctggtcacattttggagacagaactgagcaagtgctgctcacgtttcagaggactgagctgagcaagtgctggtcacattttggaggactgagctgagcaagtgctggtcacattttggaggactgagctgagcaagtgctggtcacattttggagacagagctgagcaagtgctggtcacattttggaggactgagctgagcaagtgctggtcacattttggaggactgagctgagcaagtgctgatcacattttgaagactgagctgagcaagtgcttgtcacattttggagacagatgagcaagagctggtcacgtttcagag

SEQ ID NO: 483032 - DNA, 1303 bp, Homo sapiens
  misc_feature (382)..(382): n is a, c, g, or t
gcaggctggttgcttggtgtggaatcctaacgtggctggttttgagactggagtgagaccccagtcctaggctgctggttctttctcattatagaggagacggattcagataggggctacatgcaccacaggattgtcagaagacagccgagatcactagtagaatagagacgtctagtagagttaacgatctcctgaatgaggttgcataagttgtttataacttcctaagcccaatgatcagcgaaggcacttcctcgtttacttgcccatcttcctaacaaggctatgaggtgattagacagtcagcgatggagctgtgaagaggataacattcagcagaaggagtacagagtcacagacctccacgagggtgcaaagncctcatgcgtcggcttttagagtcgcggaatcgcagggaattaccggaaggatggagtcggacatggagtgactccacattctagaatacactgatttccttgacttgcggggcattgattgcattgtaccttggatcgggacgtgatcggacgtctccctttcgtgggccaagtcgaggactctactcgcccacactaggcatggaaccgtcattcgagtcgtttttagccccgacgtatgggcctgtctggcgacatgtactcaatgggatacctggcttgccccctgataacagatacaagttacaggttatcacccaggctcgcaacaattgcagtatggaacccgtgtgaactccatggtactcgcctggaaagccacttcacttccatatgcagctcgatacgttattctaacctccaccgcagaaatgttcccagtccgaaactccgttgcgtgaggcgtccaatcccttttggcgcacttgtggccccccacggttggccgcgctagtgggaatgcccgtctctgcagccaaatggctagcgggcttaggacgggaccgcaacggcgggctccgacagcccgataccgtacccggacggccaactccagaaaccccctgtacggcgaagccatgccgccaaccatcctagcgcctctggagcaacgacgaacacttcctctaacggcaaggccacctcacatgacctcagcccccacagccagtcctgcgcacacgttacaccccagggcacaggcacagactggcatcgcaaacggacgaagtaccgcacacagccccttcggacaccagctcgcaatctgtcggaagcccctctccgggaaaactacaccccgtggcactaaagagcaaccccccatggagacacaggatgccacgcacccgcccaagggc

SEQ ID NO: 483033 - DNA, 119 bp, Homo sapiens
cagaggagagctccaggagagggcagctctgaactgctggctgtacagctcagtaggaacaggtgagaggaagtcttctgaggcagtgggctcgacgccagtagcctcctcggcgtaca

SEQ ID NO: 483034 - DNA, 218 bp, Homo sapiens
  misc_feature (8)..(8): n is a, c, g, or t
  misc_feature (107)..(107): n is a, c, g, or t
gagcctgnaggaagcccagataggcatcttcacgctgctgcacttaacttgcctttcccataaaaactgttgagaggaaaatagcaatgttatctagagcctaaagncgaaagatgccaaatccatgcttgctactccacagttcctttatgaaaagtatttcttatagccaaatatcccaattctttgtaccacacatgactaatctcgctactatt

SEQ ID NO: 483035 - DNA, 240 bp, Homo sapiens
ctttcctgttcctcctcctccttgaggtgtgtcttcgtggttccagctgttgagtcctccgtcatcaccttcatcttcctctccagagctgaggctgatgttcattgcctttgctctgttctttcagcttcttggccacctttcgccgaagtttagttctccaggttatagtagcgacctgagctccttgcgccccaacactctgatgtcctgaccgcacacccgttctgtcctcagtgc

SEQ ID NO: 483036 - DNA, 211 bp, Homo sapiens
agacacaatcctggtcacgttgaagttggccagtcggtgaccaccattcccactgtggttttcaacggtggagacggtgacttacaaagaatgtcacgttcaacgtatgggatgtgggcggccaggacaacgatccggccgctctggcggcattactacactgggacccaaggtctcatcttcgtaggtggactgcgccgaccgcgaacgt

SEQ ID NO: 483037 - DNA, 971 bp, Homo sapiens
gacgtgactattctctacaaaccacgaaagaccattggaacaactatacctatattcggcgcatgacgctggagtcctagcacagctctaagcctccttatacgagccgagctgggccgaagccaggcaaccttctaggtaacgaccacatctacaacgttatcgtcacagcccatgcattagtaataatcttcttcatagtattacccatcataatcggaggctttggcaactgactagttcccctaataatcggtgcccccgatatggacgtttcgcccgactataaacagacataatgcttctgacatcttatgcgcccctcgtctccgtactccatgctctgcatctgctatagtggaggccggagcaggaacaggttgaacagtcttaacctctccttaacagggaactactccacacctcctggagcctccgtagacctaaccatcttctccttacacctagcacgtatctcctctatcttaggggccatcaattttcatcacaacaattatcacatattaaacccccatgtccataactcgcaatatcaaacagcccctcttcgtcttgatccgtcctaagtcacatgcagtcctacttcttcctaatctctcccagtcctagctgcattggcatcacgtaatactatgtaacagaaccgccaagcgtcaaacaccatgcttctttcgacccgacggaggacgaagaacccccattctataacaagaatcctatctctgaatttttccggtcgacccctgaaagatttactattccttaatccgtaacagggctttcggaaaaaatctccccatatttgttaacttgaactactccggaaaaacaagacaccctctgggataccatacgctcttgggtcctgagctattacacaccacagtgggctatccacagggtttcatccgggtggagacacacgcacattttttcaggtcggcagtaga

SEQ ID NO: 483038 - DNA, 611 bp, Homo sapiens
ttgagaaagaaatagtggtttctatttacaaatttcaggtgtctgtccacattttgcccatggcctcactttatttttgagaggctctgaaacggattcaatttctctgttcatgaatcgatacaaaatcgtaaggcggttgggacttgtaaacgacatcaatacttggggtgtatgggtagaatcaaactgagaagggcctaggtttgtggcagcagagttccttactttctctctggcatcattaaaactatctgccacgtaatgcaggggctggaacaccgtgacagtgtaattctgaacggctgtcttatacaggtgcattgggataagctatgtcttctctgataatcagaggtgtaatacaccatagcatgacataagcacagctccatatgcctttatagagtctcagtgtctgcagagagctaactacacagtgaatcagtacattgtgtcgagcttagcaatgtattcatagtgtgagtccagaaaggcaagtgcaatgtcctggcagaaatgggcaaagctgagatctgaaagctagggtagatgagcccactgctcatgtcagctcccagttgaggggtatgcgtcgacctgtatacatg

SEQ ID NO: 483039 - DNA, 700 bp, Homo sapiens
gaagaagtcggcagcagccacctcaccagccccacacttgagtggctggacccctgctgggcactgtggggaagtgcgcctgccactgtcactaacctactggtgggcacccctggggtatggggtgcccctgcgccccctgctgtccagttcattgcccatgggtggcccctggtggtgggaccactgcgtggctcaggagcagtgtgctgggagttggcccaattgggccagtacccctgggcatcctgcaaacagtgtgccctggtgcaaggctggtgggaatcacccagtgtacagtacatcctgcccacgctgacccagacagcttcatgtgtggcacctgcgcccagcaccatgcccctgggaccaatggcagctggctcccatgctggcccgtgcaccacaccaccagcatccgtttcaccctcccactctgggcacttccaccgagctgggcaaagtccttggcttgccacttggaacccccaagggtcccttggggcagattcctcccaattcctttggcatgtcctttgtaacccgcttcccggggcatggagagagcaggagaggggccagcaacaggatagcacctgggtgcgacagagcaaaaggcgaaaaacagaacggcgcaggacgagcgagagggagagggcgaggcggagaagggcagagagcgggagagacgacaagggga

SEQ ID NO: 483040 - DNA, 333 bp, Homo sapiens
  misc_feature (132)..(132): n is a, c, g, or t
ggggtttaaactttttttttcccggttttaatttgggaataaaagggggcccctttttggaaaacgggtttaaaaaaaaatttaaataaaatatttaaaaaggaaaaggttcccagggttttttggaaaaanccctggtttcccccggggaaaaaaaaaaaagggtttcccgttttttaaaaaaaaaaaaaatttttttttttttaaggaaaggggcaagggttaaaatttggggccctccccaaggggggaaaatgggaaaatttttttttaaaaggaaaagttaaaaaggtgtttttaaaaacttaaaaaaaaaaatttttttccggggga

SEQ ID NO: 483041 - DNA, 310 bp, Homo sapiens
gtcgacggtgacgataaacagcaagaagccccgtgcaatcagcgccgaacgatgcaggtcggtataggcttcgctgaactcgttggcgatgaccgaagcgatggagctgcttggcatcagcaaggaggccgagaactgttgagcgttacccagtacgaaagtcaccgccatggtttcgcccaatgcccgtcccagtccgaggaaaatgccgccgaccaccgcagagggatgtaaggcaggacgatgtcccagaccacttcccaggtagtgccgcccaacgcgtaggcagactctttgagtggcgtgggaa

SEQ ID NO: 483042 - DNA, 394 bp, Homo sapiens
  misc_feature (22)..(22): n is a, c, g, or t
  misc_feature (57)..(57): n is a, c, g, or t
cagtctcattcctccccagaantaaccttgcttcgggtgcgggggttgggtgcattntcaataaaaaaaacttatttgtttcatttttctttcctgcggggttttcttcaaagcaacacgtccttggagctctcttggcaacccaaaggcttttccctggaaaagctctttcttttcctaaagtatccgaggcccacttctgcaacacctggttggcgagggctttcttttttttaatatacgctcgcgcgtgggtcgccggtcttgacagagctctgtgttttctcagcttcacacctccaggttgtttctccagtgggttgggttttcatacagacgtaaattttgaaagaaaagtcaaaggtgcttcagccttgtactgtgtatatatatt

SEQ ID NO: 483043 - DNA, 563 bp, Homo sapiens
  misc_feature (319)..(320): n is a, c, g, or t
  misc_feature (333)..(333): n is a, c, g, or t
  misc_feature (414)..(414): n is a, c, g, or t
  misc_feature (456)..(456): n is a, c, g, or t
  misc_feature (458)..(458): n is a, c, g, or t
  misc_feature (481)..(481): n is a, c, g, or t
  misc_feature (546)..(546): n is a, c, g, or t
  misc_feature (549)..(549): n is a, c, g, or t
agggggctacgagccgtcttccctgagagatcgcccaaacccagcgtggcggcccccgcttctttttcccaggaccatccagagagcccacactgaagatgaatgggggtataaacaccccacgaccgcccaatgtagaaagctgccctggcccctggagaaaaagcgtgagacccggccccttttggatcattctaagcccactgggttcttgccccgccaccggagcacccccatcttcttgtgacttctcttggagacattaccttcctagatgaggaaatgaaagcttatccagaaagaatgggtgaccaccctnnagcccaacctccnccacggctgggtggccccgaaggctgggctgggcgaagtatcttttcgaaaaggctcaactctccagcaccgactaagaanccttttgagcccacgcgaacttttgaagggccccttgccaantnaatagggcttctgcctaagcctntccctcccgacccataggcagacttttttaactatccttaccagaccttgggcccaatgggaatnaanctttttgaagccca

SEQ ID NO: 483044 - DNA, 257 bp, Homo sapiens
  misc_feature (78)..(78): n is a, c, g, or t
aggcaaaggtcagattggtttaggcaaaaaagatcttcaaactattcttatgacagaccctaaactctaagttttgtnccacagaaataatttactaaagagagacgtcagctgggaggagccaacaaaatgctgagtaaatcagatatgacctcagaaacaaaatgaaaattactttgccttcatatgtaaaacagtgtatttttaataaaataccccatacatttcttggcagtgaatttcaaaactctaaactg

SEQ ID NO: 483045 - DNA, 132 bp, Homo sapiens
  misc_feature (54)..(54): n is a, c, g, or t
ggctgggtgactctagcggagcttattctgcaccacagctggaccagatggtancctttgacaggacatctagggcgcgaggagtgcgcaagcccaagctgttctacgccgaacaccccttcatcttaccta

SEQ ID NO: 483046 - DNA, 477 bp, Homo sapiens
atggccaacattcagagattgcatttcatgaaaggactttggaaatatctgaaatttggggaaatgtacttaggaggtggggtcagtaacagtttaggtcttatatacacaaggacaaaatttcaccctcctcctagaacattagggagatggattaatgggagagatgtgactcaccaagggcaatattacatttataaacactgaaagaatatactagtttagaaagttttatcatcagccctgctttttcagatgtttttattcttgcattttttgcacatttttattatttgctaatgtaattctcctttccaaagaaaatctgacttgcttaaatgaatgtttaaagaagttaaaaactgcacagtggaatccacatttaagaaacccctttatgggcaaaagtatttgtctctttctcaaacagaaattttatgttgctgttaaaacaaaagtggcttgatttcttagata

SEQ ID NO: 483047 - DNA, 426 bp, Homo sapiens
  misc_feature (240)..(240): n is a, c, g, or t
  misc_feature (265)..(265): n is a, c, g, or t
  misc_feature (337)..(337): n is a, c, g, or t
  misc_feature (363)..(363): n is a, c, g, or t
  misc_feature (393)..(393): n is a, c, g, or t
  misc_feature (422)..(422): n is a, c, g, or t
cattccattccattccattccattccattccattccattccataccattccattccattccattctattcaggttgattccagtccattcctttctattccattccattccattcaattccattccattccattccattccgttccattccattccattatattcctcctgagttgtttccattgcatcccattccattccattaaactccattcctttccattacattccattccactngagggggggcccggtaacccaattnggccctatagtgagtggtattaacaattgactgggccgtggttttaacaaacgtcgtgaatggggaaaaccnggggcgttaacccaatttaatcggcntggcaggcacattccccttttgggccagtngggttaaattaggcggaaggagggcccgnaacc

SEQ ID NO: 483048 - DNA, 508 bp, Homo sapiens
ctggagattccgttagtctctgctaaaaatacaaaaattagccaagcatggtggcacaaggctgtaactccagctactcggaaggctgaggcaggagaatcgcccgaacccaggaggcggaggctgcagtgagctgagatctcaccacggcactccagccctgatgacagagcaagattccgtctcaaaaaaaaaaaaaaaagggtagagacgggattctcactatgtggcccgggcgggtctcagaggggctcaacatattcctcccacctctatctcccaaagtgaggggataacgggtgtgagccatgtataccgggtttaagatctagatataaatcaaaagatagggtacaggtggttgggtgtcttttaatggtgggttgtcatggttgggtattggatgtggccttcttaaagggaaaagggggcatctaataaggggtataattccatattcttaaacttaaacgggttaataggggaagggtcctaatacattttattt

SEQ ID NO: 483049 - DNA, 682 bp, Homo sapiens
  misc_feature (10)..(10): n is a, c, g, or t
cacgctggcnggagcggcgcgacttcctgaaggtccgggattggccggagcgcccgccgctcacggtcaggggttgccggatcccgtccgcgggcgatgctgctgcggagggtggtcgagggaggccgggcggtagccgccgcggtccgtggctcggcaagtaccaggacgggtcttggcagcgccgaagggcacgtccgagaggccgctgtccgggggcccgcacgtaccgggaggagccccggcccctccacccgcatgtggggacggagccgggaggatcgcgcgctggccgccgccgaaggacccctcgctcctctcctccatcggctcttaccgagtccccgccccggaatctgtggaggggccgcttagccttgggagaggaagcagcccggtgaacggccactttcctgcatgagtggctgccccaactgcgtgtgggtggagtacgtggctgatgagaacctcaaggccttcctcaggatggagatccggctgcacaccaggtgcggaggctgagccatccctgctggactccctaccgcaggacggagtccaggacgcagccgcagcctccttccttcacaccccctcacagactccttgtgtccaacgggaataggaagaattagttactgacttcacctgagaaaaaaataaattctctatggtggtttca

SEQ ID NO: 483050 - DNA, 116 bp, Homo sapiens
tctagaggtctccaaacacgcatctggactggatagcatatcgctgaggtcaagggccagtatgaggagattgcgagtgctgtgggcgtacggagagcgagttcgtggtatctagg

SEQ ID NO: 483051 - DNA, 489 bp, Homo sapiens
aaatgtgtggtaaggtggggggcatccatatagtcactccaggtttatggagggttcgtgtactattaaggcttttcacttcgaaacgaaggcttctcaaatcatgaaaattattaatattactgctgttagagaaatgaatgagcctacagatgataggatgtttcatgtggtgtatgcatcggggtagtccgagtaacgtcggggcattccggataggccgagaaagtgttgtgggaagaaagttagatttacgccgatgaatatgatagtgaaatggattttggcgtaagtttggtctaaggtgtagcctgagaataggggaaatcagtgaatgaagcctcctatgatggcaaatacagctcctattgataggacatattggaagtgagctacaacgtaatacgtgtcgtgtagtacgatgtctagtgatgagtttgctaatacaatgccagtcaagccacctacggtgaaaagaaagataaatcc

SEQ ID NO: 483052 - DNA, 233 bp, Homo sapiens
gacaccgcaatctcaataaagggttcattgcagccttgactcctggactcaagagatcctcctgcctcggcccctgagtagctaggactacaggtgcataccaccatgcccggctaattcttacacattttagtagagaggaggtctcactaacgtacccaggctggccttgaactccgtgggcttaacgctgtcctcgcaaccttggtccatgccgaaagtgttgggattac

SEQ ID NO: 483053 - DNA, 428 bp, Homo sapiens
  misc_feature (8)..(9): n is a, c, g, or t
  misc_feature (388)..(388): n is a, c, g, or t
  misc_feature (420)..(420): n is a, c, g, or t
  misc_feature (426)..(426): n is a, c, g, or t
gttgaaannagttatatactatatgttaacaatatggaggctgggcgtggtggctcacacctgtaatcccagcactttgggaggcccagactggcggatcacctgaggtcaggagatcgagatcagcctggccaacatggtgaaaccccttctctactgaaaatacaaaaattagccagacgtgatggcacatacctgtaatccaagctgcccagggagctgaggccggagaatcgcttgaacctggggaggtgggaggttgcagtgagccgagatcatgccactgcactccagcctggggcaacagaggcaagactccatcttcgaaaaaaaggaattcctcttgggcagatacttgaagtttattttgaaaatttaatttcgtccnttttttcattgtaatattttcagggttaccantttccntt

SEQ ID NO: 483054 - DNA, 401 bp, Homo sapiens
ctaaccacggtcacccccatggcagccacacccgggctccgacggcgtatgtctatgcaactcattccagccaccctcagcgcaaagccaacagtactgctcacataaaaggccagcccctgccccctccaaaaaaagacagctcctaccatcccagacactgcaaaggaccatactcttacccaggatctactggagcagctgttggagcccatgacgcctgtggggatgcgagaagcgctctaatagccaagacgcagattcgacctggaagctctggggcccctgagaacttgacattcaaggaacgccagcgtctttcctcacacggtcaagaagtgtcccatagagtgaaagcttctcgtatattaacagaactggagaatgaactgtacacgtgg

SEQ ID NO: 483055 - DNA, 244 bp, Homo sapiens
tcaatccacagttggttgaatccacggatgaagaacccaaggatacacaaggccaactgtatgtggaaattttaaaaatatttttctggctgggcacggtggctcatgcccgtaattccaggactctgggaggctaaggtgagcagatcactccaggtcaggagttcaagaccagcctggtcaacatgatgaaaccccgtccctacgaaaaatacaaaaatcagctgggcgtggtggtgtacac

SEQ ID NO: 483056 - DNA, 211 bp, Homo sapiens
aggagttgagacaacccaggcaacatggtgaaatgccatctctacaaacaaacaaccaaacaaaaaaacaggtgtggtggcagatgcctgtggtctcagttactcaggaggctgtggtgggaggatcatttgagcccagtaggtaaaggctgcagtgaactgtgatcgtgtgacagactccagcccgggtgacagagtgagaccctgcctc

SEQ ID NO: 483057 - DNA, 1385 bp, Homo sapiens
  misc_feature (80)..(81): n is a, c, g, or t
  misc_feature (84)..(84): n is a, c, g, or t
  misc_feature (536)..(536): n is a, c, g, or t
  misc_feature (791)..(791): n is a, c, g, or t
  misc_feature (944)..(944): n is a, c, g, or t
  misc_feature (1102)..(1102): n is a, c, g, or t
  misc_feature (1177)..(1177): n is a, c, g, or t
tcgtgcgtgtgtgtgtgtcgtgtgtgtggttggtgtcgtgggtggaggaggggggatggtgggcagacgaggaaaaaaanngtngggctacgtatacttttccgtatgtccctccctttgggtctgtgttgtcgtcgtgtttggtcttcgtccgggctctcttcttgtggtgtgtcttgcctgtttatgttatgttcggtgccgttgtgtggttgttgttttcctctcctcttcctctctcctcttgtgtgtagtttattctgtcgttctcccccgccgcgttgtgtgtggttgtcgcattcactcgctgtgttgcgtcttgatgtgttgtttcacccacgagccgcccgtgcgggtgtcgtgattggtttgttctgttgtgtggacgagagggtgttttttcgcctcctcttcgggcggcggctttgttggtgatcattctctgcggggcgcgtcttttctctccgcctaggaatgtttttgcgtccgccgcttcttggaaggaagcacgcctttgctttggctctgtcacacgncgcgtggtgtttgtcatagaaggtgagttgttcgcccccccctcccccccgccccccgtgtgtgtggtttgataaaatacggcctcctccccgcaaaagccgctgaggaaagatgggggcgcattttctagatggagaacttcttacggctcgtctggtaagacatgttgggcggcgcacgctcaccgagaggggtgtgggaacacatctcttgtccccccctcgctgagtctgtcccccacgtacggaacgtgngggctgatctaagaaattgctctttatctcatggtgactcaccccgcccgcgcccggctcctcttggacccaagggtatctctcggggcgctctctctacgagagagagatacatacagaagactcttcgtctagacaccgcccctctatttntctcgatcgacagagaggtgtcctctctatatcgcgcgtttgctcgaacagcctggggagcccccccactcactctcgcgatagagcccccctctgtgtgagacatatagtgacaaaatatttgtgtgcatatgtctatgtctttttcgcgcgccccncccacgaggctccccgcctgggttactttcagaaaagacatgtgcggctccccggtgaccaactcacagtgcggngaaactctcacatagtgcggcccccccatagatatatcccgcgtgacctatttatggtcgcacacctccattctctttggaatctgtaccgggttctcctcttagcaccccaccacccagcttgtctatgtcacccatgtgtctctaatgttacaatgcgaacaaaatactccccgtcctttgatacacaaacaatagaacaagaaaa

SEQ ID NO: 483058 - DNA, 114 bp, Homo sapiens
ccccagcatccatgtaccgagtgtccggcaaatgaaagcttccagccctggcatctacgggtctccagtgaaggcggccacctggcagtgctgatcccaccctgcaggacagga

SEQ ID NO: 483059 - DNA, 109 bp, Homo sapiens
tataggtgtagagcgtggtgcccagctgacaaccagaactttccgcagaccttgttgctttatggaccttgggtatctctctgcagtgtcaatgccatcctagaccact

SEQ ID NO: 483060 - DNA, 105 bp, Homo sapiens
  misc_feature (25)..(25): n is a, c, g, or t
  misc_feature (98)..(98): n is a, c, g, or t
agggccactcccaaagaccagctgnatcttgtgttctggggtttaggaagttggttgctggagatggtctgtttaagttttagttttagaatttccanggcgaca

SEQ ID NO: 483061 - DNA, 422 bp, Homo sapiens
tttttttttttaagataaggtctcactccattgctcaggctgcatgagttatactactacaaaagttatactacttgactgcatgcgggtaggggggggggatagtgtgagcaccacaacccttgcattgttcaagagtcaactacactttaagaatgaatttaattctatttctcgataaagctgttattaaaaattgtatagtcattctaaattttgaattatgctaattaatctaactctgatatagatatcaaagttttgttgcagttgttattttaactcaggtacttggaaatgtaaatcaatatttcaggtatcccagctcctacgaaattctaacatctaatttcaatttctctccctgcaatttaattccactcaaccttgaggtcgacgcggccgcgaatttagtagtagta

SEQ ID NO: 483062 - DNA, 149 bp, Homo sapiens
gcacatactggggcctggtcacatgtagacctgagctgagactactctcccagcgggtaggggatgcttccagccggatatacatctctccaaatgaggaccagtaactgagaagtagctgaggagaagcaatgccaaaggtgacatgg

SEQ ID NO: 483063 - DNA, 275 bp, Homo sapiens
ctgtcttcagtatcacatagcatcactgctgcttccggtccgcccttctggtgtcttgattgtgtcttggtgaagggaggacatgttggacaatgtcatcttcacatgcaggtggccagaagcatgaggcacacccctgctgctttgccggggttccagtcatcgtcatcgtcctttcctgttctgtgtggtttgtgtctgtgtgtggcttggtgcctgatcgtgtcgtgctcgcttcgcatcacaggtgctggtgtgctcggggggccgatcct

SEQ ID NO: 483064 - DNA, 191 bp, Homo sapiens
gatggtagattggcagcttgacagcatgaggttatggaagaactaaaaaacagttacaactaaaattttgtctttctggaacaatttgttatagaggttacagtttacatcgattataactgcatcataatataaagataaccatgagtattaatttaaagaccttatgttcagtatgttatttcatgaag

SEQ ID NO: 483065 - DNA, 881 bp, Homo sapiens
tgcggtggctcacgcctgtaatcccagcactttgggaggccgaggtgggcggatcatgaggtcaggagatcgagaccatcctggctaacacggtgaaaccccgtctctactaaaaatccaaaaaattagccaagcgtggtggcgggtgcctgtggtcccagctacttgggaggctgaggcaggagaatggcgtgaacccaggaggcggagcttgcagtgagccgagatcgcgccactgcactccagcctgggcgacagagcgagactccgtctccaaaaaaaaaaggaaagaaagaacagagtaaacagataatctacagaataggagaaaatactcacaaactgcacctctgacaaaggtctaatatccagaattcaacaagcacgaaaccaaatactcccattaaaaaacgagcaaaagaacacatacttctcaaacagaagacacactctggggactgtcgtggggtggcgggaggggggagggatagcataggagatatacctatgctacatgacaactcatgggtgccgcacaccagcatggcccaatgtataccgtcctggtaagttaacccgggaacacgtgccaacttgtacgcctaagaacttaacgtatagtactaatacattcaatacttgaccctggaccacaccacgtagacttagtacggcaacacgttcttgaaaagtgctgcattcccatacaatctagaatgcattcatgtcagatttattcagcccacagatatctgcagcagcaggcgtgtggtgaatccaaagggccaaagggggtcttaaccacctggaacatggctccagatcacgctacgccacgctgcagcctggccgctccctgaccctctacaacccccccagcg

SEQ ID NO: 483066 - DNA, 445 bp, Homo sapiens
atgggctagtattcagtatggtctcccttcctatcagtaaaatgaaaaaaaggttttatcaacactcgtcagaaatccaacaggcttaaggatgacggctaacacaatggaggcacaccaagaataatttataacaaagtaaaacaaaccagacttgtctacctcgtgaaatgatcaaaactatctctgtgaaagaacaagaaactcaataaccagtctttgggaaacaagcaatctattctctctgttaacgactgtaatttttgcaaattattccaattattccaggatttttttttttttttggagagggattcccattttgttgcccaggctggagtgtaagggaaatctcagctcattaaaatttccacctcttgagtagatgggactacggacacgcaggaggtgaatttggcagcgagcacaagattgcagacgggaa

SEQ ID NO: 483067 - DNA, 290 bp, Homo sapiens
tgcagtcttctggcccaccgcttccattgcaaccccttgttcgggctctccgtttaccggagaagacaccgtgacagactaagagggcaagttcatattacgtggattgctgccgggatgtgtgtaccacgttcagctcatggcagaaggctacgaccacattgagcgggcgctcccccaccatagggtgattgaggttgtgaactaatgacttccatcatgttcacttcatagttttccggcagattaatcaatttgatttaagtggaactgtgatcgtcgggttgtaa

SEQ ID NO: 483068 - DNA, 336 bp, Homo sapiens
  misc_feature (6)..(6): n is a, c, g, or t
ggcaanccctgtagggaacggggcccttcaaagttagctcaggaggcttggaaagcatcaccctcaggcccaggtgcaagtcgcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcg

SEQ ID NO: 483069 - DNA, 337 bp, Homo sapiens
tacagtgatatcagcgtctgtgattcagatatgagctacatatcatagatggcacatggctgccgtaagtacaaaaatcacactgactgctgggtgggccggcaacagaaaatttgttcttggtgagtcttactcacgtcccggcagtatactattttccaaaatgccccaccaaaggatttcctcttacatcatattagccagaactgggacatattatcaccctttatctggggtagaggcccacatttccacatcacagggaatctgctcaatgcctaaatcaaactggaactcagttacgcaacgaagaaacagaggactggtctttgggtcg

SEQ ID NO: 483070 - DNA, 721 bp, Homo sapiens
ccaaggcgcttctcttggccccggctgttttgaaaagctcgcaaacgtgccccgaaaatatccgattattgtgtccagaagaacactatctgtgtctttagtgccacacgcaatacgccccttatacacctaccctgtgtggggcattattatgtgcgaggcggggtgccctctcgcgcgcccatgttgtgtttctgggtgcacacacaattgacaggtgcgcgccgctgtacatcacgaaggttcccactccccgcgtgatacgacgcgagcaccgcgggaacccgtagcagaatggtcgcggaatgcgccgatagagggggccgagggagatcacacagcaagagacaaaatcccgaaacagcaccgtgccacgacgcactccgagaaaaaagagacgtccacgttttccccaacacctggagaactacagtcacccggggtgaaaactcgggttcccacgggcgcgcccaggatcacccactgactagacaccccacaaaggcgccattcaatctcgatgtcacagacgatgtcgaagcccgtcgtgccccaccgcctaaacaggcaggcataagtcctctgctgatcctcccacaagcgggtgcgttgagaacaacgggtgaatacactggacccgctggggccgagaggcccgggtgcgcacgctccgcccccacgggcccaaaaggaacccatcattttaaccaaacaaaaacaa

SEQ ID NO: 483071 - DNA, 295 bp, Homo sapiens
  misc_feature (119)..(119): n is a, c, g, or t
  misc_feature (125)..(125): n is a, c, g, or t
tgtgaaatgaaaagacgaaaataaggtaagacaaacaaaaaaaaatttcagctgctcgttctgctgccctcatgggctgagccaagtgtgctcacggctgcatctgcaaagggacgtcnaaaaantgggggtggggtgcttgatgtaaaaacagctcttctcccagatgttaatagaacaacctgcacaacctggattttttttttatacaatactgagccatttgctgcatttctttttatattaaatatgtgagtgacaataaaacaattttgacttgaaaaaggggggaaaa

SEQ ID NO: 483072 - DNA, 380 bp, Homo sapiens
ggaaagagcaggatgtcggccaactttttctgtacagggccaaacagtaacagctcaggttatcaggatacacaatctctgttccaaacgtactcaactctagtgttggcgcggtgaatgtcaatgacaagaaagaatatgttaaaaaaaaacaaccaaaaaaaacgggatatggagccaaggcgcagggagctcacgcccaataccagcactatgggaggccaagggagaggggctcactagaggtcgggagtacgaaaccagccggaccaacttggtgaaacccggtctctaccagaaataccaaaaatagccgggcgtgggggcacacacctgatatcccagcaacaagggaggctgcggtgggagaatcgcttgac

SEQ ID NO: 483073 - DNA, 205 bp, Homo sapiens
cagttaaccttcatcgaaacccctcatcaaaccctgaaaaccagtacaccactacattcaattaacgcggttatttgtggggccttcttatattgctttccgcaggttcacaagcaatacccaaataaagggtttgatgaaaccctcagatcaaagttaatgatgtcaatggaaagggtttgatgacagggtttgatgagggttt

SEQ ID NO: 483074 - DNA, 208 bp, Homo sapiens
cccggcccgaagagctggtattgaatggtgtatggaaggactgttgcccgtatcatacatgattggtccctgactgcactacagtggtttatctatgacccgtgaggtctactgtcagcttgcctcgccctcctccacccgagatgccagagtctctgaaggaagaagcttggttaactcagtagttaagatcaaagcaaatgtggac

SEQ ID NO: 483075 - DNA, 313 bp, Homo sapiens
ggaggagcagagctctagttctccctctacgctctgcggtgtgatgcacgggaaggaagtgggcagcatcttctggaagaagggcgagactgtataacggatcccggagccgagccgtgcccggatctaccctctccgggggctcctgccctgaaagcattaacaccatcaacgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtg

SEQ ID NO: 483076 - DNA, 84 bp, Homo sapiens
tttttttcatggggaaaatgcaaattttgtaccaaaatggttatatggaacacgcctattaaatgaattttactatcttcccta

SEQ ID NO: 483077 - DNA, 107 bp, Homo sapiens
cagactgcgccgctgacctcagctgcctcaggctgcctggcactgtctcctcctccagagcctcccgcagcgtacgatctcgatcggcaggcgctcggccccgtgct

SEQ ID NO: 483078 - DNA, 218 bp, Homo sapiens
  misc_feature (11)..(11): n is a, c, g, or t
  misc_feature (202)..(202): n is a, c, g, or t
  misc_feature (204)..(204): n is a, c, g, or t
ggcggatcacntgaggtcaggagtttgagaccagcctggccggcatgatggagccccgtctttactatgcaagaattggctgggcgtggtggcacgtgcctatagtcccggctacatggagagctggggcaggagtcacttgagccaggctggagtgcagtggtatgatcttggctcatggacgcctctacctcccgggctnangtgtcctcccgcct

SEQ ID NO: 483079 - DNA, 248 bp, Homo sapiens
  misc_feature (43)..(43): n is a, c, g, or t
  misc_feature (47)..(47): n is a, c, g, or t
  misc_feature (66)..(66): n is a, c, g, or t
  misc_feature (156)..(156): n is a, c, g, or t
gtgactctgacgagcttataaatagccgacgaatagatactantatntcactatacttttgaattnatgcaggttaaacattagactttcatataagcttattctttcagcttcatgaatatgttagtttataatttttatcacatttgaaaaatnattttcaggattccagttacacatatcatttccaagactccagttgtacatacatcaagctgcttgaaagttgtcccagaatacactgatgc

SEQ ID NO: 483080 - DNA, 660 bp, Homo sapiens
  misc_feature (318)..(318): n is a, c, g, or t
taggcatggtggctcacacctgtaatcccagcactttgagaggccgaggcgggtgtatcacctgaggtcgggagttcgagactagcctgaccaacatggagaaaccctgtctctactaaaaatacaaaattagctgggtgtgctggtgcatgcctgtaatctcagctacttgggaggctgagacaggagaatcccttgaacctgggaggtggaggttgcagtgagtcgagatcatgccattgcactggacctgggcaacaagagtggaactccggctttacaaatatatagagaatataaaatattaaaacacgcggnttccccccagcaaccggaaaaaaaaacaaagcacacacacagaacaacaacaacaaaaaacggtgtggtgggcaggcccacgggcgacctctgaaaaaaagactattacaaaaacaattgctgtggggggggccaggggaccccgagtagagcacagctcgaaagtggcaccagacgcggatcccccaggaacaccccggagcaggaacagggcggggcgattccaccacataaaaaaaaacccgcggggtcacacgagggttcggacagacaccgacatgagactacagaggaccgaggctcaccacaggggtcaaggacgcatataaaagccccgcgggt

SEQ ID NO: 483081 - DNA, 211 bp, Homo sapiens
ccccgcgggctgctaaggccgaggggatgctcatgctgcagaggtcggacctgtgttctgctctgtggtctcttgcatccctcctgcaggcgcagccatggcacagccaaaggcacggagggagagacagcaagtcacgtggctgggctcagcattaaggggtggggggacaggcctgccactttattgtccgctctgcaaggaacccacg

SEQ ID NO: 483082 - DNA, 809 bp, Homo sapiens
aagacagggcggacgggcgagtggtggaagggaaccacactgtgtaccgcatctcagccccaactccggaagagaaggaagactggatcaaatgcatcaaggctgccatcagcagagaccctttctacgagatgcttgcagcacggaaaaagaaggtctcctccacaaagagacactgagggggcaccagggcatggccagcccatgaggctgtggccctttctcctgcctcccctgagggcgctgtggagccaagcagaggagagcagagggcttctctgccagttcctgccgttccgctcctagagacttgcttcagcttttgcagttttctaagtgggagaagggtgggcggcgagggataggctggagactgcggctgccctcatggctctggagtcgctctcagagccagcagctgccagcagctggttcacagcctcagctcagcagggctgaggcaccacagggagctcgctctttacctctcagtgttcctggccaagggccttcgcctctgtccgagaatgcctgtaaggatgtactctgtgtactaaggagagagggggaaaggaagagaagccacgcactattaagatttattttggttttttttaaagcaaaagtgaacgtagcactgtactctgccctcctgtgcctgttccctaaaaggggggcctgggggctgcgggcaccccaggctgcgggcactccagggcgtgctcatgactgtgtgggccagacggcagagccgactgctggagggccacaaaaaagagctcaggcccacggaggcggttggggtcccc

SEQ ID NO: 483083 - DNA, 761 bp, Homo sapiens
ttattaaatctagtgtagtttatgttggttgttactaagccattgattcccttcgagtttcatagtttgcgaagtacacattaaaggaatccttcatcaggagcgcagggctacggtttcctctgaatctgtcaatcaatttcagggggatcttttaaaaagctaaatgagccttagaacgggactactgcaggatagcagatgcgagcgtctctctaggacatgaagatcattgcagctacgccagccactccgagggtgcactccaaaccgtcgtggtatgtgtgtcgaccacgagagagggcctgctctgtcttgtgttctaatacaagtataggaactgccgatctgtacaatgagagtgccgttgtacacgggaatctgacggaacacatcgcgcgttgtccgagatcgaatcccacacatgttacgtcctgcatccttttgctaccaaggaacgaatgagatccaccttacgtaccctcgtgctccatcgagaactaacagggctaatagtgggagtatttccacccacattttatatatccgaggctcgtcattgcgtgagaggtcaccagtcgaaaagagcatcggcccggcacacgtcttgtagtagcttatgcacctcataggcggatcgcaagcatgaactggaacgcccgccttttagtgtatgtacccagccgtttgccccatgttatgtgaacgatgaaaaaaagcttactgataagagcgtccgtaaacacacagtccggggccgt

SEQ ID NO: 483084 - DNA, 507 bp, Homo sapiens
agcggaggggccttgtcggttctgcggggcgagcgccttcgcggaaacactccaatagtagcctctgttggagccttgttgagtatcttcacacagccttcaggagggacccttttatcatgcgacccatgccgcagtttacagaaggaacgcttggtgcgtgctttgggacgtatggatcacttttaaagctttttcctttgaatgctcagacagcttgcggggggcttgggaaggaagcagctgtcccggcggaggttagaacggcttggagtcaaatgtcactagccctccatacttcttgaagacgtgaaccattgggtgcagtcgcctggacacctgaggccccaagatcgtccagtctgcaaactgtagacccatgcgcttgtgatgcgctcctcggcgctgtatgcaggacgtctttggccaatgatgagttcgtgactgctgagcttggaaggctggatgacgcacacagacagatgcggaggccgcttgaacggacaa

SEQ ID NO: 483085 - DNA, 536 bp, Homo sapiens
ctgcattttattattattattattattattgagacggggtctcgctctgttgcccaggctggagtgcagtggcgcgatcgtgactcactgcagaccttgaactcccgggcccaactgattattctcccacctcagcctcccagagataggtgggaacgcatacatgcaccatgacacctggactaattttctattaggtaaattatatttactgtggagatgggggtctccctgtgtagcccaggactggatctcgaatgcctggaccttaagcaatcactcccaactcggcctcccaaagtgctgggattacacggcatgagacaaacacgcctggacacagatattccatctgggacatgtcccactgcacaagcagatcacattatacaaactggaaatggtatatacgatgagaataaccagaggttgcacgtatgtcattagaaaagtatatatgtaagaaaagcgacggacctggaggaatatatcggtacacctaaagaatatatatggaaagatgtgacgagaatcaa

SEQ ID NO: 483086 - DNA, 411 bp, Homo sapiens
tctcagagagttaacctttattttgagtcagcaggttggaaacactctttttgtaaaatctatggagggacattttggagccaaagaggcctatagtgaaaaccccaatatcccgtgatgaaaactagaaacaagctatcagtgaaaatgctttgaaatgtgtggatttatctcacagagttaaacttttgtattgattcagcagattggacactgtctttttgtacaatctattaatggacatttcaaagcccattgaggcctatagtgaaaaactgaatatcccacgataaaaactagaaacaatctatttgtgaaaatgctttttgacttttggattcattccacagaattaaccttttttttggttcagcaggtttgaaacactcttattgtagaatctataaaggg

SEQ ID NO: 483087 - DNA, 235 bp, Homo sapiens
ccgaagtgaaacccgccaccgggttacccccacaaggggccgctgcgaagaagttcacccacccccgaaaaaataattaaactcgcaggccaggcacggtggctcatgcctgtaatcccagcactttgggaggccaagacgggcggatcttttgaggtcgggagttggaggccagcctggccaaaatggcaaaaccccgcatctactaaaatacaaaaattagccgggcgtggtg

SEQ ID NO: 483088 - DNA, 215 bp, Homo sapiens
aactctagagtatcccctgcggaaccctatccaacccactagcaccaacttgtgcttttatgcttaccctggaaatgaacatgtatgtggttactattacttaagtaacatagtatcattgacattaatcattaaattagaccagaccactgttaactatatacatttgagatctatacattactgttacatagacttgtgcaatagtctttcat

SEQ ID NO: 483089 - DNA, 165 bp, Homo sapiens
ctcgcgaacgtgtatctccctgctgaatgctcgttcccttcaagacgaggggcagggaaggacagtgaccctcaggaattcagtgccttcaacaactgtgaggagaaagagagaagccagccacagacccctggtgagcttcctgctttgaaatgaagcaatgac

SEQ ID NO: 483090 - DNA, 252 bp, Homo sapiens
aaggatccggtaggatctccatcggcttcaagtactgatacaaggtgagctctgactagctgttattcaaaagtcatgtaacatgcattcactctgtcatatgtcattgttcatagaagggtaatttgcaagtcatataagcattcacctccctaagttaaacagcgctctaggaagatgtccacattttgccttgggtttttaatgcttcaatcttcttcaacgccaaaggctatttgacggttgacgaag

SEQ ID NO: 483091 - DNA, 108 bp, Homo sapiens
gctagtctcgccttaccccccactattaaactactgggagaactctctagtagcgtagtaaccacgttctcctgatctaatatatcactctcctacttacagtacacg

SEQ ID NO: 483092 - DNA, 349 bp, Homo sapiens
cgtcgacgccacatcttgtgtcaacgggtgcttggctccccgttctctgcaactgatcgcggccatgatgatggcgcgtgataccaagtaccggtcggctcgactcatctgtgcgacttcgtccgcttcaccgcctgtgatcatcaggatcgcggcaatcagcgtctcgccaagtaagtcccgtttatccagctcgtcgtcctgctcttcgtcatcttccctggcctggaacgtttcatgaaaagacacgtcgtcagtcgatggctcatcatcttggccaagcagggcattgaggagctcgtcatcgggcaggcctgcgttgcttcgtgcctgctgctcgggtcgaagc

SEQ ID NO: 483093 - DNA, 1739 bp, Homo sapiens
gcccccactggctgctctgaaaagccatctttgcagttgttccttcatccgcctccttgctcgccgcagccgcctccgtccgctagctgcctcctccgcccgtccgcggactctcggcgatgcgtttcactcgcgcagcagtccctgtagcctctcgtcttctcttcttctagtcccctgcatcggtactcagccggcgtgctcccagccactgtcagagcgcaggccgatagacatccagtcctccgaacatcaccagccaaggacctataaacggagaacaaggacagcttgtggaacgatggcacgaacaatggaacgagacgcccctgctacaccgggcactgcctacctgacgcacacgaggcgggaggcaggccacgtctgcacacaccgacggtacgacgcaacaaccagcgacgcaagggtggcgcgaccgaccgacgcgaccgcgcgcacgacacgacaggccgaccgggcccaccgccacgacgcgtgcccccgtgccccactgcagggaaggcctcccgtccagcccaccgggccaagcggcgcagcctggcagatgcactcgacggattgacgaatggtcgctcaccgacggaaggcaaaaacaaaccgacgcaggcatgacccaggacccggcaacacacggcgcctcacccgccgccacacacacgagccctctggccccccccgcgccccccaccaaacagcttccacaacccacacgatcgtggcgcccccggcgcccacccagacacacggcggacccgcgccacccgccggcgccacgcagcaacggcgaaagaaccaagccggcgagcgccagcgcacaaagagccccgcggcacccgaggacggcaacaaccccaggaccgcgcgccacgcggcccaccagacccccgccaccgcagccaccccgcgcgccgcccacctacgccccgctcgcccctccccgccgcccacccacgcccccgcgcgccacgctcgccgcgccgcgcggctccgcgccgcccatcgcgatgctctaccgcctgccgacccgcagcgacagcccagccccccctcctccgcctcgcgtcgcccccgctgcttcgccggggccgggcccctgcccgcccgcgcgcacccgcgccgcgcgcgcctccccgccgcgcgcccgctccgctccactccggtcgcgccccgcgcccgcgcctgcccgcctccggcccgcgccccctccgcccacgtctccgggccggctgcgccgcggcctcggcccgccggcgccggtgcgcctctcggctgtctcgccgccgtgcagctgcccgcgtagcgggcgtcgcgccgcgggccggccggcgctgtcgcgcgccgcctgccgctgcggggggccggagcgctctggccgggtgggccggcgccaactggcgcgcggcccggaccgacggtgctccgtcccgtcgccgcgcgcgcgcgggcccgccgccgtctgtgcgcgtcggcccgagcgggccaccggagtgcgccgcgcggtcgcgcggcccccggcgtgagcgggcgcggcggtcccggccgcgccgcgcggccgcgccgcgcgcgccgccccgggcgaccacccctcggcggccgcccccgcgcccgccgcggcgggggggggtgcgcgcgcgctcggcggcgagccgcccgcccgcgcgccggccgtggcagccgccgcggggcctcgcgctgtccgctcgtgctcgcgcggtgcg

SEQ ID NO: 483094 - DNA, 202 bp, Homo sapiens
aagggcgtcggattttaataaaaggggagtctagctctacagcccgcgctggagtgccgtgggccatctcggctcaccgcaacctctgcctcccgggttcaagctgttctcctgcctcggtctcccaaggggctgggattacaggcgcctgccaccacgcccggctaaattttttgtatttttagtcgacgcggccggcaat

SEQ ID NO: 483095 - DNA, 205 bp, Homo sapiens
  misc_feature (76)..(76): n is a, c, g, or t
cctggtgagactgctgagaacgataccatgaggtcaattttagagagataccttcacatgtgctatcgaaagtatncatggggttgggggcaaggttcactacactaacagctccaccgagattcctgaattcccaattgcacctgaaattgcactggaactgctgatggctgcgaacttcttagattgttaaataaaataaatt

SEQ ID NO: 483096 - DNA, 680 bp, Homo sapiens
gagcactgctgggctggagacggcgggagccgctgctctccggctgagggaatcagagacagctccgtccctagtggagcgcaggggaggcagaagtcatgacaggcgaggtgggttctgaggttcacctagaaatcaatgacccaaacgtcatttcacaagaggaagcagatagtccttcagatagtggacagggcagctatgaaacaatggacccttgagtgaaggagattcagatgaagagatatttgtaagtaagaagttgaaaaacaggaaggttctacaagacagtgattccgaaacagaggacacaaatgcctctccagagaaaactacctatgtacagtgccgcaggaggagcaataatcgcgaatttatatgtggggggaaatacctaccaatcatcaggaggatcttaccaaaggtgtggcagacagtgatgacagttcccatggccacagtcttggtatcaggacaactctttgaagcgcagtgaaacctgtttagagctgagtcttcagtctggaaactctacggactttaccactgacagaaagagttcccaaaaggcacatcccgtgaatcacgaagggaacctgcaggacaacgccggcagtacacatccacaaagacgactggggacacgaggcgataacacgccatacctccacaacagccac

SEQ ID NO: 483097 - DNA, 363 bp, Homo sapiens
acgctctacaagagtaggacaatatcagaccaggggagctgactaggggtgtaaggacataagcacgaacctgacaactttataagtagtgccaacaaacggggatagaagtccaatcacctatgaactctccacggagcatgattccctcagaccaatgctaaaatacacgagccatagttaaagctgaggtcaaagcttttaatggaaaagagtatctggcaatgttcccatgatgaacgattcaaacattttcgtttgttgttctttttcttttgcttttttttttttaggaaatgaagcctcactctatcgccagaggttgagtgcaggggtgcattctcgggaaggtcagggcgtatg

SEQ ID NO: 483098 - DNA, 134 bp, Homo sapiens
agtgtcaaaacaaacatcaaaataccttgcaatcagagaacagacttccaacatcaggacacaggtatctagagtgtcattatacaaaacagtactagggagtagaaatacatagtaaaaaaaataaaataaat

SEQ ID NO: 483099 - DNA, 818 bp, Homo sapiens
gcttcattcaaatattcagtgcataaataattgccttaaattgagtctttgctgtggaattgagagtttggaaatcaaaggcccttgtgaaacatttcctgttgccatttatttatagatagcaatagcttcaaatgagtgggaaagtctacttaggtgaagtggtaagatagtcacataatgatggtataaatagcgcattgatgagttgcctaattgtgtttctccaacaataaccactggtccatgtggttcactacttactcaagaaagacatatactgagatggtgtgaaagtgtttaatgcatgtgaacgtttatttgtgaccgtgtgttccggaagaaagagtctccgatgttatggtcttcctttattttccagaaattaagtgcatctaactggtgaatgtgtatatggaaattaccagttatttcagcatatatcagtatattttaacctgcttttgtgcatgctctgtatccaaagattaacagatcatgctgaaaaacatttcaaaacgattcatgtgttttaccgttataaggaagtcgacagtatattcattcctggagtttaatgaacaggaaaaaatctctaactccccagggttccccaccaaccagtttaaagaaaactaacccaggtaaactgttccgctctcggcgggaaagttctcccccaaaaaaaaatcgttataaaacccccacctggaggggggcgacgggccacacatgttcaaggaaacccgcggagttacaccccgtgtttccggaagaaaaacaggcgttccaaggaaaggagcgccagtttaccggaa

SEQ ID NO: 483100 - DNA, 477 bp, Homo sapiens
cacaacaagcaaacaccaaacaaacacacaaaaacataaaaacaaacaaacacaaacgaccgcacacaaaacaaacagagagagcaacacacgccgcgagcacacgacatttgtaaggagagaaagccagacggccgaggcgtcgaactgagatgagagcgaggaagcgaacgtatgcaccatacacacatcgagaagcgacgcagcacgagacagcattcgacacgctgatacgagaaaggacgagcagcacgatgcagacacaaaagagaacgcaagaagaccacacacggagcaagaagagacataacacagctactagaacaggacgagcgacaatgaacgagacgacagcagagacacgcagcagcacagatgcagaatcagaagacagaagacatggccagaaaagacggaccagcacaagcagaactctagcacagatggagaatagcattagagagcagaaagaagaat

SEQ ID NO: 483101 - DNA, 446 bp, Homo sapiens
  misc_feature (183)..(184): n is a, c, g, or t
tttaaaaaaaaatattttctttgaaaaaaaaggggcccctataatggggggggaaaaaaaacccccccccccccaaaaaaaaacttcttttcttttttaaaaaggggttggagccccaaaaaaaaaaaataacccccgcccccccctttaaaaacccttttcatgggtttaaaagggggtttnnaaaaaaatttttttaacccccaaagggggggaaaaaaaaccccccccctttaaaaaagtttttttcccattttttccccccccctttttccccaaaaaaaaaaaagttttttttaaaaaaacaaaaaaatttttcccggggggcccccaaagccctaaaaaaacttgtttttaaaccgccccaaatttcccttttgggtttggcccaattaaaattaaagcttaaatttttccatccagggttaaacaattaaatgattaat

SEQ ID NO: 483102 - DNA, 958 bp, Homo sapiens
ctatacggtgaatcagaaatgagaaatgtgtaaaggcatggtcatgatatgcttgagaattcacactcatagttcccacagtaaaatgagattcttgggaaaaatgtagttcatcttccttgttcactgattaatttgagaatgggtaaagagtctgagcaatattcgtgttcgtgttgcaattagaatgtctcaggggattactcttgggtgaatggttgacaaaatggtagcggttatgacgggagaatttgttacctcgaggggaaaggctatctacggatgaattggaaataattagagtacttgaactgaatcagtagataaggggaataaaactggtggtggtgtcgtcaaagagtattcttgatgcgtatcgcgacatggagaaggtgtattcgaacgatcatggagtagtattgcggttgcattgagaatttactcgaaacctgtagcatagatgtaaaagcttgttttggggaaaaagagcagtattctcttgaaccgcttccgagaagagagcccactatgactatagttgagcacgtgtttgtgaccgattagtagcaatgagatacccccgtaaagggaaaacttgtggtccttgtatagcacaccagatcgtcgctctgtcacagaatacttgtcaaggtgtaacgtgagtacttcctctccgggggccgatggtaccattatcctaaagggaagccttgatttagacttgccatcggggtaaagaaattgcaacttacgcaaacaattggtaggtgtcaacgcttagtccagagttatattgacattcagataaatggaagatacgcctgctggcatgctcagagcccaagggatcgagatgaaaattcttcgtaggtccaataatggcaaagttatgccagatagcccaggccatgacaccattgccataacatcgatagggtggcattataggggccatagt

SEQ ID NO: 483103 - DNA, 171 bp, Homo sapiens
cccccgtggggccctgtttctgggccccggtctgggtggttggtggggttgggggggggggtccttttcccccgggggcccgtttttggggtggggggcttttggtggggccccctttggggggttgggcccggggggcccgggtttccggggcccccaaaaaaagagaga

SEQ ID NO: 483104 - DNA, 117 bp, Homo sapiens
gattcaagtcattcaagaggatcgaatgatcatgtacatattttagatactgaaacatctagctggagccagcctataactagtggttaagcaccttcatctcgtgctgcccatgcc

SEQ ID NO: 483105 - DNA, 221 bp, Homo sapiens
tgaggcaaattttcgctctttttgcccaggctgaattgcaatggcgcaatcttggctcactgaaacctctgcctcccaggtttcaagttgatttctccagcttcagcctctctaaagttacctgggatttacaagcgttgagccaccacgcctcggcttattttgtgtttttttagcaagagaggggggccttcaccatttttggtcaggcgtgttctcga

SEQ ID NO: 483106 - DNA, 335 bp, Homo sapiens
  misc_feature (335)..(335): n is a, c, g, or t
ctggaataaaacagtaagttttagctcagtcgtggtgtgacccccttgcacaggaatgttgggtgagctacagagctctggtcactcagtgattcttgcaagtccctttgtgctttggatgctaaaaaacaatgccattgggggtctcaacttcccccccatttctgaggattgcctggtgacttgctaatgggttacacatataaatgacctgtaaacctttaatattattttagtttttaatctttttaaaataaccatatgaaagttatatattctctttatagagaagtgcatatgaaaataaataccaaaaattttttgtaaaaaaaaan

SEQ ID NO: 483107 - DNA, 832 bp, Homo sapiens
gtggcagacaggtggcccgggccgctgcgtgttgtccacccaagaatggagttcctcctggtggaacccgttccagtcgacacctagtgcggcgcagtgcctcgacaaaggcgaacagatcggctccctagcgaggtgaggattagggacgttgcgattatggatgatctgtgacatcaattcaatgagactggaggaagggccaaatggatggtcctagttcgagccctgaagaagcagtgatcgaacggggtaaccggaagctatcagagcaggtgactgcgtggtgcattaacagctgctgtgatgcaccagtgtgtgagagaacgtggtggtccgaccgtctttcgcaccatccattgttgggcacaaaccgagcattgtcactcgacaagtgttctgtggtcaacaacttagtatctcccaagcaacaagccctcccatcctattgtacatggtacacacagtgtcttgtctctgactccaggtcatggtgcctgtatgccctttcgatagcccgtcctagatcgtcacctggccgttgttgcacatggtcatgcacggagctcgcacatgaggaccggtggtgtttgagtttcccttgcgcagtacttggtactgctctggtctccccttcataccacttccgacaggcggagttgtccgctggccgttggctccgaggctgcggacccatgcgccaggtcccaatgcgctgcccgagggacaagtgccggtccctgtttcgtcggccgctccgtggccctagctccgggcgggggcccaggtctgcgtgttactgggcccccagtcattccaagggttgccggtg

SEQ ID NO: 483108 - DNA, 146 bp, Homo sapiens
  misc_feature (120)..(120): n is a, c, g, or t
caacaggtcaaaaagaacctttattactttttatgattgccacttatgctttctagcagatgctttggagcaggtaattatggcccggagctttttgacccttctgtcgtcttctatgcngccgtatagtagtagtagtcggccgc

SEQ ID NO: 483109 - DNA, 145 bp, Homo sapiens
tggagaggataccagaaggcagcggtgggcccagcggtttaagctagcaaggctcgccgcgcccattcttggagggcgaggcacttcagcgaggagttcttccgaacagaccgtgttgctcatgaacttgcaaaacagcgctcgc

SEQ ID NO: 483110 - DNA, 239 bp, Homo sapiens
acagtgcctcacagcctgcacacggacgcgaggatctgacatgtgcctcacagcctgcacaggacgcgaggatctgactgtgcctcacagccgcacaggactgcgaggtatgcttgacatgtgcctcacagccacacaggacgcaaggatgctgacggtgcctcacagctaatgagctgctgctccgagcttactggagtgcccgtgtacccctggccaacttcccgtgccgcagccag

SEQ ID NO: 483111 - DNA, 1275 bp, Homo sapiens
  misc_feature (1275)..(1275): n is a, c, g, or t
gggctggactggatgccctccacagaccatcccgatctgcctgctgcgcagaatataccttccagtgcagagtggcctggctctgccagtgccacctacgatgtgtgcgagtgtgtgcagggtgcctggtcccactgtgcaaggtgaacccatgacaatggcctggatgtggctgtgaatcacgttggggaatttcttgccagtggcctaggagcatggcttcaggcatcctgccatgctgccccagtgcctctgagtgacaagttcgactgttacaatgtgtcactaggcgagaaggcagccatgtgtggctacggcatctgtgagtacagcaccgacgaggtgtacaagggctacttccacgtgaagggcctgcgtgcacgagatttggggtccttgagatgtggtcctgatggacccaccatgcccttcagtgtacactgggccacttggagatgatgagggccaggcaggcagctgggcttattgcgccacttagcagcgccgagactagcggtgagcacagacgcgcttgaacgcagcctacacctagaaaaattgctgcgcacgcgccatggtcgcggacgaacacagtacaccacagaggccatgcggccaccccaagggcaaggggctgatacatgggtaccaacaggcaacaccgatttgccaaagccggaacaaaaacacgagagcgagacaccgcgggacaatatcatccacgcacagggaaagagagcacaatccacctgaacatagcagagcaaagcataactaccgagcgggaaccccctaaccacttcaaatgtagaacacatacaacaaagcacaaacttatcacaaaactagactatacaacaacaataacagagcaatcatcaccaaaacactatacaacacgaaaaaataaataacaaaacacatagattgtcatagaacaatgaacatacaacacaccaacaaccacaaaacaaccacaatcacacacaccagcacaactaagcctgacgactaacgatcccgcaacgaagaaaacaatgataacaagaacaaatacaacacacaccacacatacaccagaacaaatatgacagtacagagaaaataacacatacggacaactcaacaataacacacgattaatccatcaccaacaacgactgattattactcagagataacattaagactactatacataatccctccgataaacaaacacaatacctcaaaagcacacattaaaccaccactatataacaaacactactaagn

SEQ ID NO: 483112 - DNA, 796 bp, Homo sapiens
gctcgtagagccacatgtatacagtgtagttttggcaaatttcattcatacctctacctccttgtgctgttttccttgaacatagtaaaaattcacatgactttgccgaaatcaagttcttaggagttcttcaacagtatttaaagacaggttctgtcccttttggtttcctgcctaactacaggtacagttaaacatggcaattaaacagacagccttctatgtcaaacatgtgtcatgtaacagatcctagtgatctctggtttcctggacgatactatttagccatttgggagaggatcaacaaaggggcacagcacgcaagcatacctgtagtaagtattattttcccttattttgcttactgtctatcgattagtctttaaattactagtacattttatgataaatttcttgtgattatatatttactcattttagaatggaagctcctcgaaagggcagggaaatctgaagtaggcaggcatttaaaaaatatttacaatgtacagttgggtggaagtttcagtttcaattgcaaattaggtttgtgacattgagaattgtgacaacgggggatcacaatattacgaagcatttaatttaatggcatggacagtttgtaaaatggtcaaaagtgctaatgatttacgtaactcaggagaaccatcaaatttaattatcaagtgcatttaaacatttcaacatgtcttagtgaggaaagtggctaggaaatagattaataggtaaataactttgtcagtgagtgctatttggaaaagaaagggcttagcaa

SEQ ID NO: 483113 - DNA, 123 bp, Homo sapiens
ccatacgtatactatgtggccaggctggtctcaattcctgaccttgtgatccgcccaccttggcctcccaaagttcatggattacaggcttgagcctacgcacccagctgccaatttctttaa

SEQ ID NO: 483114 - DNA, 1248 bp, Homo sapiens
accccccccgacatgagcaagcggacgcagggaaacaagcagcatgtgtgttgacgcgatattttcatttatcatcacctttttctggcacgcttgttttataccctgtgcgtgtctttttggtgcgaccaacctttgtccccgggggacctcttttacacacatttgtttgtgcccccccgttattttttgtctcttaccgttgtggttttctccccaattgtgagcttgtgttcgcggcatagacccccgtgggacacaaagatgtggtcacactattatacccagttggtctctctagggtattcttgtggcgcaccccccaaattttccacgttgggcaataaccctgttactccacccggggattatgtttcacgctgcccctttccgatttgtttttggcgttttcccccccccggccgtccaaagttattttgcctggcttctgccccacccttcccccggtgacccatattgaaatgtatccttgctccagatgcttcttggccccccttagggatttctatctttccctttttccaccgtttaggtgggccctgacctgggcactgtgttaattaagcccaaaacgtgcagtcccctaaggaacctccggtatcttatcaccgaacaccgtaatctaaacccttgtacgacatcaaccgtcccccctaatttgtcccctatccaaatatgggaggcccggtaatttgtggccacatccaataaggaaggacttcacattcacctgattttcccctcagttctcacaggctaacaccccctatgaccccaaacctatccgcccaaaatccactgttcacactaatcaataatttacatccggcggtgaaattttaaacttttctttcccaccacaacacctttttcggcctatccggaaatgccccgagccttatactcggaactatccccgaatgcatacacccaccactgaacactcctatcactctgtaggctcacattcacatttttctaaccaccccgtaaatatttaataattttcactgagtttgagaagccttcgcttcgaagcggaaagtcctaatagtatgaagaaccctccactaaaacctcggaggtgagctatatggagtgccccccacccctaccaccaccacttcgaagaacccgtatacataaaatttagaccaaaaaggaagggatcgagacccccccaacgctggtttcaaacccaccccctggcctccctgactttttcca

SEQ ID NO: 483115 - DNA, 376 bp, Homo sapiens
gaatgggcagtctagtgacctcagagtccatctcctgtttgcgaaaataccagtaatgcactctgtagggacaaagcactgcagataaaatcaccgtgggctcatccgggctgaaatacttggtaaatcagccattccctgcagagacacacaatcatcaagtccctcacagacatatctgttcccagaggagccaggcctgcagctggctgctcaggagatggcctcatacctcctgtactcccagtttgctttccacttaggacaaagccattgatctatatggagggcggggaccggggacagagggaggctgaaatgtatatactgcttctcccgtgtttcatgccatctcgcgtcccccattcctgcacat

SEQ ID NO: 483116 - DNA, 665 bp, Homo sapiens
gggacgcgtggggaaggtagtattccgccccactccgcccccgggttatgagaatgatgctgtctgagaccctgatggtggtggcttagccagatgacgtctgcaaatggaggcccacgggctccccgatggctctgtatcatcagggagggagctccctttatcttgttacctactcccctcttgggcccccttcttcccctgatctaagaagggtgctccggatctcccctctggcctgcgttccatcagccgaagcttcctggaggagccggaggaggccctgtgctcgcatcacatacccgtggcccgaagttggcttcacgggaagctcaggaataggatgcgagaagccctgagacctcccccaactctgccgtacagagtcaccagaccatggcttaaagatggagagacccgattgatcggtcacaccagctgttccccgataattcttgtgtcagaaggggaggctgactacccggacccctggccccacttcccgcccctcccttttgagtacacttcagagggcttctggcacgggtgagggggtcttggtggtgcccccgagagtaaaggtttagcaccccccttgtggagatatttcatggggaccaccccgtgacttcacttgaagtaaagtgggattttcccacccttga

SEQ ID NO: 483117 - DNA, 1874 bp, Homo sapiens
  misc_feature (1263)..(1263): n is a, c, g, or t
  misc_feature (1551)..(1551): n is a, c, g, or t
cggaggaagcgaagaggggagggggagggcggactgcgctcgctggtactgttactgatgggttcctgacttcgtgtatgcagtatgctctgcacttctattgtcgtcagtctttcgttggttttttgtactatacccatcgtgttcttacctgttggtgcgtcgcaccgactgattcttgtgccagggtggggtattttgttgactcgcctcgtcttttattaaatgttcgcctcccggcacgttgttgcctgttgtgtgttgtcatcgaggggtgtttcttctctgtgttgttgttgttgcgttcgtcgctcgctgtgttgttgtttgtgtttcgatgctcctgcgggttgatcttcgaccagtggttatttgtataaggtcgttctacctctctgtgtaggaaggtagtaggctgacctcatggtggtggtttcttgttcaatttttggcgggtactcctctacattttttctcggggcgacaaaatatgtaccccctggcggtgccttgggtctctcttctgtttgttttgttgggaggatatataccatcttgtgcgcacgcacgcgtcgttgtgtagcgtccggccctgtgttaaggcccccagacagtgttaagtgtgccacagtggttgtgatattgtcccccagacggtttataatagatgggttaaataggttcgatgtagaacgtgtcccgcaacccacgaggttgtgtgaagaaaattttttatttcgcgtgccgttcaaaggaaagttatacctccccccggggtgagccgttgattgccgtgttgtccgcggtgcccctctcgtttgataagatggggtcaccctcggggggaatttttcctcgtgtggcaagtgtgagatgtgtgaagtggcgccatacccatgagggagatggtgggagacaccccacaaaattgttctttttgggggcggattacaactatattttgggcgcccatataagtttctgttgatgtttaaaaacttgttctgggcgtgttcactaaagtgtttgagggagaacccccccaccctggattgttattgttgttcactgcccaccgctgtgataccctacgcttcagaggagcagtgtctccacacttgagagtatatagagccccctcctggtgtgggtggagtactcaaccgtggtgatgtggagattgtctcgtgtgtgtcctcaagaactgtcgtggggcgtgtgagagccttcggcctgatagtagaagattgtccctccgagagngcctacttgagagagatatattgtgagaagagactagtgtgggtgtgaaaatacttaggagagtgtggcgctctcttgatcacaaggggagtgttgtgtgagaagttatacagagacccctacgaaatttttttggggggaagatatgtgttttttgaaagtgggagtgtgtcccacgctgatgtcccctgctctgtaggccactgtgatacagtgtataaggtgatataagagaggccacagagtttgggagtgtgtttgtccctgctctctttgtcctcgcgtganatgtgtcctcaagagtgagaattataagagactttatattgaaagtgtgcccactatacgagaattgtgtaagctggatatgtctttatgaacgccacttggtggagtggcctcgtgttggaggtgtgctccccacccactgtgcctctaggatgtctgtattctgtggctacctctgatgtggaactcacccgccacggcttttctgaatgggcttgcaatttccagatttagattgatttttcccacccaattgcctgtcaagtattctccataggctgtattcccccccagtcccataaatgtaccccccgttaaaactc

SEQ ID NO: 483118 - DNA, 597 bp, Homo sapiens
agttatggaaaaaatactagctttaagaaattattttgattgaaaaaatattgtattttaatctttaaagttttataaatggacagacatatttaaattgccccagtattccaataactaatcttcagttgactttcttttaatattacatataagaacaaagttcctgcattgtatcttttgagtagtgaacatttgcaattaattcttaatgttaatttttatctacataaaatttgtaagaaagataggtggctatgtgatcatggatatttgttttagattattttgtctgtcctttagccatgattagatgctctcaaatgaaatttagtttttataaaagtttcaggagaggagatttattgtttaacatatgttctatgaaatattaaatattctgtattaatataaaattgatcaggattttttgaagctacaggactctagataatctaccatgtcacctttaccataatatgtaaagggaactgaaaatctatttcaacataaacttctaatttgttttaattagccaaagcattgtacttaaattgtaatgagtaaatattaaaatttggatcatctttaaaaaaa

SEQ ID NO: 483119 - DNA, 576 bp, Homo sapiens
  misc_feature (57)..(57): n is a, c, g, or t
  misc_feature (92)..(92): n is a, c, g, or t
  misc_feature (136)..(137): n is a, c, g, or t
  misc_feature (150)..(150): n is a, c, g, or t
  misc_feature (192)..(192): n is a, c, g, or t
  misc_feature (203)..(203): n is a, c, g, or t
  misc_feature (205)..(205): n is a, c, g, or t
  misc_feature (210)..(210): n is a, c, g, or t
  misc_feature (228)..(228): n is a, c, g, or t
  misc_feature (248)..(248): n is a, c, g, or t
  misc_feature (351)..(351): n is a, c, g, or t
  misc_feature (458)..(458): n is a, c, g, or t
  misc_feature (470)..(470): n is a, c, g, or t
  misc_feature (480)..(480): n is a, c, g, or t
  misc_feature (488)..(488): n is a, c, g, or t
  misc_feature (490)..(490): n is a, c, g, or t
  misc_feature (492)..(492): n is a, c, g, or t
  misc_feature (495)..(495): n is a, c, g, or t
  misc_feature (500)..(500): n is a, c, g, or t
  misc_feature (504)..(504): n is a, c, g, or t
  misc_feature (506)..(507): n is a, c, g, or t
  misc_feature (516)..(516): n is a, c, g, or t
  misc_feature (538)..(538): n is a, c, g, or t
tccaggaggcaggttgtttgttgttttttggttaatggtatttttggggcgcttctntttttttagacttctttatagggtggggagggganagattttttttttggttgatgctatttagagtggctctggttanntttttttcttcanggcattttttaggctcctttattgctgctcaccacagccccntgcgctcaganantgggnagggtttaggctcttttngttatgattttttaaatgtnatgttttaggtatgagtgtggcttcatgctatttcttgagctacctgccctaccccagtgcaggccactcacgaggcagtgagcgtggagttaagcagcaggntggtgctgattgggtagagctgggccagggtgagcttgctgtgctgggcagagacccctggtgggggctcaggctggaccctggggagaggcccccgagggcaggtntgcacacctgtncctgtgggcncctgcagntngncangccangcancnnactgagccnaagcacgctggcaggggtgagngcccctgggcaatggcaaatgggcgcactggctggagg

SEQ ID NO: 483120 - DNA, 397 bp, Homo sapiens
gaaagcaaagcaaagcacttgatggagaagccaaataaacaatcagctcctagtgcatccagcaactcaaaaccctgcatccataaagaaaaagccagggagctagataaagaggaaaaatctagtgcatcaaagaaagtataaatataacgaactccaaacacatacaggatgaaaaacagtcaagtatagtccacggtaataaagcacaacatgaacaacccttaacccttaaagaaaaaacaaaagctgcacctttgaacactccagatggagaagaaatcgataaacaagataaagatctagacagatacaaagaccgaaaccaacataaagattaagtccaaataaatatcttactcacactaaaatcttgaagcagatcccctaaagctaa

SEQ ID NO: 483121 - DNA, 360 bp, Homo sapiens
gattccatatatatgaaatgtccagaacaggataggcctatcatagacaacagagacacaaagtcgatcagcagttgccaggggaggaggaagacgggaggggtaatgaatgcttcacagggtgatgacagagtgttccggaacgtgacagaggtggagcctacacaactgtctggatgcagtaaatggcgctgaatgttcactttcaagtgattgatatgtaggttatttgaatatcatctcaattaaaaaacccaaacacgcaaactgctcccgccagctcagcccagaacagacggcgcaggccgtggagaatactgaaccacccagggttctctccgccccttctgtcgtcttctc

SEQ ID NO: 483122 - DNA, 1097 bp, Homo sapiens
ggacagtgctgagactacaaggctcggagcttccgggcactcagacatcatgagtcggtccttgctacactcccggaattggaattcgtctacttcatatgctcgttctatttctctctttctaacgatgtgtagctagtatgttgctacgcagagactaacatgcttgcgtcttagatgacaagattcggctagcttatggctccagctaccggtggacatcttgccaggactattcgctgttctacctattatactaaatccgagaaggtcaggacgagaggattcgtactaagtctctcggtaagtacatcgtgtagcatccacagattgtagggaagtaaaaaccatgcagaaaggtcaaactagctgatcataaagccaatccaacgtcaatctttattcattcgcttgatgtgaacgtcagtcatagaatcccaagattagtgagtacggagcagccgttgcgtaaccttgggtaagggtccaagcgcataacacctgtttaccgaaggaacagtggatgaatattactgaaagccagtgcgagtctcttaacgaacagtagaatctacacagttatttccgactctattttcggccacgggacacatgagttagtacattcttcacatgattacatttcaagagaggaatttggtttaataccctgtacaacggaagaaagggtatggcccccaggttctttggaacaacgccactaggtggccaaggaaaacctttggcaaaaggaaccaccggttgccggaatccgcagtgactgattccactgggccgacagagaaatgtgtccgaaagtgaccctttgtgtcactacttcaacgggcgaagcctcataagccatgaaggcgggggcctttagaacttttgactttaaagcgctacttggattaaagggttaaagccaaagtccaagttgctcgtcaggtgctaactgtggtggacacagccggattggggtcctgggggaaatggtgagtcgggactaggtggatttttcaaagtgaaacgggaagaactttcgcgatgggacagggtccgtaggacttttccatctgcgagaaaatcgggcgagt

SEQ ID NO: 483123 - DNA, 105 bp, Homo sapiens
tttgcggcaggtcttggtgaggcaaatagattcctccacacatgattacaggcacatctcaggctgactgtgctgtcctgattgttgctgcgggtcttggtgagg

SEQ ID NO: 483124 - DNA, 496 bp, Homo sapiens
gggaaccccccccaaaaggataccccccttgagggaaacccccaagaccccattaatttgtcaagattcacccaaagttgaaatgaaggggaaaaaattgttaaggggcagccagagagaaagggtcgggttacccccacaaaaggggaaacccccatcaggacttaccagcagatcctcccggaagaaactcctacaagccagaagaaagtgggggccaatattcaacattcttaaagaaaagaattttcaacccagaatttcatatccagccaaactaagcttcataagtgaaggagaaataaaatcctttacagacaagcaaatgctgagagattttgtcaccaccaggtctgccctaaaagagctcctgaaggaagcactgaacatggaaaggaacgaccggtaccagccgctgcaaaatcatgccaaaatgtaaagaccctcgacttagggcgcggtttccaattcgccctatagtgactctttttacgaa

SEQ ID NO: 483125 - DNA, 958 bp, Homo sapiens
ggacccggggcctcgggggacccatggcggattcctcgcccgcactgtccctgcgggaaggcggccccggcgccgggcctcggccccctcgccgcgccggctcgcgctcgggtccgagtccgaggaggccgagctgtcagctgagcctggcccgcacacaagacccgctcgtacgggcagcaccgcaagtgtgcgcgcgcggccgtggggcgccggcgtacatccgagcggcatgggaggcaccggggtccgcacggggggaacaaacggctggcaggggacattcgggggcatcaaaggtacgggggtgcacggagtgggaaacagatttaagggggcgcccaatttaacagcttggtttcacccaagttgatgtgggtaattttttgctggaaagaaaaacttttggacatttcccaggtttatatcaagaaagcacgccttgtgtgtgcgtcacacggggaactttaacccttccattggatcctccaagggaaaagtgaagttggggtataccaggttttcctcaaggcagaagaaggcggcgccaggtggtgtggcgggggaaaggaccttccttctttcccaagttcttcaagagattttggattgtcacaggccttgtgccagcttggagggaaggtggtcaggcaagagattttctggcagaagacttggattgggaggaattaagtgttttcaacacgggcagccaggaagtaaaaggaagagagaggagttgagaaagtcttatgaattccctttatcaagtaggtattggggcataatctaccaaattagttttgttggccttaagatcacaatggagttaaaatctttggtctataggcactaaacaaatgagttacgggaggaggaggtagcccgattaataagattatgggggggggggacacatggggggaacgcaatggaggactttaaagttccagaggtg

SEQ ID NO: 483126 - DNA, 679 bp, Homo sapiens
gtgtcttagacagaacgttttgaatgtaggtccagctttcctcacagtggcgctgacgctggggccactctcttgcctccctgaggcggtgggtcagtggtttccttgcttagcatgattttgtaagatatgttgctgattgtgggttgagggaggaggctgcagggtagggttggaagagcctagatgaagattattcatcctggttgtccccttacacaaccccttctattccttgatccttcgttttcttcgttcgtcaaaagtagtttatgatcagggacagagcagagggctgggagagccaaggtgaccagagtcttgggccctttaagacttcatcgtccagtggcagggacagtcacccatacccaagtacccaaatcatccctggaagctcgggtggggtctgctgggggtgtgtgcaagagtgcagtgaaagcacagggccagaggtggcaggagggatgatgtggacaccaggttgtcttgcctttcttctgctaacagcaacctccttcctttgggaaattgttcctccccaattccttgtggtgcatgggacacgcctactgagtttagccgattaaccaggctgtcaatcacagcatcaggccccacctctactaagtcacagtggacggcacaggaaacaaggctggccatcagagtcttcctg

SEQ ID NO: 483127 - DNA, 329 bp, Homo sapiens
  misc_feature (18)..(18): n is a, c, g, or t
  misc_feature (140)..(140): n is a, c, g, or t
  misc_feature (145)..(145): n is a, c, g, or t
  misc_feature (194)..(194): n is a, c, g, or t
  misc_feature (227)..(227): n is a, c, g, or t
atttgggccaggtgcagnggctcatgtctgtaatcccagcactttgggaggccgaggcaggtggatcacttgaggccaggagtttgacaccagcctggccaacatggcaaacctcgtctctactaaacatttatgtgtgngtggnggtgcatgcgtgtaattccagctacttgggagattgaggcatgataatnacttgaacccaggagctgtgatcgtaccattgngctccagcctgagcaacagagtgagaatttgtttcaaaaaaacaaacacacacataaacacacacaagcaaacaaatcctgttttctttattggtcgttgct

SEQ ID NO: 483128 - DNA, 241 bp, Homo sapiens
cgtcataccacaagctatctataagccaaaaatccgcatcatcattactagacttaatttgactagaaactattctaccaaaaacaacctctttcatccatccatccatagatctagtcatccataaccatctatcatccacccatctatatacccatccatccatccaccatccatcttccatccatccatagatctattcatccataaccatctatcatccacccatctctatacccat

SEQ ID NO: 483129 - DNA, 176 bp, Homo sapiens
gaggttaggcaagcagtcatgatccgactgccgtacatctcatttcttactgccttacgctcatcctgaggtccaccttggcttttaaaaacaccatgtgttctcatgcctccatgtcttttcacacactgttccatttgctcttcctcccacattacattgaaccggatagcttg

SEQ ID NO: 483130 - DNA, 644 bp, Homo sapiens
catcctgagcaaaaagaacaaatctagaggcattacatcacctgacttcaaattatactgcaaaggctatagtaaccaaaacattgtggtactggcataaaagtagacacatagaccaatggaacggaataaagaacccagaaataaattcatccatttacagccaactcatttcaaaaaaggtgccaagaacatacaatggggaaaagacacccttttcaacaaatgctgtggggaatggtagatatttatatgcagaagaatgaaaatagacccctattttttaccatatacaataaccaaatcaaactgaattaaatacttaaatgtaaaatctgaaatttttgaaaccattaaaagaaaacaggtgaaatgcttcaagacatggctgtgggcaaagatttcttgaataagaccttaaagcacaggcaaccaaagcaaaaatggataaatgaaaacacatcaaacttaaaagctcctgcacagaaaagacaataatgaagtgaagagacaactgcataatgaaagacaatattttcaaacctattcaactggatcagtgattaataacccagaatatattaggaactcaaccaaatccatgtcaaaaatcgggagaaacaaaaaacacaaacaacaaacaa

SEQ ID NO: 483131 - DNA, 440 bp, Homo sapiens
tggaaaatttagctcaattttaatgtttcccaagcattatttggaccaggtacccgggttgaaaagatgagtgacagggtctattattttttttaccagtaggggggccccagatcaatgaggcttaacagtttaatcggaggagccccttgcattattttgtgccccgtgtctgtaaccatcctcattgtgcggtagttggaaccgctttggacattctcagacgctcatgttgtggttgatacaaaaaaaggtaccataacacataaccaaagcacaaaaaaaacggggaagtgcgggttgtgcttagactgcttaggaactaattgctcctcttggattgtgcctcaaaaattcgtgggcccatcgctgcagcacttaatatttgggagtgaaactgcaatgcccagcattgtacaattggggcttgaacagtattc

SEQ ID NO: 483132 - DNA, 716 bp, Homo sapiens
  misc_feature (350)..(350): n is a, c, g, or t
attcaaagatagagattgtcagagtctatcaaaagacagacacatcttgattcactgcactttgctttattgtgttttgtgaccatgtgttttacatattgaaggtttgtggccaccctgcaatacgcaggtctcactgcaccattgttcctacagcacgtgctcacttcacgtctctgtgtcacatttcggtcattctcacagtattttaagatttttattattgaatctgttatggtgatctgtaatcagtgatctttaatgctactgttgtcattgttttgggaaccacaaatcacaccaggataagacagcaaacaattgacaaatgcgtttgttctgactgcccnaccaacgggccatttctcttctctctctttttctcaggcttctttttattaatattaaaatgtggccaattaataaccctacaatagcctctatatgttcaagtgaaagaagagttgcatgtctgtcactttaaaccaaaaggaagaaataattaagcttagtgaggaaggcatgctgtaagcaagacaggccagtagctagacctcatgcaacaaacacttagccaagttgtgaatgcaaacgaagtgttctggaaagaaatttaaagtactgctccagtgaacacatgaatgataaaaagctaaacaatcttgctgctgttatgaagaaagtttagttggtctagatagaagatgaaaaaaaaa

SEQ ID NO: 483133 - DNA, 289 bp, Homo sapiens
ctgtagatcgctcacatttacttcaagtgacagtagctttggtaataacacccaaagttgtatacagtggggatgagggattcttctttacaccaacgtatgggataggcaaagaggtggctttcatgttcaggtatgtgttacatggtgctttcttgaaagcgcaagcccagttggcgctgatgaactctttcaatattgaggtgggttgtcgtggtaaagccatctccaacaaagcacactttagtaaccattctcttccatgccttcttctttctctttccggttc

SEQ ID NO: 483134 - DNA, 879 bp, Homo sapiens
  misc_feature (11)..(11): n is a, c, g, or t
  misc_feature (247)..(247): n is a, c, g, or t
  misc_feature (249)..(249): n is a, c, g, or t
  misc_feature (261)..(261): n is a, c, g, or t
  misc_feature (275)..(275): n is a, c, g, or t
  misc_feature (301)..(301): n is a, c, g, or t
  misc_feature (345)..(345): n is a, c, g, or t
  misc_feature (363)..(363): n is a, c, g, or t
  misc_feature (369)..(369): n is a, c, g, or t
  misc_feature (371)..(371): n is a, c, g, or t
  misc_feature (373)..(373): n is a, c, g, or t
  misc_feature (436)..(436): n is a, c, g, or t
  misc_feature (471)..(471): n is a, c, g, or t
  misc_feature (740)..(740): n is a, c, g, or t
  misc_feature (782)..(782): n is a, c, g, or t
  misc_feature (824)..(824): n is a, c, g, or t
ctccgttttcnaaatgctatgaaagtcacaaagtaattaattaaaagacctcagtatcatgacaacaccatcatccttctggtcaacacatttcagtgatgcagggtgtattgtgacagcctgcagatgacacaaaacaatctacattatcatcaaatttcatgtctatactaataataatttttcactgaatgtagcaacaccttttctggctggggttgggctgaggacagaagtgctgttgggngnggaaaaaagggnggaaaaagaatgcnagctggcaactagttaatgaaaatcntaatgatatcagtctttttgcactgggaatatgccctccatcgngctcaaatgggggggggngcgggncncnggtaagactggggggcggggggcgggggtggggcgaaggcataaaatgccttcgcgcacatgnatgcctaccatgttgtgaccaagtgggagggagcngtggtgaggcaggggggagggaaataactcccttagtgtctggcatgatgatgttgaatctcttcagtaatgatttcggtgtggtgtgtggggggtgggagtgtgatgttgctttatgcctgatgcaaagaaatgccttttggctcagattaggttgtgatcacttcagtttggcacctagttaccagtgtcagcatttacagttcattcccagccatgggtgcagtaagtctctgagatctcaaaagctgtaggatgcaacccacatngccttctggccttcgaggaccatgccaaattccttaaagcantgacagctaagggtcataaggcggctctgattcaacctatgncccagtttattacactatgtcagatgcagctcttgcatataaattttgctctata

SEQ ID NO: 483135 - DNA, 262 bp, Homo sapiens
agctcggtacccccagctggcggtgtggagagggcgggcgctgcgcgcggattccgcgccccgtgcgtcagtgtttgcgtcgtgtcgctcccgtgtcgtcgtctaggcatgctcttcgacctcgtcgcgccttctggtgacaccgaatacgacgcggctctcccaagtccggccttggaagccttgggtgtggcatttggcgacactcctgcgcgtttggtagcattcgaagctgcgctcacgctcgcgcgtcgcccgcccg

SEQ ID NO: 483136 - DNA, 889 bp, Homo sapiens
tcctatggtctgaaccatcatatatcagtattaaattatgtgcgcatcattccatcttctgaacctatgttgcttctgaagtgagatgcctgttgagtaggcagtatattaccaatatccaacatgtatgctgccataatgtctcatgcttagctcacgtgttgtggacaagatgattagccgttctgggccagaaatggatatgatctgcatggatggtttagtgctcatccttcgccaggtgcatggcgccgattaaaaacaactgtggaccggacatggtacctcatgtctataatcccagacatgtttggaacggctgatgctgaggccagaattgatcacttgagcccagagaatacgagatcgagtctgggtcttccatgacataagtcctgatatctagctataagcttctaaagtagtgggtgtgcattggtgtagtatgaccaagtaagatcccgagctagttgggaggcagatgagatgaggatcacctggagtacaggatagtcgaggctgcagtgggctagagattgagagtccactggactacaagccttaagtgatggagagtgagagtcgtgtgtcaaaaaaaccaaaagtataaccggggggaggaaagatacaaatatacggcagcgagccgaaaaaaactgattgcccagattgctgaataaaacgaggggccgtatggcgccggcatacatgaatgtccaggacggtgttttaacactgtccgacgtggcaacatgttaacgagcaccttggtagagggcctatatcagggggggccacacttgccagtccctggacttgaaggccaggacaatcaacatcaagttggggcgcacacgccccaccgggcgaaatgcccggcttgaggctc

SEQ ID NO: 483137 - DNA, 426 bp, Homo sapiens
gtaatcaagatgcgggcagataaggggtgattggcaaagcttttaggggagtgttccatctagtgtcatgataagaagtaccctaatatgtttccgataccgtgtatacctaggcctccttgggttaaatagaggactcatgttttcagatatccccagtatggcaaagccagaactcggttctcttttgtataacacggagcttaggactctgttactgttataccacacaccctctacttgacccaccatttagtgggggtgtacattattagttttgtcgcgagcagggtcatatctcataatgtctgagagtcgcgacctaagagccttttgtgtgcccaaaaacatctctaaggaccccggtggacgtggtgggtacccccctgtaatcccggctcttcaaaaggtctgaacaggcgcacc

SEQ ID NO: 483138 - DNA, 195 bp, Homo sapiens
ggtgtggtggctcatgcctgtaagtaagtctcagccctttgggaggccacagcgagaacggattgtttgagcccaggtactcaacagcaggcctggtgcaacatagtgagtgtcgctgtcataaaaaatatcagctcttagtcgtgaagtcctccaagggctggtcgccatcgctagctgtggctctccggtaac

SEQ ID NO: 483139 - DNA, 339 bp, Homo sapiens
  misc_feature (83)..(83): n is a, c, g, or t
  misc_feature (121)..(122): n is a, c, g, or t
  misc_feature (318)..(318): n is a, c, g, or t
  misc_feature (332)..(332): n is a, c, g, or t
ttcggcacagggattcgcctcctggcatagtccgcgctgccttcgaccagcgcatgaagacatggcagcgtggcaggatccanagccacactgcagaagaagcgggaggccgaggctcctnnctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggactttcaagaaccacgtgatcaagtaccttgagacactcctttantcacagcagcagtnggcaaag

SEQ ID NO: 483140 - DNA, 973 bp, Homo sapiens
ggtgctgtccccctctgtgtaattatttttcatatcatgtcgtctcgtatatcttatctatgtgatgtctgctttgtatgttttgtggtgatcttcttgtttctggatctttttccctttctttccctgtcggatgtgattcctgttttgcatcctttgtggccccttcagtttttctgttcttttctcttctgatttttgggtcattctgcttccagcgggttcatgccttcttactagcctttgtaattccatgaatttatctgtgctttggactactggcagattgagttcgcacactctcgtgatctgccttacccctttgtggtttcattttacttcttccgttcctggttgttgccaggtctggcttcttattcagtgtttatgatatcttccagtttttgcgttcataggtcagagatctatcttgtgttgtgcgttaggacttgtatgagaagggtgtgtacttctgtcagaagtctcttccttcatcacctgaattcagtcaccttggagatgacaactttcaaatgctaacccgatgaccccagaaaacccgtgtgagaacatcgtaccgaagagaccttgtggaatgccctcttgacttaggcccacacctggtcgatagctcgagaaagaatgtgtcttccaaggacaatgtctcggatatgggtcactgtaattgaaagctgttagctttgtctaacacgcattgtcccttgtcactatgggccccgagcctcgaccctcgtgtctgacgcggccacctcatttctggaggggctgaggacagatgtgcctgcttgtggagaccacggctgggcctaagtcgaagggtcatctgcagccccacgcccggagcgtggagcccttggggggtggtcccccccggtgcgttctccgctcgtggtgatgtcaggagctcctcggaggatccagagcggctgtaatacagccgcagtatgtctcc

SEQ ID NO: 483141 - DNA, 344 bp, Homo sapiens
  misc_feature (8)..(8): n is a, c, g, or t
gcacgagnggatgtttctgtaggggtgtttttggatgagatttatgtttatatcagtggactttgagtaaaacagattgctctcgtgatgtgggtaggccttaaccaatcagttgaaggcttaaatagaacaaaaggctgatttacccccaagcaagaggggattctccagcagactgcctttggactcaaagtgcaactccttcctgagtcttcagcctgcctgcctctcccattaggtatttggacttgccaagcctccacaatcacatgagccaattccttaaaatatttttttttttttgagacagggtctcactctgtttcccaggctggacttcttcc

SEQ ID NO: 483142 - DNA, 970 bp, Homo sapiens
ctagtaaccgatggcacgctgcatgatccatcctacttcagcaccccgaccggttagagagtgaggacgccactaactgtctagtagccacaacagcgttatctcggtgactttgtctggctgccatctgtgcaggaagtccgatatttctgtatctcatacctcacgggctttcggaaaatagagtcgtaccctactcactgggtaacgtggacgtactccggaagcccatgaaaacatttggaatacattacgatatgcctgcagaaacctatgatgatccaaaaaggtctgcctcagggttcatatcagttggtgcagccacacaccatatattcatcagccgagccgaataagtacggtataatcctgaagtccctcaccctcaaacttccagtcctcaccaattactaattgatcttattatccacaggcgatctaaagtctatctaaccatagaacatcgacctaaaatctcacaacgaaccgtcaatattgaaatgatctcgcatgaccagctgcctactgaagacgggcatagagacttgaatcttctcaatacctacgctgataccgttggctcagtactgatagtgtataataaaacttcttcgatatcatggtcgcactacaattgacacgatactacgctagttaatttattatcccattaatgttggtactctcctcacgtgagtgagtcgtgtgggcagtcgatatgatagggctttcactgctctgagtattcacccatatgcctctaggcctaaattcttagaaacaaaggctaaagctaaaatccattatcccctatcatattcatctggccgtaaactataagtcttattccttcaaacaatttgtcggactcagtccggcattgaccggtaagtttattgaatgccccgattcatgcacatatttggaaaatcctatcattggaggtccactcattccttcccggagaatt

SEQ ID NO: 483143 - DNA, 382 bp, Homo sapiens
  misc_feature (70)..(70): n is a, c, g, or t
  misc_feature (98)..(98): n is a, c, g, or t
  misc_feature (108)..(108): n is a, c, g, or t
  misc_feature (117)..(117): n is a, c, g, or t
  misc_feature (140)..(140): n is a, c, g, or t
  misc_feature (185)..(185): n is a, c, g, or t
  misc_feature (237)..(237): n is a, c, g, or t
  misc_feature (303)..(303): n is a, c, g, or t
  misc_feature (336)..(336): n is a, c, g, or t
tttttttgggggtgaaaacgtagtttatctacagatggaaatggtcaagtagagaagatcagtgatgtangtaagtctggggtaactgaagaacacantttttgtgtngtgagaganggaaacagagtacggatttgganatgggagcaagtagaattctctcgggctgcttttatttctcaccnaagaaagaatatcatcagttaagattggattggggacactataaatttgaanaaaagaatgggaatattgacttagagaactgaactaggggaagtattaagaaactgtgctgtgctnagaaccactgagtcagtcctggaataaactagnagtgcaattgttatttaccatcatgccactcttgagccaagatatc

SEQ ID NO: 483144 - DNA, 144 bp, Homo sapiens
tcgatctagaggatcgccactttacgcaggacatacttcctattctacaccctagtaggtcccttcccctactcatcggactaatttacactcacaaaaacctagggtcactaaacattctaataatcaatctcaaggccaaga

SEQ ID NO: 483145 - DNA, 127 bp, Homo sapiens
  misc_feature (17)..(17): n is a, c, g, or t
agcggggaacactcacntttggctaggccctagcaaaagtgaacaaataggattacatgaagtgaaaaagcttatgtacagcaaaggaaacaatcaacaaagtgatggttccccgctgggtaccgag

SEQ ID NO: 483146 - DNA, 158 bp, Homo sapiens
gagccggatatcaccgggcttggaaagtatccgtttggaagagaacctcctttaccggttgttaaagagtgttatagttccaccgttttctttcgtgtccagtaagttctcgaaaaaagcctgtgtggatcatatattgttggtcatagtttatctaa

SEQ ID NO: 483147 - DNA, 365 bp, Homo sapiens
catccacgggagtgcaagagcaggcttgggcagtgtgtacatctatctaagcactctacggggctcctatacacagcccccgccatgtaatccatggagagcaagatgggtcggcctgggttggaccacttcggctcatccctccagatgggtagatggcatgtggcatgcacaacttctaccctcagtagcttctagtgggaagcctgttagaacacattgtgctgctgcgggtcaggaccgtcatcaacatcgtccacaagaccttggtgaccaggccagatgtgctggaccctgcactttgcacggacacctcttgtgtgcaagtggagctgtgatttgccttcacaaccagagtgccgggc

SEQ ID NO: 483148 - DNA, 112 bp, Homo sapiens
gagaaagaggatcaatgaaactgcttagctggaatgattaccagacacagaggcaagacagtgtccctggttagctttaggggtctgcctgtgcaggcctcatcactgtggc

SEQ ID NO: 483149 - DNA, 624 bp, Homo sapiens
attctcacatagtaaacttggagttgtgcaggggaaattggccttttccttggatttgatcacctttattaagataaaatttacataacagtataggtttctgagttggaccaaacttatacaggggtataatcattaccaaattcacgatatgaatatttcagtattccaagaagttgtctcatgcatatgcgcagtcaaatattgttctccgacccctagtccctggcaaccattcatctgcattccttcactatagagttgccttttctagaatttcatatgagtggaatcataccataccttgtatgtctccaacttctttgatttagcatgatgcttttaagattcgtgagtgatgatacatgtttcagttattcatgacttttgaatgctaaatactaatccattgaatggatataactgactatcttgaactaggctgctgggaacatcttgtgtacaagtttttgggtggaatatgtatcatttccttagggtaaatcccaggagtggaattgtgtggttgcggttaagatccatgaaattgttaagactgccctgtttacagtgtgcctcagtatttttcgtcctccagcattgatgtcgatcttcgtttgcttt

SEQ ID NO: 483150 - DNA, 683 bp, Homo sapiens
agcaaattacagcaatatgaagagatcatacagtccactgaagaatttgaaaatgccctaaaggaaatgagatttctaaaaggagatactacagattgctgaaatacgctcgtaacatcaattctcattttgcaaacaaaaagtgccaggatgtgattgtggcagccagaaatctaatgacctcagaaattcataacactgtgaagattacttcctgattctaacgactacatgtgccacgagttacccactcctgatgacggataacaacactggcaagtaccacgacaagtatccacatacctcagtaccacgaagtgaatgaattcacgagcctgaacaatacattggaccaacatcccttttccttgcccacatgccgctatcagtgagtcctgctgacagaaactcactggaactcgcctatcagactttactagacggcaacaaccagcacctgatcaatgttgctgttcaactttttctactcagtgaggaactatcttcccatctcgtcccatgatgttgtaccaacatatcacaaggagaaccttcaaaacacttccccagtcggctgctattcatcacaacaactgtatgtacatggcatcaccacttgctgaccctcgggcatcagtccagcatcgcgtcttgccccatactttgtgcatggccctgctact

SEQ ID NO: 483151 - DNA, 354 bp, Homo sapiens
gacatgctgtactaatcaatggttcgagggagttagccccgtgcccagtgtactggcaaagttagctttactcaatcgttgcctgaggtcaggaacactaaaatacctcttagtccaaatagacactttcactgaataagtaaaggtctttcctacagggtctgagaaggccaccgcagtcatttctttccttctgtcagacataattcctcagtttagccttcccacctctatacagtctgataacggaccagcctttattagtcaaatcagccaagcagtttttcaggctcttagtaggtttcagtgaaaactttatatcccttacggtcctccgtcttcaagaaaagtaga

SEQ ID NO: 483152 - DNA, 535 bp, Homo sapiens
agtcatgggagacagcacacaaatgagattcatgacgatgtccaggtttctcctgagcgcatctacatagatggtagacccttcctttggattaggaaagatgacgttaacctctggtacactgtcttggtaagcctggatgagacagacacctcggctctccttgacatagaaagccagcagaactcttaaagccagttgtagtaacggagttgtcagcactcactgaaactcactttacagggaataagagtggtgtggcattttcaatacaatggtatgtaattgccaggcagtgaaggtacaagaagatgagctcatgtcacaggcctaccagatacggtgtcacgagaaagtggtgaggcaaaggatctggttcgaggaatactgatcttggaccaataggtgaacccaacaaactagtgctcgaggcttaggttactgtcatcacaagacttgggatgactccatcataatcctgaggtagtgggtatcagaactacatatggaggtcatgagctggggctggtgtcct

SEQ ID NO: 483153 - DNA, 126 bp, Homo sapiens
agtgggttgaccgtggtctagtgggttgaccgtggctagtagggttgaccgtaggcttgtgggttgaccggggcttgatttcttttggtttttatttttatatattttttttttttttttatatat

SEQ ID NO: 483154 - DNA, 999 bp, Homo sapiens
ctgatacgaatggaatgtatgacaagaatttaaactgtgtatggatcataattgcacctgtaaacaaagtaatatcggaatcctcactcattcaatacatttgcttctggaggcagtatagtaacaaaggcaataggatggctattatgatttattgtgaataggttcatatggattggggtgattaggtgaaacattgccgcatacgtttggagataggaaccgatttcggtgtgatacctacagtaacatagttccttttatgagtcttctatcatggtaaagcgtgtccatataagcggtatcaaattcctatcagatgattataacaattatgaagagggaaggatttaatgcttactattatcaccattcaatggaacattgcctggttggttggtacatcgatacaattgccaatatagtaatcccctaaatagaaaactatgtacatacaaccgcaaactttcagttcgagaaccactaggattgttacccaatcttatcgcatcatcgtattgtattagggtcaatttgattatcacccatccgttatcgagtcagagtccaacgattaaagcagtgatgggcaatttagtatgctagacttacgtaaagattagtagcgcgcagggaatttaatcttaactagttacaggggaactcaacccgtatgggattcatacgggaaattttcaaaagaattttcatggttctagttgggtcatagaaaaaatagtttattcatgactagtaggccaaagtaggtttgtaatgtgcttttctaataggaaggtacgaggaagaatgggtcaacttgtaacaagatactgggagagttttgttgaagagcatgaaacactcgtaagaaattgagatgtaatcaccttattctaaggattggggagatttgggaaaccactgaggacctaattcaccaagggcggttataagggagaaaccctattgagaaaaggcgcctaggaattgggccaggat

SEQ ID NO: 483155 - DNA, 360 bp, Homo sapiens
  misc_feature (112)..(112): n is a, c, g, or t
  misc_feature (210)..(210): n is a, c, g, or t
  misc_feature (260)..(260): n is a, c, g, or t
  misc_feature (280)..(280): n is a, c, g, or t
  misc_feature (292)..(292): n is a, c, g, or t
  misc_feature (331)..(331): n is a, c, g, or t
  misc_feature (355)..(355): n is a, c, g, or t
aaggctgccttggaagacacactgggcagaaacgggagggcgcgctttggagcccagctggcgcatatccagggcgctgatcagcgtattgaagcccagctggcagtggtgncgagctgatagtgagcggcagaatcaggagtaccagcggctcatgggacatcaagtcgcggctggagcaggagattgccacctaccgcagcctgctcngaggggacaggaagatcactacaacaatttgtctggcctccaaggtcctntgaggcagcaggctctgggngcttctgctgtnctttggaaggtgtcttgtggggtagagggatggggaagnaagggaccttaacccccggctgtncttcc

SEQ ID NO: 483156 - DNA, 509 bp, Homo sapiens
aaagtaagatgtagccacgaagcagatgagtatcagggtctcagggtattcacggaatcctgcgggttcactcactcttcgcttcagaacgtatatatgtcttccttccaaattaaccagtatacataagggctaaaactagggatctcagaaccagtatgccaagtgtcggtgcagtttccagtttgaccacggtgacttggggcaagttgctgcttctatgttttttcaacgaaacaacccagtggaaaaacaggtttccctttaaaaagtctaggcgatgagtaacactaccaccaccacaatgaggaaaatacttctggttgtagctttggatctttggtgatctaacttgagatgctctttaatcttggggaataacatttagaagattaaagctgtagtccaataatgaaaacccttggactcttgagaaaacacatgctaacttgtatttataagatgtgaaactcattacccatttacttcagatgagtgaaaggaagttc

SEQ ID NO: 483157 - DNA, 865 bp, Homo sapiens
tctctctctctctctctctctctctctctctctcactctctatgagggacggagtcaaagaaaggatgagagaaactgaaaacaggaaaaagaaagaaaatggaaaatcagatgaaaaaggataaattaataaagcagtaacaaataataaaaataaagaaaaagaaaaagacaaaaaaaaaaaaaaaaaaacaaaaacaaaaaatagagagagaaaacaaaaaaaaaaactgcaaggacggggacggacatcaaatccaaatacgatgataaataaaccaatgaacagggaacaggaagaagaatatacgacggggggaaagcaaaaacaaataggaaaaagagaccaaatgatgacaagaaccaaaatcacacaatgagagtagaaatattcgaaaagggaaaaaagagaaaggcacaaaatatatacttgaacaaggttaaaaattacaatctataagactaattgaatacatgaattaaaaaacatttgaaaaataacagaagatacgaaaacacggaaataaattacagatacaacaaacgactataacacagagtaatcgaaagaaaaatggaaaccaagtacatagagaaacacgagaacccatgaaaacttccaatatctcgaatacaacgataatatataacacccagaataacgagccaaacaagttatatcaataatgacacagacttggaaaaatactaagtatatataaaagagacactatatgacatctcatcgtgagaccctacacgtgagtctcacattagacacaatgagtatgtcaaacacagatgttacgaggacataatgctcactgggaagatgcgcaacaaattatactagaactctctggcc

SEQ ID NO: 483158 - DNA, 933 bp, Homo sapiens
gggggtgaagtgttaactaagatggtgacaatgagaatgaaaagcaggggacacatttgagagggattataaaggaggaatcggcaggtttgggggatggatctgaagggaaatccaagtggaagggatgaatcagagaggattcccagcctttgagcacatataactaggtaggtaatggtactaataacaaatctccaaattttagagttaggaaatatgtttcaaatcatccgattccatgtttcttaaataggctgtaaggagtatccagattggaaaccattatagaaataattgtcaactcatctttatgacttccttccttttgcccttttcccagtggtattttccaggttctggaaatgacctactttatgccaccactatatttaggctgcaaatttcccctgtccatcctgaccaaggtttgaacaatcccatgtggagaggaacttaattgcagaaacccttgccagcgtcttttaatttccctatatgccgggggtacttttggggttgagattgaaaaggaaaaaaatggtaaatgtgtggggaaatgtgttccagctccagacttccttcctcaccccaccaggaagccagtattgatgggtggctttcctgattaaaaaatggcaaaatttggccaggtgcagttgcttaacttaaccccttttaatcccagcacttttggaagcctgaggagggcagatcaaaaaggccaggagatcgagaccatcctggctaacatggtgaaccccgtctctactaaaatacaaaaaatcacccgggctgttggcaggcgcctttagtcccagctactcgggaggccgagtcgggaatggcgtgaaaccgggaggcagagtcttgcagtgagctgagatcacaccactgcactccagcctgggagacagagcaagactctgtctc

SEQ ID NO: 483159 - DNA, 129 bp, Homo sapiens
gtcctcttgatcctttaaattgctttgtctgtgtcacgcaggtgacctcatctcttacatgctccctgtagcaggggtcgttagacatttttaagtcacatccagttctactaatgagaagcagtaaaa

SEQ ID NO: 483160 - DNA, 230 bp, Homo sapiens
tggagactcagaggcacccggcctggtctctgtgatcaatgcacaaggtgcgggaccttgtcccaatgcagcagggtggtcctgcctgggttgagggtgggccagacagtgaccaagccatcagggacctggttctcccgtgctgcggtaccagatgtgatggctgtagatggcacgccatgccatgatgcctgtggatgagactcctgccttgcttgacacgtaaactg

SEQ ID NO: 483161 - DNA, 601 bp, Homo sapiens
  misc_feature (190)..(190): n is a, c, g, or t
  misc_feature (387)..(387): n is a, c, g, or t
  misc_feature (423)..(423): n is a, c, g, or t
cgtattcaagagccgagaccctcaggaaggaaggagtcacactcctgggtaatctcctaaggctgtgctcctgtgctctgacatcctcagtagcattggtgcagaggccctgcttcccatgggctgttcccagccagtgaccagtcacagcaggcacactaaggcaggtcattccggggagacagaggantcctctgatggtgaactgtggctccaggactcctccgtggccttgctcaacccgccttagatttcctgtgttctaggatgtgtcgaacaaaccttgtctcctgtccagcacttggggtcccacttgcaccgtggtctgccgccttttccagggacttttgtctcacttggcatattcccttacaggtgtgttccctnataaaatgccacagaggtgaagctcatcctggcatntgctccttggaggacttggataaaaatatttccatctgcacaccaataacccttacttattccaacctgtaaaatccttctctttatccaacttctgccacccccatagaattgattttgcttggtttgtagtatctctttgagttaacaggtattttttgttttaagcccctaaatc

SEQ ID NO: 483162 - DNA, 194 bp, Homo sapiens
cttataacctcaagagtgtacattcacctcccaccctcctggagcaccagaggggctcctgctttcagtgtggccaacagttgttgggtttgggactgccatcttgaaaacaggcagaatctgaactggtacaaactggccccagtaaacttgcaggaaggtggccctgctcccttgagataagccacggtcaa

SEQ ID NO: 483163 - DNA, 382 bp, Homo sapiens
cccaggcagaagagtttcctaccaatgatgacccaggcagaggagattcctaagaaggtggtttccaaaaaggctccattaaggggggtttttgggaggaaggccccaagtgagtttacttgggtgtgagaaaacatggccgccgcttttgcgccctctcatctgtacatctgtattcccacctccattattcatattgtcacctcgaggcttgggggggtgggggagataagattagaaaccccggctttctttttaacattggggcagcgccaggtatttggaaaacccgccctttcctttagcgcccttcctgcccttcctatactattggggggagggagaccatttcatgtaaaaattacacaacaaccctgtctac

SEQ ID NO: 483164 - DNA, 350 bp, Homo sapiens
atccccaccccccactcccacacacagacacccaactgatacactgaagattaaaattctaactgtagaacctagaatgtaactgtatttggagatggggcctttaaaaaggtaatgaagataaaatgaagtcatatgggtggactccaattccatatgagtggtttccattaagaagagattaggacacagacacacagaaaggtaagaccatgtgaagacactggaggaagatggccatctacaagccaaagagatgtacaggctttagaagaaaccaacactgctgacaccttgatcttggacttctagaagtgtgagaaaataaatttctgttctttaaactaccc

SEQ ID NO: 483165 - DNA, 1631 bp, Homo sapiens
  misc_feature (258)..(258): n is a, c, g, or t
gtgttctaatctaggccgccgatagccgccgttcgagggcgttgtaatgtattatgtgtcgacgggttgtttcagtacgccgccgtggggagaatgggggcttttgtttcgtgttagacacgcagagtgtgtgtctggagtgtcccacaaacgtgtgccccctgtgtgtgttgtgtcggcggaaagacccgcccgttgtttcacacgggtgtgctcttctgttggggggtgatccccgccgggggggtagacaccacnccctcagttgtggttatgtccggtaaacaccctgtgttaacacgtgtttggggagacacagcgcgcccctggttgtgtccccctttccgggcctttataaatccttggtggggatgtactccccaccgggtgttggtgttggtttgttcttggtgaaaagtgggtgaaaagaggggtggtgtgtaaaccctgccacgcggtatatttccccgtggaagaaagagggggtgagcgacccacaccacgtgtgttggaaatataatgttaggcgctaatttcacaccttttctttgaaggggttccaccgaacccacggccccgtgttctagagggagtgtttgctttcgccccacccacgcctccacatgggtggacacatggttacccacagcttttgtgtgggggaagggcaataatatacatcttgttgcgccctctctattaaaatgtgagtcgccccctgtgtattccgcctttcttttttagcccacggaactgagccttataaatgggtcccaaacggagggtgttttaaaacccgccggctgccgtgccaacgggggtttacacaccaccccgtcgtgtggagttagtaaaaaaggagccctcatagtgggccgttttgccccccaccggatatacgtttggacacattgggggggggtcttacacaccataaagtgtttaagataagtgtttgttcctcttgggggagagtaattctcacccacggggagaatatttcaccacattgtacaccccccacgctctttagagacgcccctcatatgtggtaacgcaccaggtgcacccacacactgtacaccctcttgtgggtggttataaagaatgtggtattgagaaatatgcgccgtaatacacgttatggttgaaaaagctggtgtgtaactcgtgaaaccgggggagaaacaccacgaggttctcttggcaattcttgggccctctctactgtgagtttgttataaaggaggtgttctctcgtgcacacctgggtgtcccccccacacccccgccaatgcgttctgtgccacctgtgggctaaacttgttaaataatggtggtaattttgtaccactataaggtgattaatttcttaaactcggagcttgttcttcgtgttaagagctgtgaataacacttaatatttctgagcacttatttgtaactatccgctgtgagtcacgtaagagttcctgtaagagaatactgctttttaaagagaaaaaaataaccactcgctgagaggggtgagcctatatcccactgtgaggtggtcacctttattttaataggatttttaaaacatttttaatgaactaagttgaataaaggccaccatttaaaactgtcga

SEQ ID NO: 483166 - DNA, 223 bp, Homo sapiens
attcgcggccgcgtcgacccatccccatcatgggcatcgatgctggcctggctgtcctgggtgtgctcgctgtccttggagctgtggtcaccggtgtgatgtgttggaggaagagctcaggtggaaaaggagggagctgctgtcatgctgcgtgcagcgacagcgcccagggctctgatgagtctctcatcgcttgtagaggctgagacaggtgcctttgcag

SEQ ID NO: 483167 - DNA, 93 bp, Homo sapiens
  misc_feature (27)..(27): n is a, c, g, or t
  misc_feature (46)..(46): n is a, c, g, or t
tttaaatcccccaagacgagaatttanctcttgatatgctcagagnctggagatgcgaatggcagagatgctcaggctcagctgcaatatccg

SEQ ID NO: 483168 - DNA, 105 bp, Homo sapiens
  misc_feature (70)..(70): n is a, c, g, or t
agcggcgcccttttttgtcctctcttcctttcttcgagcttagtcacacttccaacttccacataaacanattgaaactgtatgccaatctccccactctccaaa

SEQ ID NO: 483169 - DNA, 1963 bp, Homo sapiens
  misc_feature (1)..(1): n is a, c, g, or t
  misc_feature (1030)..(1030): n is a, c, g, or t
  misc_feature (1352)..(1352): n is a, c, g, or t
ncgcgcctgctgtcctagtgttgctcgtgtacgttgtgttcgtgtgatgtgccgtcctatcgcgctggcggctgtctttctgctgcgtatctattcgcagcgttatggggctcctattatatatcagtggtgtgattatgctcgtacgctcttgttgtcgcaactgcttgtggttgcgcccgctgcttgagttcttcctgttgtatgttgtcgcctccgtttggttagtgtttgctgcggtgtaggcgtaacatactcccctgttttgtggtgggcggcttcttctcgttggtgagcctccctccgagatgttgtgctcgctgtgttactcacccccggggtgttcactctcgtggttagttggtggctggtccctccttctcccaacgccagagtggtgtccaccacaaatggttggtgggccgccctctataaggtgcactacagcgagtagtgtggtgcgatgtgtaaagaggtagattataccctttttttcgctctctggctcctaggtgggccctctttgtgggagcatcgcttgggcgctccaccaatagtgggtgtgcccgaacacgaccagcactgtgtggaagccacgcgggatgatgttcaacacgcttggggggtgtccttctcccacacgcgaaggtgaggaaggaattggtcgccagacacgtgggtgtccccacaccaccaggagaggtgtcttctgggatagtcgcctcaacacacaaaggctctcacctttggtaggggtgaagtgtgtgcttgttctaacagaccgttcgctgcgttgcttccttcacatcgccaaaggggatccgctcgcctcactaacccgtcttgatgggggtatgcccaacgtgtttctgttggtgtgcgcctccgcctcatgggttgcctcccgcctggttgtcccccgtctcccgttgaagtagggcgtgttttgctcttgggttgagaatgggagccccccactggcgacacgcttgtcgactatacatcgtctgcacctatgggtcatcctgtngtatccgacggccaaccggtgtgtgtgttcctgcccacgggccacatcgtgtgtccggggggaggactgctacgccgcctccccactcgccacgcgcacagggttgccggtctgtctccgtctcccaacagacggtcacaacacccgttctgtgggggaatagtccgtttgtacgcacattgtgtggtggtcttctcttgggtaatatgagtctcccctgtaatatgtggagaggggccgcacacaagacacacaggaggcacattctctcccacataccactaggaatatagcgcacacaccacttgggacacaggtgtgnggttatagccacacacctctccacagggattgttgggagataaacaccacacctttccacagcccaaccgctcttaatgagacccttggttctgtcaccacagaggaacacacaggggagaagatacaccacaccgcacacctatgggtgcccacccagaacatggcgcccatactccatcttttaatggagagatctctccagacaccagaggcgtggcgtatataggggagattgtgtagatggtgcgcacacacagaccagatgtataagaagagtatctccacacccctggagccatctcacacccagatgcgctgtatagcctccaggtgcaccagaataggccaggacagtgtcccatagccgagagctgcgcccctctacgcccagaagatttgagccccaccctccaggaggggcccagaaacccgggggcccatccaaaagccatcgggatttggccatggttcccagatgagcttttctaacccaacctagtagattgtttgcccttttttgcactcagacctgtgtaaaatatgctcctggaacacccaaaaaaaaaaaatatactcgagcataatcgtcggtcgaaagataatactcag

SEQ ID NO: 483170 - DNA, 1345 bp, Homo sapiens
  misc_feature (10)..(10): n is a, c, g, or t
  misc_feature (639)..(639): n is a, c, g, or t
  misc_feature (755)..(755): n is a, c, g, or t
gacagggganaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggttcactactgtgatagacaaagtggcaaagagtgtgtgacctgtctgacattagcccctgtgcagatgactttccatgctattggaagctccattgaagccagccatgatcaggtataatatgccactgccattttgctgtgttatggcccagctcggaaatggaaggccatcaaaatggaagctatgtgcgcacatgcagctttgctttccttaatacattatctgctagcaccatctgctagacttgaaaaatcaaaattgtttgngttgggaaattgatatcatagtagatttaaattattttagacttcttgtttgcagttcattattattttaaatatggaattattttatatgaaaaatagttgtcccacagggtatntttatctttaatagttatatatgagaggaagggtcaacaaaacaatatagataacactggagtctcgctgtagtatactcatttggttctgttaaaaagagttttgtattatagaatgtacagtgatgcgtcacttaatgacaaggatatgttgtgagaaatgcatcatcaggtgattttgttgctgtgcaagcatcacagaatgtacttacacaaacctaaatactagagcctaccacacacctaggctatgtggtagagcctcctgctcccactacaaacgtgtacagcatgttactttgctgaataccataggcaattgtaatgcaatggtatctgtatatttaaacatagaaaatgtacagtaaaaatatggtattgtaaccttctgggagcaccattatatttgtggtctgttattgaccaaaacgtcataatgcagcatgtgactgtatgtagaacaactgtgtaaactttcagaaccatcaacttagtcccataacttgggatattattgaaataaagttccagtattgtttttacttttaaaggtttatttctgaaataaagctaaaaatctgaaaagtgaa

SEQ ID NO: 483171 - DNA, 116 bp, Homo sapiens
ggatttgctggtgcagtacaactaggcttaatagggacatgatcaagtgggtttcatatgagggatgaagagatggtttaacatccacaagttaataaatgtgatagaccacataa

SEQ ID NO: 483172 - DNA, 2773 bp, Homo sapiens
  misc_feature (10)..(10): n is a, c, g, or t
gacagggganaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactcagttctccctttttttacataaggattgagtttctttttatgatgattttacctttatagcaattttgaattttgcattctattgctagtattgattcaggtacaccattaagatacaacattctagaagtctattaccttaggagttaattaaacatgatatttgaagaataatgaaatgctttatagttgtttgaggcataacaatgtgtatttgttttactggatcatgttttgaactgactagggagggtagcacctgcctcagatagtaccaacaattctgtttcactgggtagtctaaaactagcttatagtttaacttaacttgttgtgtatgtgaatttagggatggaaactttttttcccctatttattctttgtttccttctgggaaaaaaccccacaaaaatcagcactcctttatggatacattggagcttttgaaagaattgtaaactctaggaaggggaaatatctgtgtcttgatttcttagttgccttgaaaatcatgtactgaactgtaaccgctaacttgactggatgaactagtttgcttgtgtgtagagagtgtattgcttcctcagatttcactgttttcatctccttttccatcttagtctttattccttaagaccaaaaactgtaatatcctttagaaatgctctagaagatctgtattgtgtagaatgatcatgtatttataaatattttacaagtttagattataaaatgaaaaagaaggtcatgtgttttggggggtattttgcatgttcggatttttttttcccttcaccgaacccttctgattctttcaaactattgccaggtagttgttagtgtttctaattggactcttaatatgaacttcaagaagctgttaccagttatcggctctgtcatctgaaattttaaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatgaaaagaaattaactgcttatttatgaatctaatcatttagaaatgtctgagagtaacactgcattcttatagaaacaaagcacaaattgcattcaagctctgaattgattttttgcttggagctgttgttacagtagctgtaattttgctaccagaatgtcttaattttttaaatttgtttttatttctaagctcttggcaatgacaataattataattttaacatatcttcactgtagtcaacatgtagagtctgcttccctcattattgcattgctaaggcctttttaaaaagcttatgcttacataatatactcttttttatggacacgttatatgtttccaaatctgtgtattgtgatttttacatactaatgaatataaacaggtgattttaaaatattactgtgcttctttggttgaatgagctggtattgatgtaaaatactctgtcattgatggaccactacctgcagctaagcagtgagcagaatctccgggaaatgacttagtctggccacatgcatagcccatcttcataatgtcgcagcagaaggttctttgtggttaaaagttttaaagcctatttctttataggtaaccctctcaggtatatttacctggtagaaaaacatgtagattgtttctattacttaaatgttttaattggactgtagtttagaaattacaggaccagcttgttacagattatacactattctgttacttttatttctgaaacttaaaaacaataaattctttttctgtgtttctaggttagaacttttttattttattgcacactgaacagatactgttgcttattgaatattgtgtaaacccttctttggctttccttgcccattgcaatttgatttaagcctactagagccattgtatgtgacagctatattgtattacaaagtaaaaatatatgagtgtattg

SEQ ID NO: 483173 - DNA, 108 bp, Homo sapiens
taagagggggggttttttttttttcggggggggaaacccccggggggggcccccgggggggggggttgggggggcccccccaaggggggggggggcaccggcccccaa

SEQ ID NO: 483174 - DNA, 2950 bp, Homo sapiens
  misc_feature (10)..(10): n is a, c, g, or t
gacagggganaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactcagttctccctttttttacataaggattgagtttctttttatgatgattttacctttatagcaattttgaattttgcattctattgctagtattgattcaggtacaccattaagatacaacattctagaagtctattaccttaggagttaattaaacatgatatttgaagaataatgaaatgctttatagttgtttgaggcataacaatgtgtatttgttttactggatcatgttttgaactgactagggagggtagcacctgcctcagatagtaccaacaattctgtttcactgggtagtctaaaactagcttatagtttaacttaacttgttgtgtatgtgaatttagggatggaaactttttttcccctatttattctttgtttccttctgggaaaaaaccccacaaaaatcagcactcctttatggatacattggagcttttgaaagaattgtaaactctaggaaggggaaatatctgtgtcttgatttcttagttgccttgaaaatcatgtactgaactgtaaccgctaacttgactggatgaactagtttgcttgtgtgtagagagtgtattgcttcctcagatttcactgttttcatctccttttccatcttagtctttattccttaagaccaaaaactgtaatatcctttagaaatgctctagaagatctgtattgtgtagaatgatcatgtatttataaatattttacaagtttagattataaaatgaaaaagaaggtcatgtgttttggggggtattttgcatgttcggatttttttttcccttcaccgaacccttctgattctttcaaactattgccaggtagttgttagtgtttctaattggactcttaatatgaacttcaagaagctgttaccagttatcggctctgtcatctgaaattttaaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatgaaaagaaattaactgcttatttatgaatctaatcatttagaaatgtctgagagtaacactgcattcttatagaaacaaagcacaaattgcattcaagctctgaattgattttttgcttggagctgttgttacagtagctgtaattttgctaccagaatgtcttaattttttaaatttgtttttatttctaagctcttggcaatgacaataattataattttaacatatcttcactgtagtcaacatgtagagtctgcttccctcattattgcattgctaaggcctttttaaaaagcttatgcttacataatatactcttttttatggacacgttatatgtttccaaatctgtgtattgtgatttttacatactaatgaatataaacaggtgattttaaaatattactgtgcttctttggttgaatgagctggtattgatgtaaaatactctgtcattgatggaccactacctgcagctaagcagtgagcagaatctccgggaaatgacttagtctggccacatgcatagcccatcttcataatgtcgcagcagaaggttctttgtggttaaaagttttaaagcctatttctttataggtaaccctctcaggtatatttacctggtagaaaaacatgtagattgtttctattacttaaatgttttaattggactgtagtttagaaattacaggaccagcttgttacagattatacactattctgttacttttatttctgaaacttaaaaacaataaattctttttctgtgtttctaggttagaacttttttattttattgcacactgaacagatactgttgcttattgaatattgtgtaaacccttctttggctttccttgcccattgcaatttgatttaagcctactagagccattgtatgtgacagctatattgtattacaaagtaaaaatatatgagtgtattgaaaacaaagttgttttaattttgtttcatcacccagtctttaatttgaatttataaattacaaaaagctactttgatcaactgaatgtaggtatccaagctcaaattcttttaaacctacaaaataggtaaaattattatacaattaaaaaaattacacaactggcttaagagagca

SEQ ID NO: 483175 - DNA, 1828 bp, Homo sapiens
  misc_feature (10)..(10): n is a, c, g, or t
gacagggganaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactcagttctccctttttttacataaggattgagtttctttttatgatgattttacctttatagcaattttgaattttgcattctattgctagtattgattcaggtacaccattaagatacaacattctagaagtctattaccttaggagttaattaaacatgatatttgaagaataatgaaatgctttatagttgtttgaggcataacaatgtgtatttgttttactggatcatgttttgaactgactagggagggtagcacctgcctcagatagtaccaacaattctgtttcactgggtagtctaaaactagcttatagtttaacttaacttgttgtgtatgtgaatttagggatggaaactttttttcccctatttattctttgtttccttctgggaaaaaaccccacaaaaatcagcactcctttatggatacattggagcttttgaaagaattgtaaactctaggaaggggaaatatctgtgtcttgatttcttagttgccttgaaaatcatgtactgaactgtaaccgctaacttgactggatgaactagtttgcttgtgtgtagagagtgtattgcttcctcagatttcactgttttcatctccttttccatcttagtctttattccttaagaccaaaaactgtaatatcctttagaaatgctctagaagatctgtattgtgtagaatgatcatgtatttataaatattttacaagtttagattataaaatgaaaaagaaggtcatgtgttttggggggtattttgcatgttcggatttttttttcccttcaccgaacccttctgattctttcaaactattgccaggtagttgttagtgtttctaattggactcttaatatgaacttcaagaagctgttaccagttatcggctctgtcatctgaaattttaaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatga

SEQ ID NO: 483176 - DNA, 1080 bp, Homo sapiens
tggggtgttgggtatttcccccgggcccaaaaaattgggcccttttgggtgtgtgtctcttataaaaatttctgtgtctcgctgtgccccacccacggggtatttgtggaaattatctccgctgtgttcctcctctttttgtgtgtattttaaaaaaaaaaaaaaaaaaaaaaattacaaaaaaagggggggtgggcaaacacgctgtgtaaaggggggggcggagtattgtgtgtggcgcgcgtgagtgtgtgtttgtgtgttctctagggcttttttggagaaaaaaacaggcgtgggagccagtgtcattatatttcaccaccccacaactcgcggaaggagaagatatttgtgcgccccacagcgtgtgtgtctgtatatcatatgataccaccccgaggacagagagagggcgagagtgagttttattctccccatgtgtggtgtgtataaatctaaagcgcactattcattcaccgagagaaaaaaattggacaccaaaagaatctccccgtctctattcttacctcccacaagagcgtgacactgtttgagcgatatgtggaattatcctcacggtatataaagaggagtgcgccccttgtggaaaatatatacgagcggggtgaaaatctcttatctcacaattgtgtggtgtgttgctgaatggcgtgtgtccttccatgagttttataaaacagacgcgcctcttataaccgccacccccttcctacaagagaacaacaaaagagggggggccgcgcacacatttctaaccaaacccagaaaaaaaccagcacaacaatatgctccaaaaacaccccccggggaaacaaacacggcgggaacaactatcgagaggcggcgcgaccaaacgcccacgaccacaaacatagtatgcccgtcgggaacaataacaagcaaaatttcacccccgcgaagaaatatatcccaccgaacaaaggcgaagagaaaaagagggagtggaaaaaatagaaacaacaagagcaagacaacacaccccctggcacacaaacgccgggggtatcctccgcacacaccccaggtgatatgaag

SEQ ID NO: 483177 - DNA, 988 bp, Homo sapiens
taaaaaagacaatattctcttaatttctgctggggatacaaatgtccagttgggatgatgaaaatgaggcaagtacgggacaccagggcgggctctccggttggtcccaataaattccaagggaggaagaagctaaccaggtttgggagtggttatgggatcatacgtggcatctaggcttatcacatgtctacagccgtggtcctttcgtggaacaggacttcccgtgccccaggtgatgacagctataaagaggggccaaacattgagcgaaatcccacagtgtaatccgcaggcgcaggcgtgagtgtctccagaagtgttctctaaaaatcctgttattgggttcagagtggggagtgaccaatcagggcgtgcttgccccatttcgtgcctccacggcatcccgatactgcttgtgcctgcctaaggtcgggagagatcaattacaatcgggggggctggttgggggccataagcctgggcagctttgtctgggctaacacacgcactttatatctatagggcctgggggatactccaagtgccgcgacagaacataggcagctctacacaagaattaacgcccaattaacccgtaccgcttcaccaccagaacgttcgccccacacggggaaaggcatctccgaaccacttaaacgtgtttgtggggaaaagccccaacacccacgagacctagaagaaggggggggagcaactccgggtcaccgcccactgggacacttggcctgcaaaccctaacctaccagggacaggtttgaaacatactggcagcatacaccggccgggggagaatactctaatgccactggtcacacacacccctttacaaagccgcggcggggaccacaggcgctcaggagacacggcaaaattcccggacgaccggcaaactcagagggaggacgagtcgggcgtggcaacaaagggagggagacggagaccaacgcaaacggcgcaagaacgt

SEQ ID NO: 483178 - DNA, 562 bp, Homo sapiens
  misc_feature (21)..(21): n is a, c, g, or t
  misc_feature (60)..(60): n is a, c, g, or t
  misc_feature (86)..(86): n is a, c, g, or t
  misc_feature (100)..(100): n is a, c, g, or t
  misc_feature (119)..(119): n is a, c, g, or t
  misc_feature (129)..(129): n is a, c, g, or t
  misc_feature (164)..(164): n is a, c, g, or t
  misc_feature (205)..(205): n is a, c, g, or t
ctgtattcccaccagtttggnaagcttaagccataggatcgtttaaggcttaggagtttnaaaaccagcttgggcaacgttgttanaccccggttttttncaaaaatttaaattttganccagggtgtnatggcatgcccctgtagtcccagccactcaaaggntaagatgggaggatcactttgaacccaggactttgagactncagtgaggtatgattgtatcagattgcatcgctgcactctaggcgagaccctgtctccttaaaaaaaaaaaaaaaaatagccgggtgtgttggctcacgcctgtaatcccagcactttgggaggccgaggcaggtggatcacgaggtcaggagttcaggaccagcctggccaagatggtgaaaccgcgtctctactaaaaatacaaaaattagctgggtgtagtggcaggtacttgtaatcccagctacttgggaggctgagacagagaattgcttgaacccaggaggtggaggttgcagtgagccaaaatcatgccactacactccagcctgggcaacagagcgagactcagtctc

SEQ ID NO: 483179 - DNA, 1101 bp, Homo sapiens
  misc_feature (236)..(236): n is a, c, g, or t
ggcggagtgactcggtcggtcattacctgctgtgtagttgccccgaggactaggagcttaagtgaacgagtcagattctgaggaagatgaatccacaaagaagaaaactagtccttcagggtatccactgagggtactggtttgtctgccttgcttccctaaggctacaagaacctggactgtggaaagagattagacagtgttgctcctgccccaagtgccttactgcccgtganaagcccttcgggaatggctcgccgctggatactgaagcgcctctcagaactgggcttctaaggatccaagatcttccgtcgtcttgcccctgtcgtgggcaccagaagggcaccatctctcagtcagctcctactgactaattcaatggtcttgccttgcctaaggatgttgcttggcctgcaaggtggaacgaaaagcatgactacacttgcctggagagatagacctgagcgagttgaattgagaggaaggttacagcccctcgagagaatctttgttccttcgcgctcgcgctgagataagtgcctgtaggtgcgacgctggacggtttgtaggacccgattaactccatttaactgcactagttctcgcgcatcgtggtacccatggagagaggactgtgctaccaaggtccatcgggaatcgcaagaagcccggacttttgcccagtgtagcggagtgcagtccgaatgtcacccccttggaattcccaagatttgtggcttggcctatggcgttcgacccgtttggtgtggccccgccttttgtggattggcccttcacatgtctcctagggtggggaacagaacctttaaccagggcttttaacaccattaccgatgggctttctgcccaagcaattaatttgtggcgctgaattgggccctaaaaattggcccctgggctagcgttgggccttttactttcacttccccgtgtgcatttttaattctaacgaaagggtgggggttgtggcttaaccgtaattaaaccttaagctaagcaatgggaaaccccccggaggcgccccttttgtggttccccgcctctcgctgccgaagtgcaagaaagttgggcccccag

SEQ ID NO: 483180 - DNA, 231 bp, Homo sapiens
tctttatcgtctaacgtcgaacacctccattcacgaactccactctactcatcgattcatcaaacatgttatcaaagtacgtaggaagcaatcaaggttgccgaaaattaaaagaaccctagggtccgagattcaacaggccttgaagctcacgaaatgcttaccgtcaacctcccaagcgaaagaaagtacaacatcgatccattgacattggcataacaccacacaatt

SEQ ID NO: 483181 - DNA, 577 bp, Homo sapiens
aactacagttgttcagaacgtgtgctatggtttgaatgtgtccccttcaaaattcaggtgttgccaatgtgacagtattaaaaggtggagcctttacgaggtgattgagtcatgagggcacggcctcatgaataggattaggtgccctcatgaaaggatttgtttttttatttgttttttttgggctctgttgtggcaccaggcggggatgtggctgtcggagcacaagtctgcggctcattggagaaatctaccggtgtcccgagttgcaacgcaatgctccgtgggtaacacgcctccaaaaggagctggggattacaggcgggactgttgccattacaaccccaggttgaccttttctggtgatttgttggtaaggtaacggaggattggagttttccaccaatttgggccaggggtaattccttcgaagtttccgtaaccctcagggttagtccgaccccacccttgggccgtccaaagatggcgttggggattacacaggggcggttacgcacacgggggcccagcctctatcaacagacatttgggagtggaggggatttccaacggctcg

SEQ ID NO: 483182 - DNA, 884 bp, Homo sapiens
gatcttccccgtcttcaggtgacctgtgtctatgaagctcatttcgcgtctgtggatctggtccgcgtggtcgtcaagtcatgtctgaagccaatcagatccctagtaattaggcagcacctagcgtcaacatgagcactattcacttgtgtagtgcacgctagcttgttaccattgcagtctagtcttgtgctgaattctccgccatatacatttcttgttctgtccggatatcagccccactggatgggtcgtcctggatcggtgtcctaaatgattcccgttggccagcaacgtgtgcctcgttccccttccttgggtagcatgtcatcgtaacacgataatgaatcacgtctgccttcaagagacctgggaatgtgggtcatcccttgttgaggcatcgattgcgcacccgaaaggggtgcggcatttggaagaccaattacacgacttggagctgagaagcccaatactgtggcagcaatctttcaaactctcctagatgtgtggcgaagcccattaagatagaaattaccgccacacgaaagtcagttaccggttactcggttgtgccgctaaatccaagtcaataccagctcttgcctgagctgcttccaagtcagctccatccattccccctaaggagacacttcagtttgctttgactcgtttgaatcacacccgaggctacaagctcacaattgctctttaaacacttggtgtgactgctaatgaattgtaacggactgtctattatcctggggggaaccatttcttcgactcagtattccagcatgtcagccatgcaagtgacattgcaaggcacagaagtggtggtcatgcaagcccggaactatgaagcgggtccgggaattgtctcattc

SEQ ID NO: 483183 - DNA, 933 bp, Homo sapiens
acccagtggatcctgcaccagaagctgcaggtggagctacctgccagtcccacgccctgtgcccacactcctcagcccttggctggttgatgggactgggcgctgtggagcagggggcggcgctcggggaggctcaggccgcacaggagcccacggagttcggggaggctcaggcatggcgggctgcaggtcctgagccctgccctgtgggaaggcagctaaggccctgtgagaaattgagcacagcagctgctggcccgggtgctaaaagcccctcactgctccggcggtggggccagctggctgctccgagcgcagggtccgctgagcccacgcccacccggaactcgcactggcctgcaagcactgtgcgcagccccggttcccgcccatgcctctccctccacacctctccacacctccccgcaagctgagtgtgagcccggctccgccttggccagccgagaaaggggctcccacagtgcagcggcgggctgaagtggctcctcaagtgccgccaaagtggaagcccaggcagaggaggtgctgagagtgagtgaggggtgtgagggctgccagtgcgctgtcacctctcactaatttccccttagtttattttttgtttaaaatggagtttcgctctttgttgcccagggctggagtgcaatggcgaaatcttggctcactgtaacctcccacctcctaggttcaagcaattctcggtgcttcagcctccccagtaagctgggattacaggccccacacctggtaattttgtttttagaacagaagggattccccggtagccggtggtttcaactcctgactcagtatccactgcgtggcgcccagtgtggattcagcgttgcccgcccagccccctaatatccggctactggtgcgctcacattccaactggggggttagggcgtc

SEQ ID NO: 483184 - DNA, 342 bp, Homo sapiens
gaatcgagctcgtaccagcaggggtggcgtggtgctgcagctgatacatcaggcgctgtggccactcggaaaacttcttcttcatcgaggtgggcctgttctgccgtgacggggcccggggagttctggatgcaggtggatgactctgtgtgtggcccatgaacatgcactgagaccactcctgtgaggccatgctgggccatgatgtgatgagttcctgccctctgcagcaatgagccatgtcctctgtccaacgtgctctatacccctatcagctgtcccacctgctgcctggcgaccatctcaacgaatccccctgcccagccatggtggtggctgacc

SEQ ID NO: 483185 - DNA, 313 bp, Homo sapiens
cttgaggtaaagagttgagaccagcctggctagcatggcgaaacccagtctctactaaaaatacaaaaattagccgggtgaaattagccgggcgtggtggtgtgtgcttgtaatcccagctactcgggaggctgaggcaggagaatcgcttgaatccgggaggcagaggttgcagtgagccaagatcaggccactgcactccagcctcggggtcaagagcgaaactctgtctcaaacaaaaagaaagaaaggaaggaaggaaggagggaaggaaggaaggaaagagagaaagaaaagaaagaaagaaagaaag

SEQ ID NO: 483186 - DNA, 137 bp, Homo sapiens
agacgcatcatacaaaaatttaaaaatttgccgggcatagtggtgtgctactgtagtccagctactcagaaggctgaggtgggaggatcgtttgaccctgcctgggaggttgaggttgcagtgagtcgagattgtac

SEQ ID NO: 483187 - DNA, 393 bp, Homo sapiens
atgtattacctctgctgggagcagctgggactaggtccccatttagcgggccagacaagctcataggggatggggtcaccaggaaagcaaagacaccatggggtggccgggctgtccaggggcaccgagaagctgaagtgctgacagggagtgaaaaaggagagctcatgcggccagggctcccgaggcatgcacggggctgtgagaaaggcaggaagcctcggttacaaagtggcctggcatccaggaagtttcgggtggaagcggagggctttcccagacggctaccttcacaccgatgaaggtggtgatgaggtcgttccttaggatgcggaaccctgacttcatgtacgggatgtcatatgggtacacccaggggacgatgtcccaaag

SEQ ID NO: 483188 - DNA, 804 bp, Homo sapiens
  misc_feature (400)..(400): n is a, c, g, or t
taaggcatgttcaggcggccgggaacgggcggtggggagcgggcggagctggccctgcctctgcctggccggcgccgcagtcggtgcgggccgtgcccgtcgccgccaactgccctgagctgcttgctgaggccgagggagacgtcggggcctgcacctggagggagcctgccgcgctggccccgaggagggggcgttgccatggctgactgcctctcccgctgctgactggggggcggggtgcggccctgggaaggagggctggtctcctggccccgcgcccctcccctttactctcccctggtacttggtatgggcccgtagttgggtggcaacgacctccgggcattggggcatttccagcgtctcactagaaccattcagctatccgccagatgcncggtcttggtcatcttccgaacgtaaggacgagttttaagagtgcttcgtggagtgttcagatgctaagcaccctttactagacttggatgcaggctcgaattttacttcggtatatacctttcgaagagcaagtaaaatgtgcttgggctcccacgttattttctcccgtgtggtgttccaggagttcctgatccgatatccaccgagacaagcttggcggcccacgggctttggcgcgatccatggctggcaagtggtgtccttccgctccccagaggtatcacgtagcttatagtgctggactttgaggccacgtgcgacaagccacagattcatcctcaggaaatcatcgagttccccatcctaaagctaaatggccggaccatggagattgagtctagc

SEQ ID NO: 483189 - DNA, 632 bp, Homo sapiens
aagtcgatgaactgccttgtattggaatctttgcaaggcctcttacattacagggaactctcacaattacttgactttgaacatccttgatctgagatagttttagagtttttatacagccatctgtcagatttggggaaaaggaagtaaaggaatttaatacagatttagtaattactgctggaagtaagacttcacaattgaaaattctggatattactgcggagaacactttttaaaaagctcacttaatattgcaaataatttccttgtggagatgaagaatatactgttttaagaacgattttcaaaaccacctgccctaatgttatttaacctttttatgcctctgctccatcagatataaaacaggaatacaggaagagtacccaccacagaggctcagtgtgtagatgagtgagttgtgtatgtgaagtgcttttagaagagcacttaccaaaaataaagcacttaaagtgtttgccactattttattagtatgaagtcagattacacctgcttcttacttttatgtttttccctaagtgtgtatcttaaaccaggctactcattcttcctgacaggccccctgtgtgtcagagtatggacatccaatggaagcagaactatga

SEQ ID NO: 483190 - DNA, 186 bp, Homo sapiens
ccaggtaatatgatgggatggtggcaggatgtgattcaccctgagtatcaggagtttcaagaccaactggccaacatgcagaaaccccatctctactaataaatacaaaaattagactggacatggtggcacgtgcctgattatcccacgctacttgaacaaactgaggcaggagactcgctttga

SEQ ID NO: 483191 - DNA, 796 bp, Homo sapiens
  misc_feature (117)..(117): n is a, c, g, or t
  misc_feature (199)..(199): n is a, c, g, or t
  misc_feature (277)..(277): n is a, c, g, or t
  misc_feature (336)..(336): n is a, c, g, or t
  misc_feature (434)..(434): n is a, c, g, or t
  misc_feature (473)..(473): n is a, c, g, or t
  misc_feature (508)..(508): n is a, c, g, or t
  misc_feature (511)..(511): n is a, c, g, or t
  misc_feature (536)..(536): n is a, c, g, or t
  misc_feature (604)..(604): n is a, c, g, or t
  misc_feature (786)..(786): n is a, c, g, or t
gaaatatgggggctaggactgaagtcccctaacttttggtggctcttgtgaacagagacagttgagacttcaacatttcaaccccatagaaggcaaggaagtgcagccaggggaatngggaggcagggaagaggcatgaggtgtgccgggagagcgattatgtgcatctcttcccaactctgagttcagtgcattcagngatgctggcagcatgacatgggacactgctgggagaatttacaccacagaagctgcccaaatgcaataaatcagggcntttttcccctcccagagaactggtttactatagacgtgtgacacaccgtcccgagctantgctgaacccacccaagcctggctactgtgacaagctgtcacctccccactcggggggagtgccaactcccagccctgcacatccctacaatcagcanaacagagtggggctgagcaaaggaaagggaccagaattnggcaacccattccctgcctggagtccacttcgccncanctgggctggcttgcagcccaagacnaaagttggtgtccaacagaaaggcagcttggggctacagatagcctcctgtgcagtggctcgtggcanggagtggggaaagaagggcatgtgcaccacccagagataaggaggggtggccacccgggctggatgcccccccggcaaaggatggctgtgcccatgagaagagtggcccttcctctgctggccatcagggtggagtaggagtgactcgtggcagatcccgggaatcgggatttttctggagntgctggctaa

SEQ ID NO: 483192 - DNA, 403 bp, Homo sapiens
ttgggaaaccacaggtagccaactagggaggaaatgtactgaatgctagtaccccaagaccttggagcaggaaagtcaccccagacacctctgctttcttttgccatctgacctgcagcactgtcaggacatggcctgtggctgtgtgttcaaacacccctcccacaggactcactttgtcccaacaattcagattgcctagaaatacctttctcttacctgtttgttatttatcaatttttcccagtatttttatacggaaaaaattgtattgaagacactttgtatgcagttgataagaggaattcagtataattatggttggtgattatttttataagcacatgccaacgctttactactgtggaaagacaagtgttttaataaaaagatttacattcca

SEQ ID NO: 483193 - DNA, 387 bp, Homo sapiens
ctcttcatacaccaccctgagttgcaagtgctgtgagccatctttctatggtgaggtctggcctgaggagtcacatggaatgtccgcaagccccacagcctggatttcagagatggccccatggggcaatgctacatactctccgaacgagctacgggccccatggtctgaatcgcgatgacggttgatgtccattttggagagcactgctagcggcagatccacacggcagcgggctgctaatgccaccaagtagatgacgacgtcactaagctcctcttgaagggctgcccgttccctgggggaccagccttgggggccacgttccccatcggatttccactgaaagagttctgccagctaccccactttccccgtagtcagacc

SEQ ID NO: 483194 - DNA, 860 bp, Homo sapiens
gcgccttgcccgcggtcctgggctcgccttttcccaggtcttctcgttgctctgcgcgcctttccccggtccggcagggcctgttccccgcttcctgtcatgcatcccccttcgagtgggactcggccgcgcactttccagcttttggaagtgtgccagcgcccccgcttgctccatacaggtgtcccaccgcggccagtcttcccgcgtttttcgagcccactcgataggtccctcggtggtacggtggatctttaaggaaggtttgctacgaagagagatagggtaagcatagcagggcgcattgtctcactatgtgtagtgacatagtacgtccccgtgtggagctcaatagcatacctaagcggcccttttcgccccacggggcttgtatcttggggtcctaggcaaccttgcagccaaccccgtcacttgacaatggcaactggacgatatggctacgtttggtcccgtgtttctcttggttgtgtcctccgcattctctctatcgtccatgacgctctcgtcattaccactagggtgtcgagcctccctcaccctggctggcacagggctggtctcagcccaggcgaacccattgtgtccctgccatcatacatcagtcggtcccatgtgagaaggagtgacatcaggcacgtttgtaagtgcaagatcgtttacttcaaggcgcaagtaggctgaacctgcttaccccactttggtcctgggagctccccttgtggaagagaatagtggagaggcttggcgtcagccggcgcggggggaaccggtgccccaccctgcagagtgctagctgagttaacctgccacaattacttccgaggtctgggataaaatca

SEQ ID NO: 483195 - DNA, 940 bp, Homo sapiens
  misc_feature (1)..(1): n is a, c, g, or t
  misc_feature (334)..(334): n is a, c, g, or t
  misc_feature (500)..(500): n is a, c, g, or t
  misc_feature (508)..(508): n is a, c, g, or t
  misc_feature (523)..(523): n is a, c, g, or t
  misc_feature (549)..(549): n is a, c, g, or t
  misc_feature (580)..(580): n is a, c, g, or t
  misc_feature (586)..(586): n is a, c, g, or t
  misc_feature (588)..(588): n is a, c, g, or t
  misc_feature (632)..(632): n is a, c, g, or t
naattcccgggatggggcttttgccagcggcgccgcgggcctgcgtgctggggcagcgggcacttcttcgacctcgtcctcctcgtcctgtgcggccggccgggtgaggccgggcccgcgtagggggcagtcggcggctgcctccggcggaggtgcctcgcggcgcccgggccggcccgcgcctcggcggcgtgctccatgcatccggagcccgccccgcccccgagccgcagcagtcccgagcttcccccaagcggcggcagcaccaccagcggcagccgccggagccgccgccgcagcggggacggggagcccccgggggccccgccaccgncgccgtccgccgtcacctacccggactggatcggccagagttactccgaggtgatgagcctcaacgagcactccatgcaggcgctgtcctggcgcaagctctacttgagccgcgcaaagcttaaaagcctccagaccggacctcggctctgctctccggcttcgcnatggtggnaatggtggaggtgangctggacgctgaccacggatacccanccggggctgctcatcgccttcagtgcctgancacagntnctggtggctggtgcaccggtttgcgctcatgatcagcacctgantccctgcccaaacaatcgaaggcgggtgagcaaacgatgcacaaatctcaacctcggtcaaaggagtcccccacatgagcgcattgcaccgccacatcgagctgggctggggacttactccaccggtaattggcaccgctggactatctaacctgacgtggtcgtgcacctgatggggcaaggtcttgccccatcaagacccagccaggcacgccaaggcccaccaaggaggcccccgacagaggcgcaccaaaccaaggaaggaccaacgggatcaccagagaccagcagaagcacacgagaaccac

SEQ ID NO: 483196 - DNA, 160 bp, Homo sapiens
gacatagagtaggaggtagtacttatcttcttgtactcaaaaaggtcaaagggagcccgacgaggaataaatagcaatgccctgaaattccaactagaccttctacagaaaagtgctcagactgccaagctggtcttcccagatcattacgtgaggctct

SEQ ID NO: 483197 - DNA, 881 bp, Homo sapiens
taaaaacccttcatcaataaatggaaactatacaaaaatagtcaacccacttctacaaaatgtcagtaatcaggcgggggtcttcaaacccaaagtgtatgttgggtatgttaacagggtgaacattatttacgttgtgggcggagtgaagcacaaaatagtatgaggaacagtttgagcccaataatgtgacggtgaagtctccggttggcaacccgtggtggcctaccaaaaaacagtggttgagcccgtagaagtgcccgcctgcggaaatgtggctgaaggagaaactcgaaagtactcgtgaggctgttgtatagcggagcggacttaaaaatacaagcaccccagtataaaaatgtgtgcatactgtgagcaaggtgctatggaaattacattgtgggatatcccgggagtggatattctcttatttatagaactatatgtgcggtgacgcctcagggtgtggattgtgatatactctccgtgaagtcgcgagataatatacggaaagtggtgtacacagagaaggtggagactctcataggagggcattaacgcggggaggatgatcgccgtgttgggggcgcccagtgagcccctcctaaaatgggggggggatagggcgcaaaggctgggagggggttagaaaagggcgtccaacaaaaaattcccgtgggaaggaaaaaaaaaacttccggagaggttactaaacagacgggataaccccgtattcgaaaggcccttttgggaccagtgtgcggtggtggtgggggcccaggaaatggcgggcaaacccgcggttaacttgggccccccactgggcataaggcgagaggcgtcgggcaaaaaaggccaaataaagacacaaaagcagcgaa

SEQ ID NO: 483198 - DNA, 350 bp, Homo sapiens
catacccattcttctaggttccctagagacacatcaccccaacgacagcacgaagcagccggatatcacaacaaccctattcctgctttgccatcacctctttctaattttttttcttttttaattaaaccaaaacaggggaatgttagcattctgtctaaactccaccacacagagagacaagcgaaaatggagaatcattaaaatatatattgagctcccacttcctgtagacaatccattatgtggaatacatattgaaattttgaaataaaattaaaatttttcccttttagaaaagttaaactaaattgaaaatgagaaagtctagaaatcaaaagggtcgacgc

SEQ ID NO: 483199 - DNA, 281 bp, Homo sapiens
aaacaattattacctaatgccatagtattgcaccggatctaaccccatataccttctgctatatgaattatacttgaaataactttgccaggagagccaacgctaagacccccgaaacctagacgagctaccttagaacagctaaaagagctctcccgtctattatgcagaatattgggaagatttataggtagaggcgacgaacctaccgagcctgtgtgtattgctggttgtcctacgatagaatcttagttcatctttctttttgccctttctggtgt

SEQ ID NO: 483200 - DNA, 455 bp, Homo sapiens
  misc_feature (10)..(10): n is a, c, g, or t
  misc_feature (14)..(14): n is a, c, g, or t
  misc_feature (38)..(38): n is a, c, g, or t
  misc_feature (90)..(90): n is a, c, g, or t
  misc_feature (92)..(93): n is a, c, g, or t
  misc_feature (97)..(98): n is a, c, g, or t
  misc_feature (193)..(193): n is a, c, g, or t
  misc_feature (234)..(234): n is a, c, g, or t
  misc_feature (416)..(417): n is a, c, g, or t
  misc_feature (447)..(447): n is a, c, g, or t
agatggcggngcgngcatacagcttttcgctgactacnttcagcccgtctggtaaacttgtccagattgaatatgctttggctgctgtantnnaggnnccccgtccgtgggaattaaagctgcaaatggtgtggtattagcaactgagaaaaaacagaaatccattctgtatgataagctgcttgtaaagctnagtagaaccaattaccaagcatataggtttggtgtacagtngcatgggcccgattacagagtgcttgtgcacagaagctcgaaaactagctcaacaatactatcttgtgtaccaagaacccattcctacagctcagctggtacagagagtagcttctgtgatgcaagaatatactcagtcaggttggtgttccgtccatttggaagtttccttacctaattgnnggttggaatgaagggaccgaccataattanttccagtc

SEQ ID NO: 483201 - DNA, 398 bp, Homo sapiens
ccgagtcgttggatctgtggataggtagtgagactgtggattgcctgaattcatggagggctggacagacgcctccgcgcagggagagcaggtgaactgggccacttgttcccacagctgcccatagtggcttcttccatcgtatccttgtacttcctggagctgaccgagctcttcacgaccgggcaaagtgggcttccagtgctatgaacggaatctctccatgcactacgtggagaccaaagaggagctcatcccgctgctgatgctgctcagcttggacttcgcgggccctgccgcctcggtggtgacctgcaccggggactgtgccagactgtgggcaccacggctgtggagccaacccacgacaactcggtgaacatcctccaaggtgccga

SEQ ID NO: 483202 - DNA, 287 bp, Homo sapiens
aaaaatttttttttcccccgggggcccaaaaggaaaaaggaattttggtttaaactgggggcccctggaaccccaggtttttaaagggatccctttcaaatttaaaaaatcccggggggaaaattttttttaaaggaaaaattttccaaaaaacccgaattttttaccctgttaaatttcagaaaaaagggggggtttttttttttaagtttttgattggggtttattcccgtaaatcccccccccgattttttggggggggggaaaaaaaagggggttttggccca

SEQ ID NO: 483203 - DNA, 381 bp, Homo sapiens
ctcatttcttgtctttggcatttatgttctgtatctgtgcaatacttgggttggccaggagatgttactaagggagttccttaaaggtctgttctgtgtcaaaagtgcagtttggttgtctcggtgtgtcatgagtgcacatgaagagacctagatgctgcattttttagctctgagattccttaggtatcctgaggcagctcgttcagatgatcagcattagggtaaaaccaagggccctccatggtgacattagaagggcagggttcaaggtggcgttggttgacgaccctagccattgccctctttgttcatgttttccaaagttgtaactttgatgctgattttcgtagcaggttctagtagctcctcgttccaggc

SEQ ID NO: 483204 - DNA, 302 bp, Homo sapiens
  misc_feature (142)..(142): n is a, c, g, or t
  misc_feature (155)..(155): n is a, c, g, or t
  misc_feature (242)..(242): n is a, c, g, or t
ctgggcttagaaggccgtcgaggggggaaatggcgtcctccggggagcgggcagcctgccctcagaccgcccgggacccagggccaccgtcctgccgagacagcggcattagccaccactcaccgtgcgggagtaaaaacgnctctctggttgcnacggccaccagccgtctccccccagcgtcagtttgaatttgtgcagaccattcctagcccagactcaacccaacagattcgtccttnccctgaggtgaagccttgtttgagaaccaaataataaaattaacaaacctaaaaaaaaaa

SEQ ID NO: 483205 - DNA, 725 bp, Homo sapiens
cggccgcgcgacatttttttatttatgacttcatgactaccattaagaaaatataacctgttgggaaactgtttctgccttgatgatgttgtacagacaagagataaacagtgaggaatatgcttagatgtatgggaaagacacgggtctgtggcatgtcacaagggtacacgaatactgagagtgaatgctgaaggaatgatccccattggtggtgaccctcaggtgagactagggtgcctgtgtttcagcaaagcctgggcaattggaatgcagggctcctaagattccatgacacccccaccttctaattctgttattgcaactgcagacggttacctggcacgctggccacaatctacctcactcttatcagagtctgagctactggcagtgctttcagctctgagttgaggcacctcgaaccttgtttttgtggtgaaggatcctaaagtgctgtggggagtgatcacatttttcacaacagtaagtccctgactccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttgtataaactctgaattattttcttgtgcttttttcttagaaacaaaatgagaactagaaaagaaaaaaaa

SEQ ID NO: 483206 - DNA, 1296 bp, Homo sapiens
gatcgctactgacaagacctccctggaacccttctgatcgtcttacatcactgtgtgtgtgcaatcacccacggaaagcctcacttatgtgtggaaccgtcagaggacaaaatgatccagatgggacacggttggggatgatctgtcagttcaagcatccgtgtccttcaatcaccgaaggatcagctcgccatctccagttttcaggaaaggctcatgacctggcgttgcgagggcaagccatctgctcttgtgcattgcacatgtgactcagaatccatctccagcaagtcgaattgagaccgggtgattcacccgcaatcccaagcccgaaaggcgtttggtgacagctgccaggatgtcttatgcaacgggatccttgctgtagggtgcttgggggtgcatgtccaaaggcatcttcatagatagggcaggacggaagctcgatcctcttaaccgcaaatttggggccttctgtgtacgggggggcaggcaacggacaagaatagaacatgctccagttccataatatttatgtaacaacaaaggcagtcgttgagagtcttcgtggagcgaattaaggactgctacaatacgagaaagagcgccaatattagacatctacggcttttgggcgtgctacgctcgccaaaataccgtcgtacttgagtgtccatcatcttggtggcatggctcaccggaagttgacaccttggttttagaaccgagcgaagggcataaagttcttagaaaacgaagataggcgcaattcttgggtctttgtacggcgcgcacgattagtaaaggacgcgtgctcgagaacgccactttatatagggacactacacctggggtgggaacacgtggttggggccccaggacgcaatttgccccagaggcccacggctcattcctaggttcaggaccactcttttaaggtgtcagtaaattataagccccaaagagatttccccaaggtagccccttataattccccaacataaacccccggagggggtcatttggcgaaaacacgggcaaagggggtaaatttctgggcgaaaattcaacctagcacaccgtccccggggattaatcggtttgggctcccaacagtgtaaaaaacatcctttgtgtcgcctttggaacacaggaagcggcaagggtccgtttacttttgaagcaaatggggattgaaggcgttggacggttttcagtggggccttttctattcaataggtaagcccacgggtcccattggtcccgctgggacccagttgcccaattggttggaat

SEQ ID NO: 483207 - DNA, 256 bp, Homo sapiens
tgtttagaggatgatcattagaatacaggatatttatactcttgaaaaccgctttcccaagtacttcttcattataagtaaggtgtctctaaaagggacagatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 483208 - DNA, 529 bp, Homo sapiens
cctggcgagttgatcagtaagtagaagcgccattaccaagtaagtttaaaacacacttcttgcatatttaacaatgttacaatgtaaagtatcccaatccccccagctaatttggggaactgagcaagaagagaacattcttcagtttttacatgactttttttgttttttgggagaatggggtcctgctcgtgtagcctaggctagagttgcagtggcttgatcagcctcacgtgcaaccttcaaactcctgtgggctcaagcaattttcccaccttcaacctccttagttgctgggactacgggttgttgtgccaccatccccagctacttttatattaaattttctttttagagacagagtcttccttttttgcccaggctggtcttgaactccgtgggctcaagcagtcttccgtgcctcggcctcccaaagtgctggaattacaggcttgagccaccacattcagccttaattgaagattttgtaaggaattgagctttcaattaaactcgtttttgtgagatg

SEQ ID NO: 483209 - DNA, 1147 bp, Homo sapiens
  misc_feature (141)..(141): n is a, c, g, or t
tccaaatggacttaaatttactcatcggaagcaacctaatgggaacaccttacaataaaaaaaatattccttggttcaggtgtcttttgtgggaaaaactgtgagcgtgggaacagaaagagggcatgtggggggtgtgcncccccaacctgtaactccctttctgtgaaacaaagaacgtctccacgaggtgttccctgtggacacctcgtggctctcaggaaaaaggggagaagactcttgtgcggtggttactgtgcgtcgcattgtagaatgatacgcctgtgtgcctatagcactctcatctctctctgtggcgcaagcatctcaggagacgcccccggcctgtgtgccgggctctctgtgcgctcatctcgcgcctatttctcttttgtgtgtggtgggcccccgtgacaacagcgaatgtgtctcatctacaatattgcgcacagatataagcgacagaaagagtgtggcgcggatctctcccagcgtgggtgtgtgctttataataaagtgctgcgtgcacgagctttctacacagaagtgcccagagtgggtgctctcccccatatatgtgtcccccgagtctctcccctgctcgtgtgtctccccccccgatagatgtattacccccggtgtctcttccccacctgtttataaacaccgcgcgagggtgctctctccccgggttctcttcgcgtggggtgtggtgtcgtgtggccccgcgagaggggagagggatacaagttaaacacggaatgtgtgtgtgcgctgtgggaccaccaaaaagatttctctgtgggaatctccaggggtaataccgaaaggaacagtgacacactctctataggggggcccccgtgtggcacaaaaagaagaccgcgtgtttatgtggggcccactgtggggtctcccaacaaacacgagactacagtgggccatgggcgaaaataaaaacgggtggtcagagggcctagtgggggcccaaaacagacacaattctctcggagaagggcccccaaaacaccccccgtgggacaaaccacacaagagttgaagggggtctccacagggggaagaacaacatcttggggagaaacaaacaacattgtgggcaacatgggaacacaacccagtgaggaag

SEQ ID NO: 483210 - DNA, 4989 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 483211 - DNA, 355 bp, Homo sapiens
  misc_feature (34)..(34): n is a, c, g, or t
  misc_feature (228)..(228): n is a, c, g, or t
  misc_feature (250)..(250): n is a, c, g, or t
  misc_feature (276)..(276): n is a, c, g, or t
gtgaaatgcaagaggcagtttaagatagctcttncacacagagttggaacattttcaacccagagtgtgacttccccgcagccctggcccaggccctctcacaaggaggaggccaggagcacgtgcaactgaacaagctgtgaagccagccgggcacagaacccccggggtggaaggctcccctgtgaaaatgcaagaggaaaggcgcaaagggaatcttcccaactntctacctggaagcatcctcatntgtggacatgaagcaaagaacagtgncttcccgtgcaggctctttttgggattacaccagaacatagggcatgctcaattaaatgggcagctatttgcaaaaaaa

SEQ ID NO: 483212 - DNA, 6356 bp, Homo sapiens
  misc_feature (56)..(56): n is a, c, g, or t
  misc_feature (459)..(459): n is a, c, g, or t
  misc_feature (2171)..(2171): n is a, c, g, or t
  misc_feature (3096)..(3096): n is a, c, g, or t
  misc_feature (3098)..(3098): n is a, c, g, or t
  misc_feature (3100)..(3100): n is a, c, g, or t
  misc_feature (3108)..(3108): n is a, c, g, or t
  misc_feature (3114)..(3114): n is a, c, g, or t
  misc_feature (3120)..(3120): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaacctgagcccnctctcagcacattggacccaggcagatgtaaaaaattcacagaactatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatagggatatttcacccttggttctgagatgcaaaccaaagaatatcatgaccagctttcaggcctcctgaagtatatctctcacattgtcctgttctcatgctgaggagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttcaaccaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctntntntgtgtgtntgtgtntgtgtntgtgtgtgtgtgtgtgtgtgtgtgtgtgtctgtgtgtctatctgtctttctctttcattcttttccatttggccctgttctgtcccaacatgaaggcaataatttgttacctcattaatggatctatccttttagtttcttaaccacttccctatgctacccatgaaacctagttggggctctgttgtgtgtgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 483213 - DNA, 6695 bp, Homo sapiens
  misc_feature (56)..(56): n is a, c, g, or t
  misc_feature (459)..(459): n is a, c, g, or t
  misc_feature (2171)..(2171): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaacctgagcccnctctcagcacattggacccaggcagatgtaaaaaattcacagaactatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatagggatatttcacccttggttctgagatgcaaaccaaagaatatcatgaccagctttcaggcctcctgaagtatatctctcacattgtcctgttctcatgctgaggagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttcaaccaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctgtgtgtgtgtgtctgtgtgtctatctgtctttctctttcattcttttccatttggccctgttctgtcccaacatgaaggcaataatttgttacctcattaatggatctatccttttagtttcttaaccacttccctatgctacccatgaaacctagttggggctctgttgtgtgtgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggactttcagcaattgtggatgcttaattctgtgttaacacctggaggcaacagattcagggaaaccagagtgtgtttgatgacatgttttcaacgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtcctttgactcccttaccagtatgtcacctggccaattcactaggtcactttctctctgtctctgtctctgtctctgtctctctctgtctttctctttcattgttttctacctggccctgttctatcccaacataaaggcaataatttattacctcattaatggatctgtcctttttcttttctaaacacttccttatgtgacttctgaaatctagtggggctctgtggtgtctgattttccctggctgcttctttagttttgtctccttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 483214 - DNA, 199 bp, Homo sapiens
gatgttcatgctgtgattgttcatgttgtgattgttcatgatgtgattgtcatgatgtgattgttcatgatgtgattgttcatgatgtgattgttgagcccattccaattggacaagctgctaaggactatttaaatttacatataatgccaactctgcttgtccaattgtagaagaaccttattaaaaaaaaaatcct

SEQ ID NO: 483215 - DNA, 4764 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 483216 - DNA, 4769 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 483217 - DNA, 5647 bp, Homo sapiens
  misc_feature (56)..(56): n is a, c, g, or t
  misc_feature (459)..(459): n is a, c, g, or t
  misc_feature (2387)..(2387): n is a, c, g, or t
  misc_feature (2389)..(2389): n is a, c, g, or t
  misc_feature (2391)..(2391): n is a, c, g, or t
  misc_feature (2399)..(2399): n is a, c, g, or t
  misc_feature (2405)..(2405): n is a, c, g, or t
  misc_feature (2411)..(2411): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttcaaccaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctntntntgtgtgtntgtgtntgtgtntgtgtgtgtgtgtgtgtgtgtgtgtgtgtctgtgtgtctatctgtctttctctttcattcttttccatttggccctgttctgtcccaacatgaaggcaataatttgttacctcattaatggatctatccttttagtttcttaaccacttccctatgctacccatgaaacctagttggggctctgttgtgtgtgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 483218 - DNA, 270 bp, Homo sapiens
gcctgttttttaaaaaaaaaaaaacccttgggttaggcccgcatataaatgtaataagttccccccgggatataacccaaccaatgtttgtccgggataagaattactaaattcccaaggccatttccttttaacttttgggttaagtttgggcctgaaattttaatgaagggccatcctgggggggcccccttttcttgccccggtaaacatattggaagggcccgggccataaacccccgggccctttttttccagtgataaagtcta

SEQ ID NO: 483219 - DNA, 5145 bp, Homo sapiens
  misc_feature (56)..(56): n is a, c, g, or t
  misc_feature (459)..(459): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggactttcagcaattgtggatgcttaattctgtgttaacacctggaggcaacagattcagggaaaccagagtgtgtttgatgacatgttttcaacgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtcctttgactcccttaccagtatgtcacctggccaattcactaggtcactttctctctgtctctgtctctgtctctgtctctctctgtctttctctttcattgttttctacctggccctgttctatcccaacataaaggcaataatttattacctcattaatggatctgtcctttttcttttctaaacacttccttatgtgacttctgaaatctagtggggctctgtggtgtctgattttccctggctgcttctttagttttgtctccttttccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 483220 - DNA, 6136 bp, Homo sapiens
  misc_feature (56)..(56): n is a, c, g, or t
  misc_feature (459)..(459): n is a, c, g, or t
  misc_feature (2171)..(2171): n is a, c, g, or t
  misc_feature (3096)..(3096): n is a, c, g, or t
  misc_feature (3098)..(3098): n is a, c, g, or t
  misc_feature (3100)..(3100): n is a, c, g, or t
  misc_feature (3108)..(3108): n is a, c, g, or t
  misc_feature (3114)..(3114): n is a, c, g, or t
  misc_feature (3120)..(3120): n is a, c, g, or t
agcttgcagagcagctcaagcaagctgaggagctcaggcaatataaagtcctggtncactccaggaacgagagctgacgcagtaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcncagtccccggccccacctcttctgccacaaacgtcagcatggtggtatcagccggccctttgtccagcgagaaggcagagatgaacattctagaaatcaatgagaaattgcgcccccagctggcagagaagaaacagcagttcagaaacctcaaagagaaatgttttctaactcaactggccggcttcctggccaaccagcagaacaaatacaaatatgaagagtgcaaagacctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagacatcggtgggatcaagtgaaaaaggaggaccaagaggcaacaggtcccaggctcagcagggagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgtagtctcagttggaagcctagacatgaaatgggtcagtgagcaaggctctattcctagtctccagccatgcctgtggcaacctgagcccnctctcagcacattggacccaggcagatgtaaaaaattcacagaactatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatagggatatttcacccttggttctgagatgcaaaccaaagaatatcatgaccagctttcaggcctcctgaagtatatctctcacattgtcctgttctcatgctgaggagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttcaaccaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctntntntgtgtgtntgtgtntgtgtntgtgtgtgtgtgtgtgtgtgtgtgtgtgtctgtgtgtctatctgtctttctctttcattcttttccatttggccctgttctgtcccaacatgaaggcaataatttgttacctcattaatggatctatccttttagtttcttaaccacttccctatgctacccatgaaacctagttggggctctgttgtgtgtgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacggcgtgctgatggaagtggaagagcctgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttactaagccgagagatgtcattcctgcaggcaggacctataggcacgtgaagatttgaatgaaactacagttccatttggaagcccagacataggatgggtcagtgggcatggctctattcctattctcaaaccatgccagtggcaacctgtgctcagtctgaagacaatggacccacgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcagtgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccatttatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatca

SEQ ID NO: 483221 - DNA, 1105 bp, Homo sapiens
gcctgctccccttgcgaagaactgtggcctcccgggaggagatgaggtgctttgccttgaaaccctgggacgccattgtgcgcgctccctgcaatgtggggtggtcctccggtgacttggaactgccccggctgggtggtgtcctgggccgtcctttccccgcttcttcccacctctggctggtccctgtttcctcctgcgcccagtgctggacctgtctcggctgccctgctgccctctcacctgccccacgcagtgatcccggcctggtcacctgggcagtgtgatgcttccctgactgccggctgggggacagccgaggcaacacacagggcttgaggccgcgccggaggccacacggcctggctgagttgctccatggtctcccagactctccacagtgcgacccaggaagggtaggcaatttacccagtgaggcacggtaccccaccccagagggggatggggcaacagccgacggcccaggaattggggacgagaagaccaaggaaaagcagagtgaaaatgggccttgaagcctcaccctgagcagttgggcgtggctgagcgcattgaaacagggtttggaaaatgcaatgttgttgcccagtcttgacttggcaaggaagcacaacggagagtatgcccacacctttgaatgatgttgcaacgcttggaatggccctttgagggatactcccccctaaaaggccagggaacattcaaagggcttgagtggggaatgaaacccgtattggcaagggagttgacatccagaaattagcagacaaacgaacggtcaacacaattcttgagtacttcacaacaagttcgggcggacacgcccgtgtggaatttaatatggaacacaagaggtgagagccaagatcatcgacctaccaaaaggcggtaacccatcggtggaaagaagagaagctatgtgagacactaaaagtgggtaggatatcacccccagaaccgaggaaacgcagtgagacagagagcacgaaatgggggggagtagaagtatcggaggttgaataacagcgacatagtaggcacaagatcgagagaaacccaagggagagaacgacaccgttgtgaa

SEQ ID NO: 483222 - DNA, 423 bp, Homo sapiens
atctgcccgccttggctcccaaaatgctgggattacaggtgtgagccaccgcgcctagccctctacttcagtttttaaatttatgtcttctaaattttagcaatgttacatcaagtttagcctaaagctgcctccttacatactttaagttcagcctccaggtttctctgtacatggtgaactataacctaaagggagttagactctagcctactcttgagccagttactgagttgtggtcaaaggtggacaactgttcaaactgtgttaaaataaggcagatgccaagctgtaaccaattcggctatttctgtacctcactttcgttttctgtatgtcactttcctttttcagtccataaatcttcctgcacgtggctgtgctaggagtctctgggcctactctggctcagaaggctgccga

SEQ ID NO: 483223 - DNA, 150 bp, Homo sapiens
ctcgtggaaggcccgggaccccgggaattgggtgtcgggcgtgacaacggcctaaggctccctgttctcttcctaaggtaaacattgggctttaaaaaccccagccgttggaaattcccttaacgggaccccccgttaattccccaacgg

SEQ ID NO: 483224 - DNA, 635 bp, Homo sapiens
  misc_feature (332)..(333): n is a, c, g, or t
ttgttgatccagcagctgtgcagatgtcgtgttcgtggttctctggtgtatatggatagggtcttctggccccccatagatataagggactggcctgcggttctccactgattgggtatgtagttgatctcattgactggaggtgcaagggcggacagaagcatgtggcgcagacccggtgggctgacctgaagagtgccctagtcttcattactttcacttatgggttttcaccagtgctgaagacccttacagagtctgtcagcactgacaccatctatgccatgtcagtcttcatgctgttaggccatctcatcttttttgactatggnntgccaatgctttgcccaaattggtgggtaaatttccccaaggaacaaaacaacctttaaattcccctttttgggaaaaaaccaaatttttgggggggcacccccaaaaaaaaaatattatatcacgagagaagaattatataatagtaggtaatataagaatagtggggggggggaggagaaacaccacagagaagaagtagaatataaaaaagataataattaaaagaaaaaaaaaagagataagtaattatagagagagaggagaggagatattataaaaaagaagtatatagtaaagat

SEQ ID NO: 483225 - DNA, 1052 bp, Homo sapiens
  misc_feature (849)..(849): n is a, c, g, or t
tccccggaacgggtgcgcccgcggggaagaggacccccccccccccccctgggggaccccacgcccccgccacccttgccgggtgaaagaagggatgaaaagtggggaaattcttgcgtttaaatccctcctgcctgcctttggccccatgcaatgggactgattccctgggtttccggccacagccttgtcctgatccaaaccctaaatccagggcgtaacccccggctatctgttgcccagtggtcaatcataccgccaatagggtgtcttcctgcttcctggtgggcttttttgggctgcttccggggcccgcaaggagaactattgtctgtgaagatccacctttgcccatactttccgtctcttgatacatagtttggtggaggtggccccccagacccaatgctggctaattttgtttaagaagaataaaggtgaattttcacagaagtttataatataaccaactttcccggcacccacagaatggaagaatttatccccgaaaacacacccaccacctgcttccaatcctctgacgcacaggattccacaggcacgattttataagtggctctgttgggggctcggctcaaactaacaccacagaatttgggaagagaaataccctcttccacatgttcgagaagagaccccgaggttcccccgaactctcctctgctcgccacttgaataggttaactgtgtggcctgttgggagattaaatttcacacacgacagaaaggcggaatccacataaaggaagggcctgttgttgtgaagaaagaattgtggggctgtgctgaaggagaaaaatgttgctggtggtaagctgcaccgcacgnccctctggaattgctctttgtccaaggttttgggaaattgttctttgcctcgctgccttcgtgaaagaagtaatcacagaaagtggctaacgaaggtgaatttaaggggttctggttctcctcaagcctcctcaatctgggggagatggaatagatatcctcccggtttttccaattaaacggactacttttttcagacccga

SEQ ID NO: 483226 - DNA, 742 bp, Homo sapiens
  misc_feature (505)..(505): n is a, c, g, or t
ccgtgagggtggtcgcgtctttccgcccctcgttcgatgttgttccccgccgtatgcgcggccgctttggggtgtggtttaggcccccccacccggcggggcccgccctaattttgtcgggtcgctatcggtcggcgtgtgcccgccccccttaagggcgggaagaatttaacgccgcgtggctttgccgctggcgcagcaccccccttgctcaacgattcccgcgtgtctcttacgtcatcgcactgggtagtagaagtaagtgtgctcctcgagtttgattggcacgcgcgcgcgctcttcgggtcgtcctgcaaggttgtagtcagtctccctgcgctctccttggccccgctcgacttatgggttcctccccgccgcctgttcactcgctgcaggtacgcactgcgtgttccccccacccttctagttcgcgcgcgctcgccccccgtcctctctcccctcttggggcgccctgtctgcctcctcctttacccgcgtgcgnctttgttcgcccccctaatgtggcgcctcatcctctcttaatgattcctccccatgatccacatatctcgctcttgtctactctccccgccctcatttatgccgcctcccttctcaccccgctctctataaacacctctctctcatgtttaactcaccctcgcgctctggaattgattcctcccactctcatctcctccctctgctctctccccccaacaaataaccaaaaacaaca

SEQ ID NO: 483227 - DNA, 148 bp, Homo sapiens
cagtttgaagcatcccaaaccagccatgtacaaccagctgtgctataagaaagagggagggcctgaccataactacaccaaggagaagatcaatgatcgtagatgggaatctgcctcctgtctggggatgatgctgagtgggatgacc

SEQ ID NO: 483228 - DNA, 747 bp, Homo sapiens
tgcggtagctcatgcctgtaatcccagcacttgggaggctgaggcaggaggatcacgaggtcaagagatcgagaccatccaggccaacctggagaaaccctgtctctactaaaaatacaaaaattagctgggcgtcgtggtgggcgcctgtagtcccagctacttgggacgctgaggcaggagaattgcttgaacccgggaggcagaggttgcagtgagccgagatcatgcccccgcactccagcctggcaacagagcgagactgcgtctcaaaaaaaaaaaaaaggtaaaccaaaggggtaaaaaatgaggaggaaggagggcagaaatattggcaagggagaagggatacagggcaaaatacaggatgggcaatcaacaggtggtacaggcacaatcatattggcaggttcaaaaatgggcaattacatattaacttagaaccaacaggaaaaagagatgagttatgcctgccggtgtgaaccatgtggtgactttgtgtcacaagcccaagagaataggtcaaacggggggaattgggaaaacttttgttaaacgcaaggcaattcatggggagggttattagaaggatgtgccggacattagggggatgtggagatgtggaattcccaaaagtatatgggaatagcatacgatttataaaaatatattgggatattggatttatatacactttataaaccttttaaatggcaccaaaaaagggttagggggtatataaattag

SEQ ID NO: 483229 - DNA, 1638 bp, Homo sapiens
taaaacatatcccttcattgccataatggctgccattttgccatagcatttccatataactgaaaaactgaacttgctcaccttctatcctttagctatcactgatgactctggaacacaaccctgctgcaacgcttgcttaacggcacctcctcactcttgcccgtcctctttctctaagctgaactacaggcacacgctattagcttgttccttaacttctctctcttcccccagctaaacactactggcactcctctctctaacgcaaccgaactcttgcacgcacagccaaaaccacactctaacactgctccactgctccaacggcgcgggctaccccagcactctcccactctccgctttctccaacctaacttgccccaccaaactaacccgcaagcgggcactctaactcgccttgccccaccagcgcgccgcgggccacacctcctcttctactctcctgctcccttaaccctctccccctaaccccccccgtattccccccttgccttcccctagcccccgttccttttctacacccctccaagcctctacagcgcctttggcttcccctcgcgccccgccgcgcaccccctgcgccaccccccacgcacacccccccacagacgccacaacacccccctgcaagcctgcgccaccaccggccccccactccccccctgcggccaccctcgcccacgcacaaccacacccactccccccacacacgcgcccccaaccaacctctcccccccaccccacacacttcactccccctcccacaaccctcaacgccccaatatccccgtctctcccccaacctctggcaactctctcgcacacgcgccgccgccaaccaccttctcacaccctcaacttctcactcatcactcccttccctcctgctacaactttccccaaacacacccgtgcggcacctacattctacgacccacaaccgtttttcacccccccccgtttctaactcttaacagcttttctaacacccaacccttctccctggccctgccactgcctgccgcctctcaagccttcccaccacctctacaaaccacccgcccacctctgccgcggaacccttccggtccaacacaccgcccactctcaaccaccaaccaaccgcctccccaccgcccacaacagcctacgggcccccaacacaacacgtcccctctgggggccccctataaaccgacgccccacacaaacctctgtccctggccatccccccacccacgggcgactaatcccctgtggcagacccctcgcgccgccccgccctcaacacccccccaacaccccccccacacggcacagcgtccccaccccacacccccgtccaccccctgcccgccccaccaccgctgccaacccccacccccgcacggcgcccccgccgcccccccccccgcccccccacccccctgcccccacccccccccccccccacccccccccccgcccccccccgcctcccgcgccaccccccaccccccccccccccccccaccccaccccccacccccccccccccccccccgccccccccccccccccaccccccacaccgccccccccccccccccccccccccccccccccacccccccc

SEQ ID NO: 483230 - DNA, 206 bp, Homo sapiens
gttttggtcccgtttcccccccatggggaggaacagttggcattgagtagcagctgcccccatagtttggggcccacattcttttgtcccacctccctgccattgctttttgcctttccccagattgtttcagccgttaacctaacctggcccctgtgggcatttgagtttgcgacccctgtgttaaaccaataaacatgcaaata

SEQ ID NO: 483231 - DNA, 434 bp, Homo sapiens
catgtatattaactcaacaaatatagacttattagcctcctcttaacaatacaagccttctaatacttaattaccctctcacaatagtatatgttaaattattgaacaatagtagaatttagatattgttgccattattttggatagtgtttagatttacagcaaacatgcaaacaattttctttgttcaccattacttctcgcattttggatcttccttctggaagatggtaattttctcttaacattttgaagatacgctgcagtatcatttggcttctattgttactattgaaaggtcagctgtcagccaaattatcttttctttgaagattagtgtcttttcttttcttttttttttttttttttgagatggagtcttgctctgttgcctaggctggagtgcagtggcgcaatctcagctcactgcaacc

SEQ ID NO: 483232 - DNA, 125 bp, Homo sapiens
  misc_feature (58)..(58): n is a, c, g, or t
  misc_feature (106)..(106): n is a, c, g, or t
cgggcgggctgaagcgccagcagagtggtttatctcagcagggccacccaggacaggngtctgtgtggaggggcaggctgaagcgccagcagagtggtttagctcnagcaggccaccaggactga

SEQ ID NO: 483233 - DNA, 120 bp, Homo sapiens
cacggtggatgatcagcaagaaatgttatgaaatggcctcccaccttcggcgttcctgtactgacctcgtcttgtcccttccccttcaccgctccccacatgctttgcagccctttcctc

SEQ ID NO: 483234 - DNA, 284 bp, Homo sapiens
gaaatcaatccactcataccactcgaacattgacttaccccagtatccctcgattcctggacggcgatctgatcctgaagccccttcaagccccctcaccgtggacaccaccaatcccacctgtcacacccccctggcacctggactccaccctctccccctccctcgctccacggagagggggagaagcctcggcaataaagaggcccatcccatggggaccacgccgtccacatcccgaccgatatcggacctgcgaccctcactggacccaaacccacatc

SEQ ID NO: 483235 - DNA, 312 bp, Homo sapiens
gatctaaatacaatacaataacaataacaccgacatcaatattaaccatgtctatttgaaaacatattctttaaattgactgggacttcattatctcatttacataactatataataatatgtaacataaatttcattttactttgattcttacagatctgttgtaagtcagtttcatacgactttcagttcatcagtcttcttgtgtctgtagtaataacctggccttcccagttctgaggggctttctaatacagagctccactgttttttatgacagtaccacagtatcttcctccttaagcggatcag

SEQ ID NO: 483236 - DNA, 212 bp, Homo sapiens
aggaataaggataacgatacctagagacggtgtttttaaagaaaggacctaaaacatagtatgtgttgaataaaaggtagccttctggctgggtgcagaggctcacgcctgtaatcccagcactttgggaggccgaggcaggcggatcacgaggtcaggagatcgagaccatcctggctaacacggtgaaaccccgtctctactaaaaatac

SEQ ID NO: 483237 - DNA, 107 bp, Homo sapiens
  misc_feature (47)..(47): n is a, c, g, or t
  misc_feature (71)..(71): n is a, c, g, or t
  misc_feature (80)..(80): n is a, c, g, or t
gagagagcgagaactactctcaagtttttatgtttcttttttttttnaacttcagctttaaaacacttggnttcattttnattgtgtagtaaccatttaaaaattct

SEQ ID NO: 483238 - DNA, 737 bp, Homo sapiens
cttatgaagtctttccgtataacatcttagtttcgctattagtgataatcccagcattgctcagtcatgctcagccccttgtcctgacataggtctccgtttttactttcaagtattgcataataatctctcagtcatgtagcttctgcttcgctccctattactacttatctcaggatgctaattactgttgatgtaccttaatggatttcttataccgtatctgcgcggatgaagctgtgagtatactgatagaccgaagagaagaaggtgaatgagactgcgtgtcatgctctacttagtgtgggagagtgcctgagcaacatccttaagtattttctgctgatacgcgtacttgatctgtatccaagactatgatggttgaggttgtatgtgcccgactcttgtgttcggtaggctctaagcacaatgggggtgggcaacgtagacatgcaagagctgaagccctgcttgaaaagacccttcaaggaagtaaaatggcaggggcagagtgcagcttaacatgttgctatccctgttggttttagagttggtttttggaatggattcaagttcttacacaatttatttgtgaatacaagcataatctaggtgatttgagttaatgaacttcttttcatgatgtagggaaagttgaatgtatatatttctaagaagaatttgtttagcagattacaaagttgggcaaaaatagactgttcaccagaaactaggca

SEQ ID NO: 483239 - DNA, 360 bp, Homo sapiens
tgagacagggtcttgctctgtcacccaggctggagtgcagtggtgtaatcttggctcactgcaacctccacctcccagggtcaagcgatcttcccactacagcctcctgagcagctgggactacagacacatgttaccacacctgggctaatttttgtattttttgtagagacaagatttcaccatgttgcccaggctggtctcaaactcctgggtctcaagagatctgcctgccttggcctcccaaagtgctgggattacaggcatgtgccaccgtgcccagctagtttctattagtttttgaaaattctgtgtatttttgtgggtttcccagtctgttattttggcatatgtatgttt

SEQ ID NO: 483240 - DNA, 155 bp, Homo sapiens
tagtcaacagggtgaatgatggttgggacgagagttgcctgtcttcagccagtgcctgtctcatatgtgggcgggacctctgagacagcctggcagcgagggtatgtactacacacactgcttggcctgcaccacgggctacgggacgaggaccg

SEQ ID NO: 483241 - DNA, 308 bp, Homo sapiens
gcagcgcagcaccatcaatggtgttaggttcattgaggtgagatggcaccagtgcattccagcctggcgacatagcaagactccatctcaaaaaaaaaatggtgctataataggataactccattgggccaagtagcaggtgtcccaaaaatatgatttaactttcatttggcagtgtctagaacagagaacgatgtaagtgtgagtggcatgtccagtgtccagcgtcagtcatggcccggccctgaaatacagctgctgccagccaggactctaaccaagtgggcagagttgggcaaggcagcttt

SEQ ID NO: 483242 - DNA, 131 bp, Homo sapiens
acagaacacttggctttgcaaagtggcacgcctggagagaacttggaagctccacgccccttctatacctcaccctatgcatctcttcagttgtatcttttgtgatatcctttataataaaccagtaaacg

SEQ ID NO: 483243 - DNA, 1250 bp, Homo sapiens
gcatgacatttctttgtgctatggcttacttgttaaagagaagaaaaaaaaactaatccaacctgttagattttgcaggtgaagtcagcagcttaaaaatgtcttacccagatttcaatggatttttattccccctacctcccaaaatctggagactggtgtaaaacatttgttcttctatgaacactggcctcagacctgcttacgacatgccataggagtgtgttgtgcacatctctctcatcttccagcaggaggagcccgtgagcacgcacagttgcccgtgtctgggtcacccgaaggcaccgggctcaccttggacctcccaggcaaagggagaaaagcctcagaaactgcatcatgggattcagaaaggaactattctctaagaagtccagacattttaccatttccacaattctcctatatccagaattgagttcggaccaagtgtatagttgggacagaactaagaattctaatctctgacagcgaaacccttactagggccttctaaaacatacagagtatcctatgtgtggcttcaaatattggaacattcatgtaacaagatcaagctataaccttcagctagctactctagaacagctaacggtgccgcacttcgcggcctactttcaatgattccagcaatcctcatctaaataggtgtagcatgttgctttgcacaactattttataacccaaggcaattccacggaactttagttgactaccaaggttctctactccgcccaatgtgtgccgtgaaggtcttcaaggcgggatcctgtttgcctctaaccttcttccctcctgataaactcatagaagtagcaaccatctctgtgatctcacatcgcattgtgctataccactaagcatgctgcgactataattcgatcatagttgcctgtcttgaccatctaatttatatataaacccgcacatattacatccttaaccttctatcatcgacactcgacaagaacgagcggcgaccacgcaacaacggcgaccaacccagcccgcggccgcccaaagccacccaagcagaaagcgctaaccgatcccaagcaacacctgcttgctaaccaaccgcgccccacggcgccgacacatcgcacgcctcggagcacgcacacgactaccgcccgaccccataccaccctgccgcggccttaccccaaacctcctttgaacaactcacaagacacccccctcgctcgtactaactcctcccgactcac

SEQ ID NO: 483244 - DNA, 108 bp, Homo sapiens
tgtgctcccaaaactctctcccatggatcagactcttggaggggattcacactccttgaagtaggcctggagattaacaatcatcttgacaaatcttgtcgacgcggc

SEQ ID NO: 483245 - DNA, 307 bp, Homo sapiens
  misc_feature (209)..(209): n is a, c, g, or t
gggcgtggtctcagctcattgccaacctcgcctcctaggttgaagcaattctcctgcctcagcctcctgagtagccaggactacaggcacgtgcaccacacccagtgtaatttttgtatttttagtggagacggggtttcaccatgttggtcaggctggtcttgaactcctgacctcaggtgatccacctgcgtcaacctccgtaaatnctgggattacaggcatgagccactgttcctggccagttttccagaattctaagttttgcttaaaagctgaaattttatcattgcaacacggtctctca

SEQ ID NO: 483246 - DNA, 253 bp, Homo sapiens
actccgaggtccttttagtctcagagcgatgggaagatcctggcagaagcagatagactgagcacaaaacactggctgatcgggacagacaagtgtgtggagaggatcaatgagatagtgaacagggcccaacggaaagcaggagtggatcctctggtaccgattcgaaactatgggcctatctcataaaacggaggggaccaggaggacacgaaggaggatcctgatcgaggagctataaggggaccgattt

SEQ ID NO: 483247 - DNA, 303 bp, Homo sapiens
agatcgatcgagccggtaccgctcacacatgcacaggtgggagtctttagtatatagttgtaaatagtgtctggttatgtaaaaatgaaattttttagacacagtaattgaacgtgtattcctggtttgtatatttaataaatttcgtgttttcattccttaaaaccaaaaaaaaaaaaaaaaaaaaaaaaaaaaaaaaaaaacaacacaaaaaccaacaacacaccaaaacacaaaacacacaacaccctcccacacaccaacctttcaaaaagagcgagcgacgcggggggatgagtctca

SEQ ID NO: 483248 - DNA, 234 bp, Homo sapiens
gagtcggtaccgtgataggttcaactgaagcccaaacctcaggactgtgcaatatccatgtaacaaacctgcacatggaccctctgaatctaaaattcaaaaaaaaaaaaaattttaaaaattcacctttaaaacaaacaagaaacctaaaacgggcaatgaacttttattgcatggtaagggaatgggaaagaacggggggcgtaaaggatggatgttttctcctagtgccgg

SEQ ID NO: 483249 - DNA, 440 bp, Homo sapiens
aattccagttggccacaagcagctcccaagtcaatttctctggttcactgtccattagttgacccagctagaaccccacccctggctcctgacgcctctcctgctggactcttcagcatgttggatgaaggccattagtgctgaactcaccatactcttccaagatttgcctgctcctccccatcaccccagagcaagccttggctcctctcccttcctaaaaaatccccaccatgttgtccgttctcctgggtcctaatatccccaaaaaaaaaacacactatccaattgtattccaaaacaaaaaaacattccaccattaaatttgctcttattaagtctattatcctgattcatcctctttggtattaaagtcaataaatcgtataaatcttgaaactttttaactcagaaaaataaattctgtaaaaacaatcaaa

SEQ ID NO: 483250 - DNA, 421 bp, Homo sapiens
ggttgagctgtgcttgactccagcctgggtgacagagtgagaacccgtctcaaaaaaaaaaaagactgagttgattattagtccaagcaggtgaattaagtcacctctatgtcccatgttggctgccacttggaatccccaggtcctcagcaggccaggaacggtgtgtcaccggagtgcccctgagctctgtgctgcaagggggccatcgaccacccttggtgccgttgctggaatcccttctcacgtctccctggagccagcactttattaagcgctccagcagcttccctggccactcctggttctggatataagtcgcgtttcccagggcagcgaaagtttctcccctgaaatccaagagttcctcggacaccagaggccccaacagttccatgtccttgcctggacagacgagtcc

SEQ ID NO: 483251 - DNA, 325 bp, Homo sapiens
gtactctagaggatctcctccacactagtccaaagaaaatttaaaaattagccgggcatggtgatgtgtgtctgtatccagcacttcaggaggccaaggtgggaggactgcttgagcttagaagttcaagacagcctgagcaacatagggagggcctgtctgtacaaaaaaccaaaaaattagctgggttgtggtgatacatgcctgtggtcccagctacttgagaggctgaggcggaaggatcacttgagcccgggaggtcgaggctgctgtgaaccatgatcatgccactgcactccagcctgggcagcagagcaagaccctc

SEQ ID NO: 483252 - DNA, 178 bp, Homo sapiens
actgactcagcatagcatggtctcagtcttcagcagaaccacctccaggaggaaccacttctctatgagtacctgagagcctctctggtactcctgagtcctcaacctatgtgctatctatgcctggtcaccatcagctactttcgatatatgacctagcgacccgggctagtgtggt

SEQ ID NO: 483253 - DNA, 718 bp, Homo sapiens
cattccttaagtcctaatgggaaaaaaaaaaaaaaaaaatgaattatttgaaaaacccgggggtgtaaacaattgattgtacccctacacactattcaataagtagtaaaaggagcttcacacaaattcagtctaatctgcccttcctgtggtgggccattaattattaaacattaaatgtgctgtgttactgataaaaagctcatttttcttcaaagaagacttacagcttagctgcacattgggtgttaaagcagcttctaaattggttagaactttggtgtttgaacctttgtaaatattatctaatttatggaaaaagttggatttaaaattatattattttaatcattagaaatcagggtttggggcggtgtattggactaattgggtcgactcaatgaaaaatgttgtccacacctttaattctaagggggggccaattatttgggacaactacaagaggggaaaacacaagatggccttcccatgtggcaaaattcttaaagctcctttccagggtcggggaaaattaccctgggttcataacaccttttggccctgcaattaacggttattcccacgctcaggaggaactctcatatcccttttggatcagacacagttccattatattccttgaactccaatattcttacagaatctctcacataacggtatcactcgcaattcgctatcactctacccataagacaag

SEQ ID NO: 483254 - DNA, 337 bp, Homo sapiens
cccccccccttttcccccccttttgggggggggggggggaaaaaaccccctggccccggggttttttttttccgggggggtttttttcccccccccccccccccccgggggccaggggggggcccccccccccaaaaattttttttttaaaaaaaattttcccccccccaaatttttttttggggggggggtttttttccgttaaatttgggtttttgaaaccgcaaaatttcttttttttttcgaattttttttttttttttaaaatggggtccctctttttttatacgtccccccccgtggggggtttttggaaaaaaaatttgtttgcttttta

SEQ ID NO: 483255 - DNA, 319 bp, Homo sapiens
cgtcgacgtcggcatcagcaccagggcgtcgccaccattggccacgcgctcaataatggcaccctggcgaccacggaagctgttgaaaccgaagaatgtctttgaggacgcgttgagcctgttcgagcataaccactccaaaaatcatcgaaacgcttgttcaaaggctggctgaagattcaccgttttcacgaaaaaaaccgtaagcaggcatttcccagcggccccgagggtcagcagcgcatcacaaaacgcggcagtatacccgagcgtccgacggcaatgggcggtgccggtcggttaagggaattcagtcgac

SEQ ID NO: 483256 - DNA, 359 bp, Homo sapiens
  misc_feature (10)..(10): n is a, c, g, or t
  misc_feature (57)..(57): n is a, c, g, or t
  misc_feature (133)..(133): n is a, c, g, or t
  misc_feature (140)..(140): n is a, c, g, or t
  misc_feature (144)..(144): n is a, c, g, or t
  misc_feature (187)..(187): n is a, c, g, or t
  misc_feature (267)..(267): n is a, c, g, or t
  misc_feature (271)..(271): n is a, c, g, or t
actcaccgcnaataaggattgttgacgatatctgccaccttaacccacccagcacgntggcacgcctgcttcatacagtttttgtggcacctgcactttttcatcgacgccatagcccatatgcacgacctgnaaaccgntgtnataaacgccagaacgcggcgcattgataccaataaagcgcccntctttgctttctgcggcatcgagaatgcgttgactgtcggttaacaggccaccaaatgtaatgacccgaccgacctgtancctntcacgcacgatacgaccaattttgattgcgtcgtcaaaagagatcacagagagattggcggtaatgttatagacctggcctaaatccg

SEQ ID NO: 483257 - DNA, 654 bp, Homo sapiens
  misc_feature (4)..(4): n is a, c, g, or t
  misc_feature (86)..(86): n is a, c, g, or t
  misc_feature (114)..(114): n is a, c, g, or t
  misc_feature (193)..(193): n is a, c, g, or t
  misc_feature (195)..(195): n is a, c, g, or t
  misc_feature (243)..(243): n is a, c, g, or t
  misc_feature (245)..(245): n is a, c, g, or t
  misc_feature (249)..(249): n is a, c, g, or t
  misc_feature (278)..(278): n is a, c, g, or t
  misc_feature (280)..(280): n is a, c, g, or t
  misc_feature (283)..(283): n is a, c, g, or t
  misc_feature (288)..(289): n is a, c, g, or t
  misc_feature (318)..(318): n is a, c, g, or t
  misc_feature (343)..(344): n is a, c, g, or t
  misc_feature (355)..(355): n is a, c, g, or t
  misc_feature (358)..(358): n is a, c, g, or t
  misc_feature (364)..(364): n is a, c, g, or t
  misc_feature (371)..(371): n is a, c, g, or t
  misc_feature (376)..(376): n is a, c, g, or t
  misc_feature (439)..(439): n is a, c, g, or t
  misc_feature (467)..(467): n is a, c, g, or t
  misc_feature (494)..(495): n is a, c, g, or t
  misc_feature (652)..(652): n is a, c, g, or t
gagnccccaagaatccttttggttttactggatgtcagggattacagtcagcaaaccccactcatttacagggtcaggtgatacanaggctgagctggagggttagggtcaggncccctcaggaaactctggtctggcacagcagcagcagggatgccactctccctttgtggaatccttcttaatacaagantnagaagcagaagagcaaaccacaaaggaatatccagctcaccccccaancncccncgcagacctgcaaacccccatggagatangncangccgnncgggaacacagtgactgactctgacacanagcaaagcacctctccaagcgaaannaaaaaaaaaanaanaataanttaatantttgnatcagcaagatgagcaggcaccaccatggaaagaacacctggagtgtagctggataaaaaaantcagcaacattccccagaaaaggaggtnagcactccatggcccaggaaaacatgnnggatgaagggttggaacctgcagtgaccagatggagatacaatgcaggcagctgctaccatgcttggtgaccagggtacaagcccctgatgagcttgccatggcagccaaggacactggtgccggaggaacgacaggggcctgcaaagggacatccntt

SEQ ID NO: 483258 - DNA, 241 bp, Homo sapiens
tgcggtgatctagaggacccggctcattcagttcatggtatattgcaggtgaaaaaagcagatcgtattctaagaaacagacacaacacatggtgaatatctagtttttcttctagtagtcagtttcttgaaccagtgatttctgatacatggcctaagcctgtgacatcatcagttcaagcaatggggtcttctagtgtgaaagccacacactaggtgggaaacaggcacctggaacgaa

SEQ ID NO: 483259 - DNA, 444 bp, Homo sapiens
  misc_feature (372)..(372): n is a, c, g, or t
  misc_feature (374)..(375): n is a, c, g, or t
  misc_feature (380)..(380): n is a, c, g, or t
acctgtctcctggtgagtgagtgaattgagatcaggtatggagggacttggctcctggtgagtgagttaattgagactctgtgtggagggacctggctcctggtgagtgagttaattgagatgaggtatggagggacctggctcctggtgagtgagttaattgagatgaggtgtggagggacctggctcctggtgagtgagtgaattgagatgaggtatggagggacctggctcctggtgagtgagtgaattgagatcaggtatggagggacttggctcctggtgagtgagttaattgagatgaggtgtggagggacctggctcctggtgagtgagtgaattgagatcaggtatggagggacctggctcctngnngtganttaattgagatgatgtatggagggaccaggaggcggaggctgcagtgaaccatgatggagctgc

SEQ ID NO: 483260 - DNA, 268 bp, Homo sapiens
tattactttatgaacattatcacagtatacctgcaaattaacaccttttcactttgtgcttttgttatgtattttgcttctatatatgccataagcttctcaatgaaatgtgtttttttattttaaattgtcaattatcatttaagagagagagagagcgagtgtgtgtgtgtgtgtgtgtgtgtgtgcatgtgcatgtgattttaataaggccttcatatttacttgcatatgtatttacttgttctggtgttcttcattccttctc

SEQ ID NO: 483261 - DNA, 1159 bp, Homo sapiens
gatcaatagacccaccatgccccaggctcaacggctgtgctgatggaaggtggaagagcctgaagtcttgcagcgactcactggatggatgttgattctactccgtcaatgtactttgaactacctgactcattccgagctactacagaagtgtgttttactcattatgaggaacagcacatcgaggcttcgccctttacgtggacaataggttttcttactttgacggtgacgaggtctccacctgggtgttccagcatggaagtgcatattcccagcaataaggcaggcgcctgtagctaagccgagagatgtcagttcctgcatggcaggtacctataggcacgtgaagatttgaatgaaactacagttccactttggaagcccagacataggatgggtcagtgggcatggctctattcctattctcaaaccatgccagatggcgacctgttagtctacaggtctgaaggacaatggtaccgcacggttaggtgtgacacgttcacataactgtgcagtgacatgccgggagtgatcagtcgagacatgtgaatttgaaccaggtatctctgggtagctacaaaattcctcagggatggcagtttagcagacatgtctctgagcttctatacctgctcaaggtcattgtcatcttgtgtgtagagctcatccaaaggtgttacccatggttatcaatgaacctaagctcattcgtaacgggtctacagtgacggcatgtataagctgatccatctgtaacacaggagggatcctgggtgaggattgaattaagaaacaacaatggtgttgacaatagtagacccggatagagtaccttgggtaaaagaagcacaaggctgaggcctcaagtgggagctagacattagggaagacaacaggatgagtggacacaacgacaggggaaaggctaagaccgcaaccccacaatcaaccgggtgagaaaaagagacacgaaaacaagtagagaaacacaagttaccagagacctgccggcgaaaatggacaaacgaggcgtgacaaagcagagaagacaaacagggaaaacagaaccagaaagagacacaaaaaaacacctaccgcaccacacaacgaagaagagcgataacaagctgatcaagaacacagcagagggagg

SEQ ID NO: 483262 - DNA, 821 bp, Homo sapiens
ccagggagtttaatagttggagggaaacacaaattgtggggtggttccagcagccacacataaatctaggagaaggccaccaacactgaggggggccacatatacacgcaggcggataaaaaatatatttttgtggcgtggagatacagatctgttctcagaccccctctgggagaaaatatctttgcgggggttgttctctgctccaaacaaatagtgggggcgcccaaccacccgcgaatgaccacagagagaggaggtggagtagtgttctctccacacatggtgtgccccccagcggcgaaaaaattttgtgtgctatattatagcaaggaactattgtatggagacaccgcacactgtggggtgttggaaagacacacgcatatatatagagatgtgtaaaatgtttctcccacagatgatagttttatgtacaaacagtttataaagtggggttctttttggggtgctccaccgcgcgcccttatagatagtgtggttgctttttggagaagggggagtaacacaagataataagtgtgtacgaaaacacagtgattctctgagagtgagctctcttgtggaataaaattccctcgggggataattttttagtcacgaaaagccgaagtatattccaaaatcacttttgacgccacggtagaagggtgcccccccctgccttttgtatgtcacaaacttggggggaaaacccattgttttggggggacaaaaaaggtttttggggtgttccccccaaacaaacgggggtttgtgaaaaattttttttaatttttgtgaaggggatttttttttta

SEQ ID NO: 483263 - DNA, 151 bp, Homo sapiens
acatcagcgtaaaacctaagtatactaagaaacacggtaaccaatacgaagcattacagatagtatagtagatatataaagtaaccgcaaatacagagtactggatataccagaaagtgaaactaaaagagacagataacaagtgctggaa

SEQ ID NO: 483264 - DNA, 947 bp, Homo sapiens
atgcctgtaatcccagcactttgtgaggccgaggcgggtggatcacgaggtcaggagttcaagaccagcctggccagcatggtgaaaccccatctctactaagactacaaaaaattagccgggtgtggcggcgggcgcctgtggtcccagctgctcgggaggctgaggcagagaattgcttgaacccgggaggcggaggttgcagtgagctaagatcgcaccactttactccagcctgagcgacagagcaagactctgtctcaaaaaaaaaaaaaaagagagagagagtgggcaagatattgggtaaacctaggcctttaacacctatagctttcagctctttccccgggttcttggctaaaattggggatgaatggtgacgggcctttgatgtccaaatattcatcctcctgggattggatttctacgggggcagtgggcttacacggaggtaagcatactctaaccgggtctcctaggaaccaactggtgggttgaactggtgggatgcagtccattaccggggaaaaagcaaatgggctctacttagagacaatgatccaagagatttcatctgatgtgccctgagttacccaacaataggcataagctcagggaagtacttgccaggttttctaggtgtctcatataaatatcacaagtttagtcggggccacgccggtatcccggcattggaaggcaggtggcaaaacacaagggcgagatcgaacatcgggtagaggtgaagccggtctataaatggaacatggcggtgggggcggctgggccagaactgggaggggacggaaggtgacccggggggcttgggccaaacgcctggtccggaggggatgtcaaaaaacaacacaacggggcatctcgcaagccacatgaaggcgtataacggggacaggagtgagagagggacacacaaatgtggataggcc

SEQ ID NO: 483265 - DNA, 295 bp, Homo sapiens
cccccccttttttttttttggtggggaaaaaaagggtgggggcccggcccccccttttttttttaaaagggggaaaatgggtagtccccttttttgaattcctaaattttctctgggaagggacctgggaaccctgttacccccttttcccttggggggggaggggcccttgtggccgggggggtggaatttagggggggaccaccttttccctttctagctttttaaaaagggggggttcctttttccttttgggttttcccccctttccaaaaaaaaaccttttaaaagctta

SEQ ID NO: 483266 - DNA, 965 bp, Homo sapiens
  misc_feature (321)..(321): n is a, c, g, or t
  misc_feature (325)..(325): n is a, c, g, or t
  misc_feature (333)..(333): n is a, c, g, or t
  misc_feature (356)..(356): n is a, c, g, or t
  misc_feature (377)..(377): n is a, c, g, or t
  misc_feature (385)..(385): n is a, c, g, or t
  misc_feature (398)..(398): n is a, c, g, or t
  misc_feature (403)..(403): n is a, c, g, or t
  misc_feature (409)..(409): n is a, c, g, or t
  misc_feature (812)..(812): n is a, c, g, or t
tgtgtgtatgccagacactgccccggccagggggatagatgtaacaccactaatacctcagctgctttgttttgttttgttttgagatggagccttgctctgtcgcccaggctggagtgcagaggcgcgatctcagctcactgcaacctccacctcctaggctcaagcaattctcctgcctcagcctcctgagtaactgggaatacaggcgcacacaccacgcccagctaatttttgtatttttagtagagacggagtttcaccatgttggccaggctcgtctcaaactcctgacctcatgcctgtaattccagcactttnggangccgaggngggaggatcgcttgagctcagangttcgagaccagcctgggcancatggagngatcccgtctctnccaanaatacnaaaactagctgggcatggtggtgcatgcttgtgatcctagctacttgggaggctgaggtgagaggatcacttgagcctggagggcggaggttgcattgagccaagattgccccactgcactccagagtcaggcttcagtcatgacttgatcacttaatagccatgtgaccctaggcaaaataataacttcacctttctgtgaccctttcctcccctataaaatgggattacagataccaggctgtgatgccattaactatgtctggcccatggtaagcagctaataagtgttagttattattgggaggccgaggcaggcggatcacctgaggtcaggagttcgagagcagcctggctggccatcgtagcgaaaccccatctctgctaaaaataacaaaaattngctgggcatggtggtgggcgcctgtaggcccagctacttgggaggctgagtcaggggaattgcttcagcctgggaggcagaagttgcaagtcacagtgagccgagatcgtaccactgcactccagcctgggtgacagagcaagattctgtctg

SEQ ID NO: 483267 - DNA, 729 bp, Homo sapiens
  misc_feature (85)..(85): n is a, c, g, or t
  misc_feature (89)..(89): n is a, c, g, or t
  misc_feature (97)..(97): n is a, c, g, or t
  misc_feature (120)..(120): n is a, c, g, or t
  misc_feature (141)..(141): n is a, c, g, or t
  misc_feature (149)..(149): n is a, c, g, or t
  misc_feature (162)..(162): n is a, c, g, or t
  misc_feature (167)..(167): n is a, c, g, or t
  misc_feature (173)..(173): n is a, c, g, or t
  misc_feature (576)..(576): n is a, c, g, or t
ttgtcggtatgagactcttcccaggacagagaaaacacaaatgaggctgggcgccgtggctcatgcctgtaattccagcactttnggangccgaggngggaggatcgcttgagctcagangttcgagaccagcctgggcancatggagngatcccgtctctnccaanaatacnaaaactagctgggcatggtggtgcatgcttgtgatcctagctacttgggaggctgaggtgagaggatcacttgagcctggagggcggaggttgcattgagccaagattgccccactgcactccagagtcaggcttcagtcatgacttgatcacttaatagccatgtgaccctaggcaaaataataacttcacctttctgtgaccctttcctcccctataaaatgggattacagataccaggctgtgatgccattaactatgtctggcccatggtaagcagctaataagtgttagttattattgggaggccgaggcaggcggatcacctgaggtcaggagttcgagagcagcctggctggccatcgtagcgaaaccccatctctgctaaaaataacaaaaattngctgggcatggtggtgggcgcctgtaggcccagctacttgggaggctgagtcaggggaattgcttcagcctgggaggcagaagttgcaagtcacagtgagccgagatcgtaccactgcactccagcctgggtgacagagcaagattctgtctg

SEQ ID NO: 483268 - DNA, 661 bp, Homo sapiens
gagttgtctttgtctttctttggaaatggagtttggctcttcttgcccaggctggagtgcagagggcgcgatctgggctcactgcaacctctgcctcccgggttataagtgattctcctgcctcagcctcccgagttattggggattacaggcgccgtgccaccatgcccggctaatttggcatttttagtagaaagggggtttctccagtgtgggctcaggtgggtctctaactccgtgacctcaggtgatccatccgcctcagcctcccaaagtttcgtgggaattacaggcgtgtgagccaccacgacctgtggccataggtggctctttctcttatgtggggaattttaactcggtcattgtggtccctaaggaacctcagaaaatatacgtggtggagtgctttacaaaaggggtgtggtggtgtgtggtgttgtgtggtgtgtgattcagatataactccaagaaaatttccctcccgaggcaaattaaaaaacccccgaggagagaggaggtggggcacaacaaacctctttatatctgcatagcgggccagaacagaaactttccgaatgaaaaaacgaccacattgaaaccctcgcagaacacctcgaagtggtgcctccacccagcgcggcccaataagcagtgggtaaaa

SEQ ID NO: 483269 - DNA, 402 bp, Homo sapiens
gaaaaaaaagtcccccctttttctcaggacagtaagttttgtgggcattttcgcgggagggcagggcttccccccaattttgcaggtgttccgggcccttatgaagggcccttatgacccccttgtgggccccctgttttttgccaaccagaccgagaagggctttctgttgggccctgagttgggggaactcaggaacaaactttttgcccgcttcaagttttgggacccgctgggcaaagccccttaagcctggggtttcggccaggggtttgtgaatggggggatgatccggggcccccttccccccccaaagggggagccgctggtgtttatgtggggccccccccccatgatccagtgcgccccccttcccccgtaaatgattttttttccctttta

SEQ ID NO: 483270 - DNA, 179 bp, Homo sapiens
atggaagacatgtaataagaattggatactcacaggaggttggaggaacagcacatcctttgtgaagcatttgtgagctgaagcagcgggaatgaaatatgtatatgtgaccttctcagagttgtatgctatctacactggcgtcgtgctaatagatatttagatgttacttgtaaaag

SEQ ID NO: 483271 - DNA, 677 bp, Homo sapiens
caaatgcccggagcaagctcctcggatccctcccaaaaatggccctgatcatccccaaaccctcggcaggcccatcacccgggccaatcccgcggaacccccgcggccccccggaggacacggcaacactgggaaaacggataccggaaggggccccccccagcccccaatcccccacgaagggtcccacacgagtgatggcgaaacgagacggtcttttgccccgccgggtctccagacaagaatcccccggcatctcagagcagagccactgcgtgccccacaacggtgctcccccgcctgcgacaccattaagcccaagaggcgaaaatatcggctccaaccacacaccgcggttctctcatgggacacacatccccccccagagcgcgaagccagcaccaagcgccccccgaagaacctccctggtgggcaccacggactagaggccccccacggttctaaacgcaccaggggaaccccccagcgctcctgaagagcggcctccccggcccccacgaaggaggagatgctactcagaagtgtttaatccccgagggcggaggaggaccccgcacattcgacccccccccgtggtcgtgcataatctggcgcctgtggatacacagggaccgcccccctcaaaagcagaccagccctgattcgcccaacatgac

SEQ ID NO: 483272 - DNA, 933 bp, Homo sapiens
gcccgctcctccgcggctcatggcgaccgactctcgcgcacatcgggaccctccggccgtggccggcgaggcgccggtgctcgggccccagccccggacgtgtggtgactccgccgcgcctcgccgtctgcccgtgcggggggaaaaagaaattttagctctcgtgcagggccctgcaggcgaccgagtgctccgtatcaaagtcatggagaaaaagacaaatgatacaccctgctgtcaccacacaagcctgctgcacacaagggattgacctcagaaatgcgctgatacattatcgctgacggacgactggcagcccgagcactccagggaacgaagcaaaaacgacacatacttagcgtcgcatctccagaagccttgaagagaaactcagcatcattcgccgaccactacgccgaccaccagcccgcacccacacaccacacaacaggcaccacgagccgccacgacaagagcgccccaccgccaccagacggaggcaccacacgagacagacgcaagagcaccgacccccagcgcgagcgagcccacggcgcgaccgaccaggccccccccaccccacacccccgcaccactcgaagacacagcagcacaccgacaccagcagccacacgcacgacgccagcgcaggccaccagccgacagcgcgacaacaccgcacagacggccgacacagcacacgcgagggaacagggcagggaacaccgaccagaaccaggcaaccacgccgccggcgcgggaagcgagcgtgacaaaagtacgagagcagcgcgagagcggtagagcgcaagctcgggaggcagagcgagggccgcggcagcgcacgcccacgagacaccccagcgcagacgccagacagcgcgcaggagcccgagggcgcagcgcgcgcccgcgagcccgagcgagcacgcg

SEQ ID NO: 483273 - DNA, 182 bp, Homo sapiens
gagaggacgaggaggggtgagatcagttacatttctagtacgtcaactgaatgtatttttgtaactccttattttggtatatggttttttttctgagacggagtctcactcgtgtcatccaggctggagtgcagtggcacaatctcagctcactgcaacctctgcctcctgggtgcctctgg

SEQ ID NO: 483274 - DNA, 446 bp, Homo sapiens
  misc_feature (3)..(3): n is a, c, g, or t
  misc_feature (10)..(10): n is a, c, g, or t
agnggaacgnacatcctgactctgacttctttggacaggagggtttttacccagattggattccccaatgcagcagggagcgcattttctcagaaagaaacagctcttatcactgtgactggcagctcatttttggtatgaaccaactctattcattcctcatcatgtggcttacttttattacagtcaattttgaggatattctggactaaatatttaagtgcagtcatttctttttggtttgcaaaaagagcacagccctggactacaagtttggagatttaaattctgaccttgagtttggaactgacaagttgtgtgaccctgagcaagtcagttaacctatctgagccttaatttccttatttataaattgaggtgtgtcgaatagattgcttttaagggctttctgctctgtgattccttgataatacatttctttcctt

SEQ ID NO: 483275 - DNA, 168 bp, Homo sapiens
gcctagaggatgttcaccttatgcgtgggggcgggtgggcagtgagcttgaaagcccactgtggagtggggagcaggagaggaaggggtactggttagtctcctaggggctgagcggagtattgttgccctgcttatatcccctaaatggtggacgggtagaagcgga

SEQ ID NO: 483276 - DNA, 852 bp, Homo sapiens
  misc_feature (468)..(468): n is a, c, g, or t
  misc_feature (470)..(470): n is a, c, g, or t
  misc_feature (472)..(472): n is a, c, g, or t
ggtaagtagttagtatgttacagtagtctatagaattatgtacaccttagaggacactagtaaatagaatattagaaagggaaactgtgtcctattaatcttcaaatttgagcatttagttttatgaaagcacaggctatttgattaggttgcatgtttattacatgtttcgtcctactgctttattatctaacaggtacagaagcattagggagagttcaggaatggtagtagttgaattagggctaactggaattcttattttaacaagatgctcacaactacagtgtgtgtggttcctttgtagctttttattctggagggtggctcttacttccctcatttagctgtgctctcttttcacaggggatgcccgggtagttaaagacatggcaactggaaaatccaaaggctatggttttgtatctttttataacaaactggatgcagaaaatgcgattgtgcaangngnggtcagtgggttgggtggtcgtcaagatccgtaatgcaattgtggccacgttcgtaagaccagctggcacctaaaagtacagcaagaaaacaacactaagcaggttgagattctgaacgatgtacgtaacaccagtcattagtccacaaagacattgtagctggtgtactgtcggacggaagttgcgtcgtgggttaacagagtcacgcttatgatgacatgacatttctcacgcagtttggatcaaagttcatggacataacgaagtttcccccagacacaagggcttattccatgttgtcagaattttcaagcccatgaaaagtgcaagcccatgcccattgttccggtgaaccggtactatacgatttgaaggactt

SEQ ID NO: 483277 - DNA, 520 bp, Homo sapiens
  misc_feature (136)..(136): n is a, c, g, or t
  misc_feature (138)..(138): n is a, c, g, or t
  misc_feature (140)..(140): n is a, c, g, or t
atcaaatcagcatttgccccctttggtaaaatatcggatgcccgggtagttaaagacatggcaactggaaaatccaaaggctatggttttgtatctttttataacaaactggatgcagaaaatgcgattgtgcaangngnggtcagtgggttgggtggtcgtcaagatccgtaatgcaattgtggccacgttcgtaagaccagctggcacctaaaagtacagcaagaaaacaacactaagcaggttgagattctgaacgatgtacgtaacaccagtcattagtccacaaagacattgtagctggtgtactgtcggacggaagttgcgtcgtgggttaacagagtcacgcttatgatgacatgacatttctcacgcagtttggatcaaagttcatggacataacgaagtttcccccagacacaagggcttattccatgttgtcagaattttcaagcccatgaaaagtgcaagcccatgcccattgttccggtgaaccggtactatacgatttgaaggactt

SEQ ID NO: 483278 - DNA, 171 bp, Homo sapiens
gggggcccgggggggggggggggggggggggcccccccccgttccgcttttcggggggggggggttttgggccatttttaggggggggaaaggggggggggggggttttttggggtttgggggggggggggggaaaaaatttcccttttttacgggggggggcccccttta

SEQ ID NO: 483279 - DNA, 715 bp, Homo sapiens
ggggggggaggcaggaagggagagagtggggtgagggtataacgcgtgaagccggtttaacagatgcatcaacctgtgtgcagtctatgagacatccatcttacatgcactgtaccgcctagtctcaaataaaagggatgagttgtaaagctattaggatcttgaaagctaggaaaaagcagctgttgtcatcttagtgcgagataaatcatactttaatccaaagcgtgcaattacacatgtgaggataatttcatgccgcatgggcccttgcgatttttcattgactgatttcatgatgaaacgtccattggggatcactcgatcaatttcccgtatatggggtagagatccaattgattgatatgaggttcagtgaaatttaactgtgaaaacccttgctttgccgaacttatgttcacatgatgatatgcaggcttccgatagatgctttacatgataaaaggcccaatccgtttgtagtttaaaccatgtgcacaatcggtttggccagtagaaaatgaaaggctctaactggccccaaaatttaggagccatttttacatcaaaagtgtagttttcaaccatatatccatttttgggaaatgctctaataatcaaaccaatatcctttgtaggggcctaatgtgactcattttgggacattaaccctctttgtaatatgccttcatttccggttcgacgtgtatcgtcc

SEQ ID NO: 483280 - DNA, 507 bp, Homo sapiens
gagcctgactgaactaactccacacaacacaggcgctgagatttgagataatctagtggatcacagttttcctaatcccatcacccctagagcaaggcaatgtacactcattactaacagtgagtcactaacgcagttgtgtttctctctctttttcttttttgagataaagttccactcttgttactcagggctgatgtgcactggcccgatcttgtctcaccacaacctctgcctcctggtttcactcgattctcctgcctcggcctcccaagtagccgggataacaggcatgcaccaccatgcctggctaattttttactttttgtaaagacagggtctcactgtgttactgtgttgcccaaactcgtcttaagctcctgaacccaagtaatcctcccacctcaaattccccaactactaagattacaggtgtgagccaccacacccagcctctgaaacagtttaaacaaccaagaaataacctttttttttaaaagggtcata

SEQ ID NO: 483281 - DNA, 175 bp, Homo sapiens
gagatttggaattcatcagtgatgttaaaagtcactggccggctgtgataatcgcgcgtgttatcctagcattttgggaggccgaggcgggcagatcacttgaggtcaggagttccagaccaacctggccaacatggtgaaaccccatctttactacaaatgcaaaaattagctg

SEQ ID NO: 483282 - DNA, 238 bp, Homo sapiens
tttttcccccggttttttccaagaaaggggggggggtttttgtttcccccccccccccccttttaaggccccttggaaggcccccccccccccggaggggggttttggggcccctattggggggggtttcctgtttttcccaaaaaaaagccctcccttcccaaggggcccttccccccccttttttttttttaaaaacccctaaaacccttaaaaaccggtgggggtggggccctta

SEQ ID NO: 483283 - DNA, 621 bp, Homo sapiens
tgatcgctgactttagaggatccaccgcgtggatcttgtccggcttgagaatctgcagaagatcctgactaacatattttctgaggggatgcactggatttcacatgaagagatagatacgatcccgaacgacttatctgccccaggggagtccgagccacagttttctgatcaactgatgattctgacccgcttctttctctctggggggtaagacacttgttgttgaagctctggggatgatggagaacgactcctcggcctaggagtctgaggcaaagctttcggttctgggggaagaatcacattcgcttctccctctagatggcgttctaggtatatctttcattccagggagaggacccagacaggctgtgcctcgagggagtcccagacccatctctaggtccgggagaagacccagaccggcttctcctggagggaggtcggggtaaaccatctttcatttcaggagaagatgcagaactacttctttctctcgagggggtcaggggtacagcatcaggcacaggtgaagagatgctcggattggaagacgtccctgcctttgccactgggatctgggggataactcagaagggctgtgcccagagggtctgg

SEQ ID NO: 483284 - DNA, 262 bp, Homo sapiens
  misc_feature (31)..(31): n is a, c, g, or t
  misc_feature (74)..(74): n is a, c, g, or t
  misc_feature (169)..(169): n is a, c, g, or t
  misc_feature (213)..(213): n is a, c, g, or t
  misc_feature (227)..(227): n is a, c, g, or t
ctgaagaacgacatcaaaggaaacagactcnagtttcaaaggggaggactccaatagtactgtctgaatagccnaataggcaggaaaaggctgtgtggatgtacgcatggccacaaagaaagtcaagcttctgagctcatgacctcagcagtgttgctgtggaagcagnagagacttcagagctgcacatgcctaggtttggatttatgtccntcactctgagctangcaggttccagcaagtgcttgaagttttctgcgtt

SEQ ID NO: 483285 - DNA, 398 bp, Homo sapiens
  misc_feature (10)..(10): n is a, c, g, or t
  misc_feature (14)..(14): n is a, c, g, or t
  misc_feature (24)..(24): n is a, c, g, or t
  misc_feature (77)..(77): n is a, c, g, or t
  misc_feature (123)..(123): n is a, c, g, or t
  misc_feature (125)..(125): n is a, c, g, or t
  misc_feature (140)..(140): n is a, c, g, or t
  misc_feature (179)..(179): n is a, c, g, or t
tctgattctngagnatccctgtanacactcgaggacacgcccctgtattcggtatcgatacatctagtggttgagcngggagaggtctacattcctctagaacgaaccacagtcagtactacngnagcgctgggatatcnagcccggtccatccaaagcgtaagccatatgtctctccnctggacctctctggaaatgcttctcaactttgatgatggctccagtgacaggcagcagccaccaggactgtgatctccctgggatttaaagtgggaggttaaaccaggctccacgccactgcggaattgtgcaattgtaagtcaagtctcaattgtgagccaagcttctcccagggtcagaggtggagttagaaaggccccatgtgaccctgagcaagt

SEQ ID NO: 483286 - DNA, 221 bp, Homo sapiens
gagctggagaacactggacagcacagcactctagcaggagctccgggccagagggagccggagtgacggtgctgaagaacgccttgatgaagagacgcggtccctataggctccggtccacgagatgaggcagaaacacgcccaggcggtggaggagctcacagagcagcttgagcagttccagagggtaatgcttttatggtgatagcttttttggtgat

SEQ ID NO: 483287 - DNA, 839 bp, Homo sapiens
gtccagaaggcaaaattaccgaatgccatttttaaaagtatgctataaactatgctactctcatacaggggacccgtattttaaaatctccagacttgcttcacatctagattatccagcacaatcataaagtgaatgacaaaccctttgaatgaaatagtggcacaaaatctgttcaggttaggtgtaccgtgtaacagtggggatggggtcaaacagtggttcaacgtcactgttggcatcaaccaaatcaaaggttacagttattagtaagagcaagtgcatttgaatcacatttttctggaactattcataatatgaagtttacctagaaccaatgagtttctagtttaatagtttagctatgcaaatgagcaactaaaacaatactttatattgttatttatagaaagagtcaaaacacctgtattataaacctataatatgcaaaatcatgcaattcacatagttacacaagatgtaaacatatacaaaatcatgtacctatatatttgatggacatctacatcctatattgtgacatgtaagtctataaaaaggtgaaaagtatgattacttaccaattaagtatgatagatatgatccaagaaattggatcagaagtgaagtaaaatcctcaactgaagcaaatggatactaaatctactaatgggaagttcataaaatatacatctacatgcctaagaccataattaaaaagaacataaagtaaataagagcaaatagaaacgaaagatataaagacaaggaaaacacaagatataaaagaccaaaaaaaacaagcaacaacggaaaagacgataaaagaaaaaacgaag

SEQ ID NO: 483288 - DNA, 183 bp, Homo sapiens
agagatccccgacaccccactcatctgcctattcataaaccaactataaactaaagccgtataataatgtactcgactgcccaatttaaaaaaatagctctctgcagtaagagtcagggtaatgattataggaggaagctgctggggtgagggtagagagatattctttttcttgcactgggt

SEQ ID NO: 483289 - DNA, 398 bp, Homo sapiens
  misc_feature (77)..(77): n is a, c, g, or t
  misc_feature (123)..(123): n is a, c, g, or t
  misc_feature (125)..(125): n is a, c, g, or t
  misc_feature (140)..(140): n is a, c, g, or t
  misc_feature (179)..(179): n is a, c, g, or t
ctatgaggtatcccgtaacccgaccgaggactctgcccctttgttctgactactcgatcagtctatggggttgagcngggagaggtctacattcctctagaacgaaccacagtcagtactacngnagcgctgggatatcnagcccggtccatccaaagcgtaagccatatgtctctccnctggacctctctggaaatgcttctcaactttgatgatggctccagtgacaggcagcagccaccaggactgtgatctccctgggatttaaagtgggaggttaaaccaggctccacgccactgcggaattgtgcaattgtaagtcaagtctcaattgtgagccaagcttctcccagggtcagaggtggagttagaaaggccccatgtgaccctgagcaagt

SEQ ID NO: 483290 - DNA, 571 bp, Homo sapiens
catgggactacttttcaggatgttatagtattaacacacataatgtgaacttcccagcacactgctctatggcatacttctgagcacatagtacatgctctataaagatgcattgatgcatatacacgtttttcaaatgcagacttactcagacttgccaccatcttccgcctctgtaaacattaaagggcttgcagagaatgccgtatttcaagatgatgattggtggtcttgtcttcggatgtaaagtatttgtgtcgtgataagggtgttgcagtgagggactcatgctgtgactgctttttctagctgagtggtataatgggtctagggggaggagtgtcagcaataagaagacttgcaataacaggagacttgcaataagaagctaattcatggaccctgtctctaataaacaaagattggccaggcatggtggcgggtgcctgtggtcccagctattcgggaggctgaggcaggagagtcgcttgagcctgggaggtgaagtttgcggtgggctgagaccgtaccgctgcactccagcctgggcaacagagcgggactccgtatt

SEQ ID NO: 483291 - DNA, 845 bp, Homo sapiens
ggaatcgtccggagagaatcatcactctgaccggccccaccaagttgccatctttaaggctttcgctatgatcatcgaccaagctggaggacgatatcacacgagtctccatgaccaacagtagcgcggaccaggaggcccccggtcactcctgaggctggtggtgacggcacagccagtgcggctccctgatctgggaaaggggggttgtaagattccaaagagatccgcgagagtacggggggcgcaggtgttccaggtggcgggggaatatgctgcccaatccagcgagcgggcaatcaccatcgccgggtcgtgcccgcagtcttgtgcaaccgagtgtgtcacagcagatttgcctggtcatgctggagaccgctctcccagtctccgcaagggagaggtcagtgagcattcccgtaccagcccatgccgggcccaggctccccagtgatctgggcgggcggcaagatcggctgcagcaggacgctgcgaggctaccccccatgtcgccatgaacgtggacggggaaccacctcgtagaatgacttacttcgacttccacggacccagcaacacgcagtatctcccggctcacgatcatggcgccaagcgtgacacacggttggcgctcaacaaccagtcttagctttgccactgagtgacacggcggggcacggcattcgaccggaactgacttcaaggtctccagaaggtgaaacggttgtggggccactcggatgcatatagcaaacacccagaattaccggtcccactactcactgggtagctctatggggccacacggcgacaaatgaaatcgcaaagctgagccaaaacatgga

SEQ ID NO: 483292 - DNA, 130 bp, Homo sapiens
tggggctaggttgggccagacaactccagcttgctagctcaggcttctttatattacagcatagtccaaagggtgagatggaatctgcatgtcctcttgtaagcctcacagcttctgaactccaccagtg

SEQ ID NO: 483293 - DNA, 896 bp, Homo sapiens
gcagtgcttacgaagataggtcacagtgccaatcccaagtgccgatgcatgtaagcgcgggaaactcacatctgcacctaactcccaccttctttctctgggaaatcttcctaggacatgcccagatggactcaggagcccatcagcatagtaaactccccacactgcagacacgtggcacattgacgtagtatgcagtgtgtgggatccaggtggaccaccttaggtgtatcatttgaaccgcttgacgtgaaaaaatgcgtgcctggcagggctcccatgagtcacgaccatccaacaataagtgaaggactaacaccacatacaacacacggtcaagagatgacatatcgccctagctggatctactacagggcaacgggccacagaagggtgcaagggtccacggcacgggctgagatgtctcatgtagttaagagctaactctgcccaatctatatccgggctggatgtggagatctgaaggcccgaacagccacctctggcctctgttgagtcaacgcaagcctgtgacgaccttggggggagcctgctctactcctctagggccgatacattagcgagtcattgtctagtgactcgcgcagattcccaggagtacatgccatagttcattaaccaacagtgggaactcataaccaaggctaagcccaactagccgcctaacacaactacacctacactacatgtaacacacctacggcaccgtccatactaacacccatcaccccacaataaccgctcgcaccatgacacaaccacaacaagcacacaagcaatcacctcagcatctccacaacgacaccaaaaaccagtaaccacctcttaccagccccaccaacacccccaccacacacaaaaccgacgcatacaac

SEQ ID NO: 483294 - DNA, 482 bp, Homo sapiens
  misc_feature (339)..(339): n is a, c, g, or t
atgtccagttgtacagataaatacacaatgttctaatgttacctcaaggcctgaatttaggaattgaaagtctttggtttttcacagtggtgaagaaaccagtagtaactttaaaatacccttgagtttccctctgctcatttatctcccaaatctatagttcatgttttctttctgtgatatccacttccttgtaataattggcttctgagattaataaattcttgaaaggcatagggaaaaaatgaaaatttgtctctttgaggaggcaggggacaagtttttttaagaggggaaggaatggaaaaggatggcagttattgtttttaaagccagagngagggattgtggctgggccattaaagggagatttgtggaggtgctttgtggggatttggaagtttctgctttgctttctccggccacactaggagagccccatttcaccgtccctttcaacaccacccgtatttttggtaaac

SEQ ID NO: 483295 - DNA, 364 bp, Homo sapiens
cagtcagtcagcagtaccaccgggccaagctgattgccccgccaagagactcgctctgggctcccctcgtaaaacgcaggagaactcgagttcagccagcattaaggatgagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaag

SEQ ID NO: 483296 - DNA, 1218 bp, Homo sapiens
  misc_feature (1216)..(1216): n is a, c, g, or t
  misc_feature (1218)..(1218): n is a, c, g, or t
cagcctctgcctcccaggacgagggagatcctccccacctcagccttccactgtagctgggactacgaggcattgcaccacaggcatgcaccaacacacgccagcaaaattttgtgaatgtggcgtagagaccatgggtttgcatcatgtttgcccaggcttggtctttgaaattgcctgaggctcaaagccaattctaatttttggccttgtgtgcctcccaaaagctggctggcagcacttaacaggggcattgaagcccaacccagtggacaaggccttatctacaattgtggtacatcactcataatacaaggggacacgcataatcttctttcatcccccatccccacaaaactaaggggatattctttatttatcccctttatcggtccactttgggttccatggtaagtggtaattcctttacaagttttcattataattggaaatccatttgtgggaagtcatgtgaaaacaacgggcaactttcaaggaagaggctaaagaaacgaacactaggataacgagggcaataactcaggaggctaatctggaagtattttacctataaagtatgtgtaaagctacttgtggacgctttggacaactgtcacaagaaccccagtggacgttgcattgttgggaagcaacacgatgactgggaggcgttggtaaaggaccacacagggcacgcaggtgacgctacacgggcagaatgggccgtacgttggtgggcacacaacttctgggggcccatttccgtgtgctaacacctcgtggggtaacaatcggcggcgagcgcggccttggtgcaccccactgatggggggttctgttggcgcgacgcgattttccccccaagcgcagtgacacacaggtgtggaagtgcggtccagaaccgcggcgacttaccaccgatggccgggtaatctacacggaagacgacgagacgggcaccgcaataaacgcgtgacacctatacaagcaggcgtgacttacggacggagagcggacaacaaccggtcgtgggtgcggacccctctactctccctcacttcttattatttccttcactctaacaatgtattgtcaattttcttcttttaacacacagacgtcgacacacagcctgaactaaaagtacgagagaacagcacacaaagtacgcagaacagaaaacgagaccaggacaacagcgtagagaaggacacantn

SEQ ID NO: 483297 - DNA, 106 bp, Homo sapiens
cccgttcatcaaccctgtcaaaacccgtatacaagtagaccactacagccaattaacgcggttatttagggggccttcttattgctttccgtaggggtttcgatga

SEQ ID NO: 483298 - DNA, 803 bp, Homo sapiens
gcaaagatgcttcatttctcactgtaaacataagatcgttgccacatgactacatggacctcagtctaggaattaaatctgcacctacgctaggtctcttgtatgatatgtccattcaagcagtcattctcaggggtaatataatagtgagtgtcatgactaccttatcgtaagagtagatccagtatctgaaggtcggactttgtagtaggactacgggggaactcctttcaacgcgggtctcgagtgagacccgagagttctctgtcttgcattatatgtgaagtagtttaaaccgcatctgcatgggaggagacggcagtgcatgtgaatccaaggaaaggcttcccctcagtggattatcacggtcactcatgctaatcctatgtgctagccactttctttcatatcgtttgcaggaaacttcactaggagaggatttgaccatgtggggacacccaaaagtgtccacccactcttgacaggtatagaaagaacttggttggtcacaacagggggacaaggacaccaatagtattgaagcttaaaaaactccagtaaggaacacttggttacatccggacaaacagaagtagttactgggtgcgacgtaatctccatttaggagagaacttgatggagagctagcttatgctcacagacccagattaggaatcatcaggagagggacttgttaccgggaatatcgagctcctgtgggctggtggcaaaggcttccatctcttcgagcatgttaacgatacattgcggaggtcgacaaatagaacctcttatgaaccctc

SEQ ID NO: 483299 - DNA, 172 bp, Homo sapiens
gctaacgtgcggtgacaggacgctgactgagatgatgcttgaacccccactgctggtttgttcaactggtacagttcacattattaagtcgtaacaactgtgaagcttatttctctacagagacccaggtgtctcccgtcctcaactctgctcagtccatctgacccatctt

SEQ ID NO: 483300 - DNA, 177 bp, Homo sapiens
aggagatgatgctttgggtacttgaacctcagccacttttcaggcgtgtgcaatagctcaaaagggaaggcagagaggccatgtgggcacattagaccttcatcctgctcatgtcttctggagtcatccatgccctgtcccagcgttctccattgtaggaagcgctgggacggagat

SEQ ID NO: 483301 - DNA, 182 bp, Homo sapiens
ttaataagcctggtgctgcccgattcaggtccaccaccttgacaggatgatgctctgcgggacatccactcctccttggtcatgggctatcatggactggattcgggacttctgctcatccgtcaggactgggaccactcctcttcctccccagctgatcggatgtctctggcccagcgagg

SEQ ID NO: 483302 - DNA, 222 bp, Homo sapiens
tttcccggcagcctcttcaccgacccatgggtgccagacttcaggatgttccttgagaaagagtttcgccagtttcggcgactcgatgcgctcgcggctcatgcgcgccaggttctggttgagcaggtcgatcggcaggttgaccttttccagcaccgccaccagctccggggcctcgtcgtggaagactctggacaaaccgaccttgatgctcacgctctt

SEQ ID NO: 483303 - DNA, 89 bp, Homo sapiens
taatacaacaggtgtccagaatacttgcagtataaaatgaagatttggttgttgtataaaaaataatgctgttaaacaggagttgacct

SEQ ID NO: 483304 - DNA, 1693 bp, Homo sapiens
  misc_feature (1172)..(1172): n is a, c, g, or t
ggacgcgtgggtcctggacgctgtggtgcgtgacgcagtagggtactgaacacacgctgtacgacagagtcagagagaaccgcaccatggtgcatgtctcctgccgacaagaccaacgatcaaggccgcctggtggtaacggtcgggtgcgcaaagcaaggcgacgtatggtgcaggaggccgctggaagaggatgtgcctagtccataccccagcaaccacagaccatacttcaccagaacgtatctgacctgagccaacgagcacctcgacacacgtgctcacaggagccaaggagacacgacacggatggcaccgaccatgcagcaagaacacacacgcgcacggtacgaagccacgagaagagaacagagcatagccgcaaaaggcgagcatagaaccacgaccagtgaaggggacgcctatgcaacccgcgacagaccacacacaataaccgcacgcttgcgaaccacctgagatcaacacgataacaaagagaccacacataaagtgcgacgtcataggcccttgccatagagaagataccgccatggcacactgacccgccaaacacctaagcgaccacggacaccaagagcgatacaaacacccacttgctagtgatatgcacaaggcaccatgcaaaccactgaccaacacaaagaaacaaccaaggaggacgaaaacaatgcggaccaagccaaacgagagaaagcaacagaacacagcgacaaaaaggtaaaccaggggaacaagacatagagaagacaccaaacagcagaccacaaccggcaagacacatcacacgacaaccaggacataagagacgacaacgcccacacggaggagagaccaccctcgcacactatgaccacccgagacgcatgcactaccacagggcaccccgcagtagcagcagtgggtcctccataagctgtaaagcggaacagagacacgtcaactaatggagcgcgcacggcacagacatgcaccacaatgtaacgcacacacacacaccacaaaaccccccagcagcagcagaaaggccgagcacgggcacaacagcaacgaaaacataccatgcactcacacccgctagacccctaccagcaagagcacacgcgcacaacaccggcgacgcccacatccaacgacaagacacaacacagacnacacacacaagcaataagcagacagacgacaacaaaccaagaaacgcaacgccacgcacacagcgcccaacagaaataacaacgaccacagcgcaccaagaccaacagcgcgaacacagcacagaacgcagacggaacaagaggaagcgccaaagacacacaacaccacgccaagcgacatcgacagaacgagagacgcgcaggacgaacgcaaggagtgagccgaacaagtggatgtacgatatacgaagagcagggacaaccaagcgcggcgacgacagtgcacagcatcaacgcgggcagacagaagagagacaagacaggccatggaggaagaccccagaggcgcagagacaaaggagaggcggacagcagaccgagcagccctaagagggatgcgccgagaagcagagaggaacgagcgaacggcagacaagcgccagaggacggctacgcggcgcacgacaggccgacagggagaacgagaggcaagcacacaataaatggaagctcctacgcac

SEQ ID NO: 483305 - DNA, 588 bp, Homo sapiens
aacacagtttcttgtcactaagtctgtgcggtctggtggcacagcaaagattcgtgcatatgtccacccacatttggtctgcatgctattctacacagtcaatagcggccgagagccactcatctcccctataggggagagggaaagtttctttaaaaggctaggcaggatgattcataaggcatagatgaacgaatatacacatggtatctaactcagtagctatgtcgagccatcaggatattgttctacctgagcttaaaagatatgtgtagttctcccgttgcttttcccttcttcacgtgaacgaactctccgccacaacacagaggtgaaaagagcgctcacattcaaactctactcttgctgttcacatttacgatggagtcccagaatctccaggtttcttgctcaggcctcaggcaggactagatctcagatgtgagttctgggccagtatttctccaacacagtgttgcgtacttcagacctctgtctatgatctattagctctccctttagctagggcagattaaaggatgatacctttcaaaataattacacatcaggcctggtgcggcggctccc

SEQ ID NO: 483306 - DNA, 125 bp, Homo sapiens
acccccaatcacaagaagatttccacccctgcctcccatggctggttccaagacagtgagacagtttggaaagtgatgtcagaatagcttcccataaagcagcctccttttgaggcctgagtgga

SEQ ID NO: 483307 - DNA, 455 bp, Homo sapiens
  misc_feature (39)..(39): n is a, c, g, or t
  misc_feature (74)..(74): n is a, c, g, or t
  misc_feature (158)..(158): n is a, c, g, or t
  misc_feature (223)..(223): n is a, c, g, or t
cccaccaaaggaccgtatacttttttttttaaccagaantcatttccaacctgagtcctttgaatttacctgcnggaaaacctaggattcttttggaggcctgagaagaaagagtccatggtagagtttcctttttggatttagctcaataatgatgntcagattgggcaagtggggtgcgcgcatggctcatacctgtatcccgcactttgggaggccgagntaggcggatcacttgaggtcaggagttcgaaactagcctggccaacatggtgaaatcgcatctctactaaaaatagaaaaattagccagatatggtggcacacgcctataattcccagctactcgggtggctgaggcacaagaattgcttaaatctgggaggcggaggttgcagtgagctgagattgagccactgcacttcagcctgggtgagacaatgagattctgtctcc

SEQ ID NO: 483308 - DNA, 376 bp, Homo sapiens
gcggccgcctactactactctactactactaaattcgcggccgcgtcgacctgggctttatgtagcttgtaggctacagcatgtattgcactgaattctgtaggcaggtataacacaatggtaagtgtttgtgtttccgaacatacctaaacatagaaaaagcaaggaacggtggctcacatgtgtaatcccagcattttgggagggtgaggcatgagaatctttcgagcccatgagtttgagaccagtttgggcaacatggggagaccccatctctgtaaaaaatcttaccaaaaaaaaaattcgacgcgggctgtaatttagtatcaatagtcgccactggaatatcagactcaaacctagtggcgtattatac

SEQ ID NO: 483309 - DNA, 231 bp, Homo sapiens
  misc_feature (87)..(87): n is a, c, g, or t
ttaggccgttgtagtggtggacgggcaggtattccagtgcaggatgctccacgtgttaccatctaccatcaagaaggaaagcagcgnaggattgcccagtgcctgggattcgtcgtcctacacagaagaagaaggagtgccaggacaaagccaacagtgccagctctcacagctggaacacactattcatggggccgaatgccgtggccgatgccatcgcactgacaacgg

SEQ ID NO: 483310 - DNA, 285 bp, Homo sapiens
ctaaaaatatacaacatcgaatcagaaaaataggggcgacaaggaaaataattaggctgtcgcctcaattgtgcattcccgtgcaaagttgcctgacatcgcgacagcgttaacagttgacttcacttgtctatgctgcagttgatggctacataaccagtttcaccacacctatagcacttcacctttggtgcagtctttatgaatgtgtccgaattctccacaagaatagcatttctgctcatctgcattgtcgcagtccaccagccacaaggtccaggtatt

SEQ ID NO: 483311 - DNA, 226 bp, Homo sapiens
ctcaccacagaaacacctcatgtcactgctcacacgaacgacacactcatagatgcttaatcacagacactatcacactgcacccgaacgcatcagcacacgcacactcatagccatcacacagcacactagcacacagcacacaccaagacacagcacacacatgcacacacaacacacacacgcgaacacagcacacacgaacacagctccatcacgcggatca

SEQ ID NO: 483312 - DNA, 952 bp, Homo sapiens
acacgcccagtccatctgaccccaggtggttcaggaggcgaggaggccaggcgtgggttggaggacggctgtgctgccttcttcctcctccccaggctgccgtgctggggcccctccctcttgggaacccctccctctccggaggccgtatggcttcagcctgctttctaggactcagcgttggtgcctgccctgccaccctgaccctgacttgtgctcaagcctggcacctggatcctggttcctgcttggggcctggggatggggtcccaataggcttatgggatcacagggccactgggccaccagctgcccctcccttggctggagtcctgccctgacctccggactggagttcccctcctcttccagccccacggggccaagactcggcctcctggctggaggctccactgtctgggtggggctggtggtgccagggtcaaatcctggggccttcatgctcaattgttgctgacgaggccgcctggacagcttgcctggtcccctgtatgtccactctggatgtccacagtgactcgggctcctcagcagcccacgtcctcctcaccatctcccagaacattggagtcagggaaacagaggcgtgtggacaaggccctggggccctcacctaagactcacccgagcatcaggcgtgcgtgggcccgagtacggctgggactctccatcagcacagacaaagtcacacacatcctgggcacgagcacaggaggccacggaagtacgacgccagtgaggtaggccccgcacggggtagcacagcgcttgtggcgactggcttctcgaatcgccggacagatctccaacaccctggtgggccgaaccacggcacaccgggcgcgacggccaaccggtgggcctgggcgcatcaccatctacagacggtcaggccacagacggcgggatccacaaagagccgacacggtca

SEQ ID NO: 483313 - DNA, 894 bp, Homo sapiens
gaatcatattgatatcttcttcgaaaccgcacttatccccaccttggctatcatcacgccgatgaggccaaccagccagaacgcctgaagtgcaggcgcatacttcctatgctacgcccgtaggtaggcatccgcttccgcctactcgatcgacacttaatttactactgcgagcaacaccctatgctgaactaaatcattgctactactgcactctcaggggccaagaagctatgcgaaaactcctgagtcccaacagagttaatatgagtaggcttacagaatagcgttatagtaaagatgacctgctttacggaatccatttatgactccctaaagcccatgtcgaagaccccatcgctgggtcaattagtagctgggccgtggagtagctcttgaaactaggcgggtatggtatatattacgcatcacactcattctcaaccgctgacgaaacaccgtagtctaccgcttccttgtactatccctatgaggcataattataagcaagctccatctggctatgagaaaagactaaaatcgctcatgcataactcttgcaagcaagcacatagcctcgtagtaacaggcattctcattccaaccccctgaggcttcacggggccagcattctcataatcggccacggatttagatcctcatttactattctggctaagcaaaatcaaattacgaacgcgtccacagcgatcatcatctttttcagggagttcaaatttaatccaatatagctttggagactctagaagctcgtaaccgcttaacccatataacaggaatctcggagaacccggcggaattaccccataaggaaaagagtaacctattcaaagggccacaaaaactaaacgtatcttcccaggtaaaaagggc

SEQ ID NO: 483314 - DNA, 302 bp, Homo sapiens
tacagatgaatgtttagatttcaaaatttaaaagccccgagtctagaagaacctgaaaactgagtactcctcaagctgaaaggccatctctacagaactatcattccttttttttgttttttgttttcttttttggagatgaggtctcgctatgttgcccaggctggagtgcggttattcacaggtgcaaccacagggcactgcagctttaaactcctgggctcaagcgatcctcctgcctcagcctcccaaatagttgggactagatgcacgcaccaccacgcctgactcagacattcact

SEQ ID NO: 483315 - DNA, 634 bp, Homo sapiens
taagaggatcccgctgatctgcttacgcagaaaacagatgtccattacagatctttgggatgggtgaagggaattttaactggcgattttgtttcccgtttgactaccttccaccgaacactctgtatcgtgcgaaaaaagagcatttctggagtattgaccagacggaatttcgaatccccacccagctgatcattccagatatggggacaatgacaaggttttctcttgggatgactacttgggtttcctaagaacttgactttgcgtcacacggatcattccttgcaaatcaccagagaaatgcaggttggacatgattccggacctcaaagccatgaacccccttaagcggatcagcgctgatccgcttaagccaggttatggcagcaagtatgtctgcttttggatcctttaaaaaaaccaagatgaattccaataaaaattgtttatgtcaggcgttttggctttaaccgacatgatccaggtttcaggggccacccaaggtgctccttgcagaaagatcgttcaggaacacccccgacaggcattgcttcctcctcctcagcagctcacccaacaggcgtacagccagaggagccaccctatacaggagctcagatataagcggatc

SEQ ID NO: 483316 - DNA, 156 bp, Homo sapiens
aataacgtggacaggacagtcaacaaaggaaacatgatacagactaatctgaagtacccttggatccctggaatgtccgtaggacactcgtacaggtgtactgatcccacaagatctctaacgttctggccgagggcaaactagggtcatcaagct

SEQ ID NO: 483317 - DNA, 368 bp, Homo sapiens
gtgacaaaaatcctgacagaaacatggacagtgaaggccaggctgaggaggtctcagagagaaataagaagctttctggaaaatgtcttccttttggatatggaaagcttacacaatgcctgtaccatcattgtaccttagaagcagtggccttgctttttatttcagagactcataggcaaaagagactgtagccttgacccagaggaaactttggactttgtaactttgagttaatcctgaaatgagttaagactttgggagactgctggcaaggcatgattatattttgcaatgtgagaaggacatgagattcatggggtcaaggacaaaatatacggtttttctctatgtccttaccaaaaaaa

SEQ ID NO: 483318 - DNA, 274 bp, Homo sapiens
ctcttatgtacctcttctgtgcctcttactaatccattcctttccttgccactggcactctctttttttaactttttttgagacagcgtctcactctgtcactcaggctggagtgcactggtgtgacctcagctcactgcaacctccacctcccaggctcaagcaatcctcccacctcagcctctctggtagctaagaggtgcataccaccatgcccagctaaattttttttttttttttttggtaagagacgggttttttggccttgtaacct

SEQ ID NO: 483319 - DNA, 342 bp, Homo sapiens
cggcatccctagtgttttaaacttttccaccacctgcagagccaaaaagatgccgatgagctttagcctcacccagatgctgctcgtcagcgctgcctacctggctgcgttgttcggggtggcttggatcagtgagcgtggaatgattccgcgggcgatcattcgccatccgttgacctacaccttgtccctcggcgtttatgccagcgcctgggcgttctatggcacggtgggcctggcctatcactatggctatggctttctctccagctacctcggcgtatccggtgcgttcctgctggcgccggtgttgctgtacccgatcctgaaaatcacccgcac

SEQ ID NO: 483320 - DNA, 701 bp, Homo sapiens
agcggatctacggggcggcaggaggcccgaagcaagatggcggtgaatcagagccacaccgagaaccgcgcggagccctcatccctaacggtgaaagtctctggaagcggtctccgaatgtggagctctgccttcccacagcgatcagaaggctcaaatgtctttatggtagaaagacaggaacatgtatctcactttgcataccgggtgattttcataacttcatgctccatcagtgatcccgatgttgtgcttttatgatgccattggatctgatgacgaatctctaactgttgaacaaccagtatttgtctgcgaaacttgcattaagggaactattcaggcagctccatatggtggctgggaaggacgagctagctttataaaatgtagtcttcagaaatggaggtgccattgaatttgcccagttgatggtgaaagcgggctctgctgctgcccgaggatttccatttagaaccttaagatgactggttcagctctatgggcatttatgtaattactgggaatgggaatttgtgcatcgtccacagatgccttgtacagttatgtctatggagcgccacctgcgggatatggagccccacctccggatacggagccccactgcaggatatggagccaaacccgtaggaaatgaaaggccgctgtgggatacagagcctcacctggctgcccatatc

SEQ ID NO: 483321 - DNA, 307 bp, Homo sapiens
cccccgagttataacgggtgctggtggaaaacagtggtactgtagtattgggtggaatactcagacaaacggaacgcgataatgtgaccaaagtgccatttttgggtgatctgcctcttgtgtggcgatttatttatctagcactgggacaaccaatgacaagacagagttgctgatatttatcaccccaaaaattgtgacagatcaattccatttgaagtaatctgctacccgatttgtttcaagatcacattcattagtaaagagataggtggtctatgaagaagtttgtccaaatggtgtttgg

SEQ ID NO: 483322 - DNA, 323 bp, Homo sapiens
  misc_feature (13)..(13): n is a, c, g, or t
agcgaaagcttantagtgctcgcagatgcgctgagtcgcgcacgccgcggcgtcctcgtttgttttttcgctgcgatagccagatgtaatgatgatgggaaggtgaatcccatgcatcgaaaaccacccttggatgccacaaagtatatcgaggagtgtctggctcatctggactgcggtaccggtgtgaacgtctcgcagaatgcgacaaatgcgctcataacctgaccattgtagccggccactttcgtggtagatctcgttgacctcctcccatacccccttactaacttcacgcttcagccaaaggcgtcttggctgat

SEQ ID NO: 483323 - DNA, 142 bp, Homo sapiens
agagattggccagcaggaaggcgggggatcggggcaagtggcagcaccaagcaggccaacgtggttcttacaacgtctttccatgtctgacaagccagatacagagttcaagagctcagctgtatcgaccagaatcgtgatg

SEQ ID NO: 483324 - DNA, 200 bp, Homo sapiens
ggggaaaaacaaacagaaaatctcctcttctttctcttgcttgctgaccccaggtactccagcttcagatgggacctctgggggtggcttaggggcctcgaggaggcccgtgagcttcaggtgtatggctaggggtcacggatcctgcacatggggcagggtcccaagaactcgggaaattggccttctggtggttacac

SEQ ID NO: 483325 - DNA, 281 bp, Homo sapiens
gagatgccaccagtgcactcgagccggggtgacagagcgagactccatctcttaaataagtaacttttgtggccggtgtgtgttggctcatacctgaaatcctaccagtttgagacggcaaggttgggtggaccatctgagtgtccggagctcaacattaggtctagccaaaatggtgaaatcccatcgttactaaaataaaaaaatatggaggcatggggttgcatgcgtgtaatcccagctacttggagggctgaggtagaagaattgcttgaacccag

SEQ ID NO: 483326 - DNA, 227 bp, Homo sapiens
taaacataaagatgaggatataaggatacacacctgcattctatcgatagtcatttttactctaccttctgggtgtgtaacggatggaaaagacacatcagaaccgaataaacacagatccattcatacccgtggaaaggttggcaggccactcaagggactgctcagagcgtccacctcatctcagatggcctcaccgtatgacgctcaggatgacgcccggaagg

SEQ ID NO: 483327 - DNA, 363 bp, Homo sapiens
aattttgcccaaatccctatctaagagatctggggagacatgtcctacaaaccataaattctcatcacaagggttttatttaaccctatatgtcatgacttactttccaatcagactctggcttaacattataagacaggcaaataaatcaaaatatttaatcccaaaacatgtttctctgccatatcttgaaaatgtccctgcaaagccattctttgtagggtgaaaacctgcatctgtaaagagtctctattaacatagctagatcttttttttccaggtcctcccaatcctgaagagattagcttttgtttcatgcctcttaaagatccgaataggaaatatctttcatagtttgtctct

SEQ ID NO: 483328 - DNA, 234 bp, Homo sapiens
cgatatttttacaagatacccccaaaaaacattttaagagggcaaaagtagaagctgcaaggtctcttaaggtccaatcctggaagtatcacttctgctgcattcaactgggcaaagtagatcacaagtcctgcccagattaatgtccacttcttgacaggatgaacagcaaaattatactgtaaagaactgagcatattggagttcccactgtggtgcagtggttaacaaacc

SEQ ID NO: 483329 - DNA, 1364 bp, Homo sapiens
  misc_feature (85)..(85): n is a, c, g, or t
gggccgcactctgctgcaccgactgctgccgcctctctgtcagcgttgccaggctgacacatcatcgcaaatcctggtagcgatnccgcggagcggcgcggtcgccctgttccttcgtcgcgccgcatgatgccgcgatgagcctctgctattcctgtccgcggccgcctgtgtgccgcacggtgctcgagtgcccgagctgtagtacgccgcagtgcgcagctgattcgcaggaggctctgcttgtcgatccctggccagactcctcgcgggatagcccgtacactaagaggagtaccactgaccaagttagggcccgtgtgattgaggtcgtgacacctcgatggtttggcctcgctagaaagtcgaacagcgggtactgatgcataataacagacccctgacaagaaaggtagggactagcacgcgtcagggcagcaccatgtcgagcctgcgcgtgcccccacgaccttgcctggacagagcgttgtcgtcctggctcgcgcgtgcccttgcttctgcttagaggggccccagttgcctcccatccgttggcattccatttagcgcacattgccccattgaccgcttgcctagggtccatggccgaatagcttcatggcgctcggtccccaagcgttccttgcacctatgcgagtgttggcacttgccccacgcccattcctttccctattcatggactcccagccttggtcttgttcggccccaatttcccttgaggacatggtcgtgccaacggacgtagccattgccttcgtgaagccttgtgccatttggggcatcattggcgcgccagtgtcttgacgccagtggttcccaggggggccagttgtcccaggaagtttgggtcgttgagcgcccccttgttcgcaacgtccttgggctgcctaggaaatgtccccccgtttgccaaaaaggggatcgcggcccattgtgcggtcccccataggcgaatttccgccaacaaaatcccccgagagtaagtgcgcccttttgagcgttcgcaaggcattttaagtgcccgggcccccaacaggggctcctttggagtgttccattcaagggaaattttccccttaaagttccatttttccccaaggcacaagcgttaaacttgaaaaaccgggttcgaattttgggtcggtgggacaaaaaccaccgttgaaggagaacaacaagcgacaagtccacatcggggcacagctttggacgattaacattacacatggagcaaaacacaccaatgagccaggggacgcgggattcacatatgttatcaccacgaaggtagacgagatagccagagtacacacacaccaagataggtccctcgacgaaaatag

SEQ ID NO: 483330 - DNA, 263 bp, Homo sapiens
gactagttaaagcaactagcctggagatggcttatgtactctctcctttgtttttgttttgttttttgagacggagtctccgtgtcgcccacgctgaagtgcagtggcgcggatctcggctcattgtaacctccgcctcccgggttcaagtgattctcctccgtcagctccggagtagctgggactacaggcatgcatcaccacgcctggctaatttttttgtgtttttagtagagacggggtttcgccatgttgggctggct

SEQ ID NO: 483331 - DNA, 1331 bp, Homo sapiens
  misc_feature (131)..(131): n is a, c, g, or t
  misc_feature (138)..(138): n is a, c, g, or t
  misc_feature (141)..(141): n is a, c, g, or t
  misc_feature (171)..(171): n is a, c, g, or t
  misc_feature (283)..(283): n is a, c, g, or t
  misc_feature (295)..(295): n is a, c, g, or t
  misc_feature (298)..(298): n is a, c, g, or t
  misc_feature (304)..(304): n is a, c, g, or t
  misc_feature (311)..(311): n is a, c, g, or t
  misc_feature (323)..(323): n is a, c, g, or t
gattgctcaggttggtggtggctgcgtgtcaggcgtgtgcgtgcagtacggagacagtgctgctgggatgtggcattgccgagcgcatcaggtcctgtgctgatgatgaagaagatgtgaccgcgccctgntggagcngcngctggagcccgaggagctgtaccagacttnccagcgcatcgtggagaacgtgaacgtcatcatctccacctacggcgagggcgagagcggcccatgggcaacatcatgatcgatcctgtcctcggtaccgtgggctttggtnctggcctccacnggntggccnttcaccnctgaagcagttngccgagatgtatgtgccaagttcgcacgagcaagggggagggaccagattggaggccgtgccagagcgggccaagaaagtagaggacatgatgacagaagctgtggggctgacaggtactttgacccagccaacggcaagttcagcaagtcagccaccagccccgaagggaagaagctgacacgcaccttctgccagctgatcctggaccccatcattcaaggtgtgtgaggcgatcatgaatctcaagaagagaggagacagcaagaactgatagatgagaagtggatgtcacaatcaggaaaggcagcaaggagaagaggacacaagggaaaagagagaaaggcaaagaccgcatgagagaaagagagtgaagcatgcggccagacatgagcatgccatgacgggacaacgccatggcagcaaggaatgatacacccgagtcccacactgaaccatacacccatgatgcacggcccgcaggaaaagtacccaggctgacgacagacctcccatggaaacagaagaggggaacacacaggagaacgacacgacgggactggacaacttgggagagcattaacaacaagctagagacaccccccaaaagggggcacatcaagagaagaaagcgaaataatacaccgaaaacaaaggagagccacacacattcacggaacaaaccgaccggagatacaaagcgccccatgggacacggaagccgtacagcaagaggaagagacaatacaaagagtgcccggaagaggacaaaggaaaacaaaggaagaccacaacgaaagaacaccctaggtgaaaaaacggggagacaacaacaacaacaaaagacacaacatgcacaaaagaaacaaacagaacagaaaggccgcgaaaacaggacgaccagaacagaggagaaagcaaggagaacaaaagtgagcaacaagaaggagagacaagagaaacggtaagaaaagaaacaacaagaaacgagaaacaaacggcagagagc

SEQ ID NO: 483332 - DNA, 252 bp, Homo sapiens
ccacaccagactatcacaggctgcatgagcaaaaaaacagcactgggtacaccggggagtccagtctctttgcccaactccagaacttcctgcagctcaacataaaagccctgggggagggtctaagggcttctcggactgactgcagagtttcccacctcctctggtgggccgaaattgtgtcctttcaattttctttagaaagttttgcaaatcagccaaacctagtggctcatgcctgtaatcccaaca

SEQ ID NO: 483333 - DNA, 584 bp, Homo sapiens
  misc_feature (276)..(276): n is a, c, g, or t
  misc_feature (486)..(486): n is a, c, g, or t
  misc_feature (503)..(503): n is a, c, g, or t
cacgccgcaccgccggttcaaaagccgcaatgctcgagcagcttttcggttaccacaggctgttgaactcgataaggttaatgcccgcatgcggctggcaaaactcggttgggtccgagtaagaatgtcgcgggacgtgtgtggaaagcttaagaacgcaacagtctatcgtgagcaggggaattggtttgtgtcattgcagaccgagcgtgatgaagagttagttccacgcacgggcactgcggtcggggtcgattttggtgctgtacgtgccgngacctcgacagacggacaaacgctagtgctagaagcgcgattaagcaagggtgccgcgcgcctgcgttacttgcaacggtgtatgtctcgtaaacagctgggttcgcgcagacggcagcgggcaaaagctaggcttgcaaaagtacatgcgcgcgttgtgcggattcgtaacgatgccatgcataagctgagccgagcgcttatcgaganacatgcggttgtctgtnttgaagacttacggattgcatgatgggcaccggccggcgcgcatatccctcagcctcagatcaacgcacatagttcatgca

SEQ ID NO: 483334 - DNA, 129 bp, Homo sapiens
  misc_feature (93)..(93): n is a, c, g, or t
  misc_feature (99)..(99): n is a, c, g, or t
ctcggtacctctccctactgtatctatacaaaatgcttcagatgatggtatctcatgctggtttattactcccctgctccttgggcaggtgancatatngtcccaggcatctaggatacagtagggaga

SEQ ID NO: 483335 - DNA, 191 bp, Homo sapiens
attccatcccgctccaccagtccacaccgcagcagcacgagtgagctcgagaccgagaggggaagagaggaggaagcgatacagtactacaggcaaccatggaggtggtgaccggcagcaacggcgggaggctgaacccgtgggcggagcccttcgtgccggggagctggtgccgccccgcccccgtgcag

SEQ ID NO: 483336 - DNA, 173 bp, Homo sapiens
atatcgtcgacccccgcgtccgaataaatttaagaactcttagctgggagaagaaagatccccggctttacccattgtaagataaaagacccattaattgccaataattccaaaagtaatttttttaatttattgaagaactcttagctgggagaagaaagatccccggctta

SEQ ID NO: 483337 - DNA, 493 bp, Homo sapiens
  misc_feature (469)..(469): n is a, c, g, or t
  misc_feature (476)..(476): n is a, c, g, or t
tattttctctcatctaaacaggaaaggctattcaagggctaacttcgaataaatgttatatcacaaaatgaagtaggagaaaagaattattactttggttcaagtcccaatcatcaggtgtatctaagctgtttgtgaactcaggattcatggtctaggtgatttatctttctctttctccattcccaggattgacaagaaaatagacagaattagccacaagttctatcttatcccctcttttatgcctgcaggaggagttctatggaatgcgtaaatgttagacctctagctacaattcttttctgcacttttcactctcagctgcatgtgaaagaaagtgacaaaaagaagctagtaatgttgtaggcagtaaacaaacaaaaaaaaagttcttttgttgttgggagaatggaaggaaaacctgccatgttaaattacggcacacacacacacatttaaaattacnttttgcngttaccaaattggagtg

SEQ ID NO: 483338 - DNA, 239 bp, Homo sapiens
actccggcctcgggagtggtaacagctgcggcaacaaggtggtgggtccagcagggtagcatggttgaagtcagcacatgtctcgatctctgggggtgtcatgtcacattgcaagtccagctacatcacgggacggtggacgcgcctgacgagacctactgtcgacgggtgacccgactctcggacctgcgtggctgctttcatgttttccctttaccacctgtccctacacaccactt

SEQ ID NO: 483339 - DNA, 419 bp, Homo sapiens
  misc_feature (101)..(101): n is a, c, g, or t
  misc_feature (170)..(171): n is a, c, g, or t
  misc_feature (181)..(181): n is a, c, g, or t
  misc_feature (184)..(184): n is a, c, g, or t
  misc_feature (205)..(205): n is a, c, g, or t
  misc_feature (393)..(393): n is a, c, g, or t
acgttcatccgggataagtactcaaagagattccctgaactggagtccttggtccccaatgcactggattacatccgcacggtcaaggagctgggcaacanctgggacaagtgcaagaacaatgagaacctgcagcagatcctcaccaatgccaccatcatggtcgtcanngttaacggcntcnaccaacccaggggcaacaagntgttcggaagaaggagctgggagcggctggaggaaggcctgcgacatggcgctggagctgaacggcctccaagcaccgcatctacgagtatgtggagtcccgggatgtccttcaatcgcacccaaacctgtccaatcattatcggggcatcccacgggcccgccaagatcatgggttgtgggccggcnctggaccaacctctccaagatgcccg

SEQ ID NO: 483340 - DNA, 307 bp, Homo sapiens
gagcggggtggggacattgctctctgggtttttggtttgggggcggctctctgctccttcactgtcccctctggcttcccatagtgtgtgctgtgagtggttcccctgtgcttaaaatggtgccaatgcccatctcatcctggcacgccctactccactgccctggcagcagcaggtgtggccaatggaggggggtgctgtgccccgagtgattcccccagtcaaactgtctttgtcaccactgtggggctcacgttttcatccgttcccgcaacttccctatgtccccggtacataggtttggaca

SEQ ID NO: 483341 - DNA, 1366 bp, Homo sapiens
acggatttgccgccagaacacaggtgtcgtgaaacactacccggtaaaagccaaaatggtgaaaggacaagactcatactcaccacttgtcgtcattggacacgtagattcgggcaagtccaccactcactggccatctgcatctcatacaatgcggtggcatcgaccaaatagcaacccattgaaaacatttgcagacaggcaggctagctgagcatgggcaaagggcttccttcaaagatatgcctggagtctatggaataaccgtgaaagctgagcgtgaacgatggtactcaaccatatgactatctgccttgatggaaacttatgagaccagcaacgatacatactgtgactactcattgatgaccccaggacacaagagactatatatcaaaacacatgcacttcacagggacatactcaggctgacatgatgctgatccctgcatctgtagactgctgcgatgctaggatgacatcaagaacgactaggcatatcatccaagaaatgggacacgaacccagagaagacactacactaactgaaacttaacaaaaaataggaatgtgcaaaaacaagcgcaactcagacacaggaggttcaacgaaacaatgagatatccaactaggaaccaaaccgtaacaggaacaagaaaagagatatagaggaacattgagaaaggacagaacaaaacacataaaactaacgaacaacaaaaggagattaacaaagaaacagaaaaccaaaagcaattgaagaaaccacacactacaagagataggcacaatggaagacgaaacacagcaagacagccaaaaaaagaaaaaaaagacaataaaacaaacaactgagacaagcaaaaccgataaaggaaatgacaagaagaaaagcacggcaagacacgaacgagagataaagagcacacagcgaatgaacaacacgtcaacaaccaaaacaacatcacacatgaaaaaagacaacaagcaataagaaaacacagaatatacacaacaaacacaaagaaaggacaaggacacagaaaacaagagggaccgactaaaaacagaaataataacaacaaagtgaggaggaaaaggaagggacagagcacaacggaagagagaagaaaaaaacgaaggatagaacaaaataagtagcgagaagacacaatgggaaaaacaggaaagacagagacaacaagacgacaacgccgcacgcagagccacgaacacataagttaaggaggaggagaaggagcgggaggacgtaaacgaggaagaatgagagaaagacggacagagagaaacaaagaggacagagaacgtggccggacaagctcggcgtctcgccagaccggagagg

SEQ ID NO: 483342 - DNA, 372 bp, Homo sapiens
aaaggagctaagtaaaataagctagtcacaaaatgacaaatactgtattatttcacctatatgaagtatccaagccaattcataaaaacagaaagaatatcgctggttaccagggacagataagaggagaaaggggaagtgtttaataggttgtttagtagttatagagtttcatatttgcaagatataaaagctcggaaaatctgtctcacaacaatgtgtatatactttacactactaaactgtacatttaaaaatggttcaccaggcgcggtggctcacgcctgtaatcccagcattttgggaggcccacgcgggtggatcacaaggtcaggagatctagaccatcctggctaacacggtgaaatcccg

SEQ ID NO: 483343 - DNA, 426 bp, Homo sapiens
  misc_feature (187)..(187): n is a, c, g, or t
  misc_feature (354)..(354): n is a, c, g, or t
  misc_feature (357)..(357): n is a, c, g, or t
  misc_feature (361)..(361): n is a, c, g, or t
  misc_feature (380)..(380): n is a, c, g, or t
catgggaaggatcagctgaggagtgaggatggcggcgattacccacagccttagcgtgacctgctcatttgcagcaccaaccaatgaaagtcaacagaaaatgtgaaaaatggcagtccatgccatgaatacacgtcatttgaaaaaagcgtccgcgggtgccactggcactcacacacacgccctncacttaatgtctccacttaataccaagaaccttcagttgagaatctattttattttattattattattattttgagatggaacctcacttcattgcccgggctggagtgcagtggtgcgatctcagctcactgcaacctctgcctcctgggttcgggccattctccngcncttnccccctccccgcagcaccntctctgcccgttcttgtccacacatctattaaatgcttctgttttc

SEQ ID NO: 483344 - DNA, 840 bp, Homo sapiens
tgagcgacgctagatgggccgagctcctccctctgctccagcagtgccaagtggtcaggctggtaggcgagctgtggcctcacggaagtcgacggggcaaggacatcagctctgcacttcgagtcaagcctgcactggtcagcagctcaacctgcgcatggaaggagctgggcgatgtcggcgtgcattgcgtgctccagggcctgattagagcccctccctgcaacgatccagaacgctgagcctccagaactgtgggcctgaccggggcgccggtgtgcggggtcctgttcagcacactacgcacccatggccacaccatgctaggagtctgcaatccttccagacgacaaccgtccttgggggatgctgggctctgcatgcatgctcttgcgaaggactccttggagccccgcagtgccggctggaaaagcttggagcgtggagtattgcaagccctctcggtgtgtcagttgtgatggccctggcctccggtgtctcagggacaagccggacttcgaaggatgctcacggttagcaacgatgacatcaatgaggctggcgtccgtgtgctgtgccagggcctggagtggactccccgctggcagctggaggcggcgtcaagctggagagctgcggtgtgactatcagacaacttggcgggacctgtgcggtattgtggcctccaaggctcgctggggaggtgggccctggggcagcaataagctgggtgatgttgggcgtggtggagctgtggccagggctgttccaaccccagttccaggtcaaggaccctgtggctctgggagtgtgggttcactgcccagggttggggggcct

SEQ ID NO: 483345 - DNA, 500 bp, Homo sapiens
cactgttaggcctttattttattttattttccatcgaaagcattggaggcccagtgcaatggctcacgcctgtgatcccagcactttgggaggccaaggcgggtggatcacgaggtcaggagatggagaccatcctggctaacatggtgaaaccccgtctctactaaaaatacgaaaaattagccaggcgtggtggtgggcacctgtagtcccagctactcaggaggctgaggcaggagaatggcgtgaacccggaaggcggagcttgcagttagccgagatcacgccactgcactccagcctacatgacaatgtgacactccatctcaaaaaataataataataacaatataagaactagctgggcatggtggcgcatgcatgtagtcccagctactcctgaggctcagtcaggagaatcgcttgaacttgggaggcggaggttgcagtgagctgagctcataccactgcactccagcctgaacagagtgagatcctgt

SEQ ID NO: 483346 - DNA, 155 bp, Homo sapiens
  misc_feature (29)..(29): n is a, c, g, or t
  misc_feature (60)..(60): n is a, c, g, or t
  misc_feature (83)..(83): n is a, c, g, or t
  misc_feature (86)..(86): n is a, c, g, or t
  misc_feature (90)..(90): n is a, c, g, or t
  misc_feature (109)..(109): n is a, c, g, or t
acagtaggggggctgagtggcccagagcnctgggggaaaaagaactcccctgccttgcgngtgtgcctaaacaccctgctccngcncttnccccctccccgcagcaccntctctgcccgttcttgtccacacatctattaaatgcttctgttttc

SEQ ID NO: 483347 - DNA, 1338 bp, Homo sapiens
aatcacagcagtcctacttcgtccgtatctctcccagtcctagctgctggcagtcactatactactaacagaccggcgaatcctcaacaccgaccgttcttcgaccccggcggaggaggagaccggcgattcgtataccaacacctattctgatgttgcggtcaccctgaagtttatattcttatcctagccaggcgttcggaataagtctcccatattggtaacttactactccggaagaaaaagaaccatttggatacataggtatggtctgagctatgatatcaattggcttcctagggtttatcgtgtgagcacagcatatatttacagtaggaatagacgtagacacgacgagcatatttgcacctccgctagccataatcatcgctatccccaccggcgtcacacgtatttagcgtgactcgccaagtccacggaagcagtatgaaagtgatctgctgcagtgtctgagccctaggattcatcttgtcttttcaccgtaggtggcctgactggcattgtattagccaactcatccactagacatcgtcactacccgaaccgtactacggtgtagctcacttccacgtatgtctatcaataggaagctgtgatttgcccacctaggagggtcattcctgggttccccatttttggggttaccttgaaacaagtttcggaaaccctaacaattaatattaacggagagaaatcacttcttccccccacaagttggcgactcgaaggcacgaggatgggagtaccaccagttaccgaagcaactaatgggggggactaccgggcaaatatagagcagctcggggatagatgcttcctgctgtctcgccgttgctcgcgttcataacactcactacactatctttcgtgtcatcgtttctattatgtcagatgatagaacagcgcataataatgataggacagggacggagagagagaggagacatgcaggcaggagaaggtcagcgcgccaacaggcgagaaggccgagaagtcaaagcggcggcaaagcagacggagcgagcgcccgcgcgcgagcggcgcgcaacaagcagacggagcaaaaccaggcgagtacaagcacccgactgcaccggggacagcgcggaacaagcaaagcgacaacacgacagaacagcaagcagcaagagacaaaacaggcgcaggacgccgcacgcagagagcgacgagcacccagaggagcgaagcaagagacacaagcaggaaaaacgacacgcaaagcaaagaaggagcagagagaaggagacgcagagaagacagcagagacgacagagaggacccacgacgcgacacgca

SEQ ID NO: 483348 - DNA, 125 bp, Homo sapiens
cgctcccgtgtcgcagccaacaggatttcaaattttatcttttggcggtatgcacttttaagcagtcaccccccaactaacacattattttaccctcccactcccatactactacaatctcatca

SEQ ID NO: 483349 - DNA, 165 bp, Homo sapiens
ccccttttttgggttttggggggggggggggggggccccggggggtttttttttccccccccactttttttttcccggggcggggggtttaaagtccaaaaactcccctttgttaaccaaaggggggggggcccccagggggcctttttttttccccccccctta

SEQ ID NO: 483350 - DNA, 240 bp, Homo sapiens
gtcgacggaaaggggcatctcagctggcccatgctgaggcatcccttccccctgagggaccagccacacaatggtatagtatagaataaagtttattcagggcatgtggaggggagttaagagggtaggagagacagagagaggcagagaagagtagagaaatagaggccggccatgagcacgtggatagagaaggggtaggggaatggggagagagggaccttggtgtatagcacgcca

SEQ ID NO: 483351 - DNA, 1044 bp, Homo sapiens
tggttttcctaaagggttttcctcaggggcttctcttaagtggctggtagctgctgcagtgctgcgcagggcctccggaaaattgcgcggattaaggccacacagcgtggagtgctagttctccagggaagggtgcttagaagcccagtttcagaagaaggcccaggttcagctttcgtgcaaaagggcgtgtcgtggtggtgcaggccagtgacattcgtgatatttggggaggccacagagaggagcctaggtgtggcccctgtgggtgtgcctttgaagttccgtggcgtgcagctctcccttcacgaggtgcctccggaacgaaggtatacgtgggggcgtggggcgcaggtctcgagaaggccacagggggggacgcctctgtagaggctttagaggccaagcttgggtgtgcgctcccgagagcttgttgggaacagatggcgcagcctgtgggacatttccaaagagcgggggatatactcttatataatcgcaacggctcttagagctcaagaggttctccgtgacacataggccacagggacaggaacagatttttccgcggggtgatgtgggtcttgtggaagggaggagattcggttccccgggaagttccggggaacacgtttttcggccccagatatgtggcggtaaaaccgggcgacagaaagaattagtgtcgggccacatgtgatgcccgggagaagattgcagatcttgggccggattcccgagtaagcggccttggaaagcaaccttttagtgtctctcgagcgcatcaggtcggggggggaccccaaggaacaaaggtcgagcagatttaaagacccccaggttacaaggggccacatggttgcccacgccggaaagttacagggggggaaaaaattcgctttaggccgccgggggaatggtgtgtgcttgttatgaaagtaagccaaaatctgggtgccacaatggtataaaaacgctgtagggacaacgctagaaagaaaaaaaatttcacagaacacgctaacaaatgtgggcaccttgggc

SEQ ID NO: 483352 - DNA, 912 bp, Homo sapiens
tacccttaagggaggaattttggatgcaaatgtttggcccctatggcgttggaggcccaatactttgcaataaccccgataccaaggtggcttatggcggtttccagcagcagcaggtagcttatggcagtggcagatagattttaaataggaaccaaagcttatacaggacgtaggagagtccagagtcattggacagggaagcttatacaggttatccaccagaaattgtgtgaacttctatgccaagtcacatgtgtgttggcactgggcctagctgtctaccaaacgtaacgaacatggtgtttagactaaataactccaatgtgctaatgggcacacaaaatctcgaggactgtaatttgtcgagctaacattgtactaaccaggtttattctctagttctcctggtctgtggaaagtgtaagcattccacatagggtttttatgtagattttttttttcagcacccgcagtgactgttagtactgtgctaaaagtgtaacacgatcgtagtatcggtgatcagcatcgaagtcaaactgtctctatttaaaatgtgcattgtgtagaagctagtctacatcttaaggccatcttggagtaagagatttccccaacaagtcgatgaagttagaattccttaccagaggtgatgccagggttatactcttggaaatttatagtacaatcctgcttgggtggagaagccacttgtcttcggacaaccttggtgtagttgaactgatagttatctcgatctgtgaccatgaagttcaccattataagggattacccaagcataaatccatggaagtgccttataaaatgtgattgttggcagcaatcctatgcaatatatctaaagttgaagtaatggtaccagataaaattcatagatgggaatgaagc

SEQ ID NO: 483353 - DNA, 665 bp, Homo sapiens
cggagccaaaggtactgtgaagttcctaaacatgtctctgccactctttgtctaaactatgtaacgtagatgcagctgactttgcctgtagccacatagaacccatcccatggctgcagaggaagcttgcggtggctctccagagaccagaggcatagtgaggtcccagggaggcttcctctgtcttgcaacagatatttgtgatctttctctatgtgcctattgtcacaacagagtccggcagcgacttctcttgagggagcaatttggagactagctggaacccagacgttcgccctggatgccatcctttatcatccacagcaatcccatctggttggtagcactgctatgggactcacactgtccctcctctatcctagggagcctgaggcccaggggtggaaagatccagttgcgagtggtgcgaagtgaaccgctcaggataatgaaagcaactagcttttgaaatgacctaccgatacccgatgactgagactgagactatctcagactgtcttctggcttatgtcagaacactccctgtactagaagtaccgcggtgatggtggtaatggctgtgtagacccttactccaatggggtaaagcactttaagttttggccgtccaatgccgttccacctttaaggagcatccggcctgt

SEQ ID NO: 483354 - DNA, 422 bp, Homo sapiens
taaaattggtttacctcaggatgattgatgtgcagagaatgggggaaggctaaactctgagacacagccccagaagtaggacagtcctcatcaagtgccccagtcccatggtgacagtgacaccctggtggcgagcccgagtgtgatggttcattgctgtgcgcattgcattggagtgactgaacaacaaggctgtcaccaaatcccacacattttattaagaaatgtttcctaagggagcatttttggactgtgttttaaaacctagtgaaccatgactcggagccagcagagtaggctgtgtctgtggacttgagcacaccatcaacattgctgttcaggaaatgataatttacgtccattccaagttgtaaatgctagtcttttatttttttttttccaataaaaagaccattaactta

SEQ ID NO: 483355 - DNA, 433 bp, Homo sapiens
cccgacatacagccctgactcaagtgagtccacctgcctggcctcccaaagtgctgggattacaggtgtgagccaccatgcctggcctcatatcatttataaataagagtaatttgactagttcctttccaatttggatgtctttatttcttccttatgtaatcgctctagctaggactttcagtactatgttgaataacagtattgaaagtgggcatccttgttgtgtttcatatcttagaggaaggcttttaatataatactaaatggggaaaacagtctgttatgggtctgttgtatatagctcttactgtgttaaggtatgttccttctataaccaatttttgagagtttttgtcatgaaaggatattgagttttatcaaatgctttctcaacatcaattgaaatgatcatatggtttttgtcttttat

SEQ ID NO: 483356 - DNA, 128 bp, Homo sapiens
tgcaactgcggacagccaagtctgtgacttgcacgtactcccctgacctcaacaagatgtattgccaactggccaagactgccctgtgcagctgtgggtagataccacacccccgacccggcacccgt

SEQ ID NO: 483357 - DNA, 1064 bp, Homo sapiens
aaactagcgtagttaggcctcgtttattgaagaggatgtgatctttttaatagggaggtgggaggaggatgtagggaggcatggtgggtgcttaattatcatttccaaggtgcaagtgtaattattcaaatctatacgtacatagttccaccattaggcacaagacaaaatactcatgctaagcaaaggaagagaaagacaaagacagtttagtgcatttactaaagcaacaaataattctccaaagaaggggatgaaaatgctagttcctttaagcacttacttgactgtaaagttggtccctgcttaaattcatacccatagtataagcgtcggtatgacaaccactgcagtgtgagcaaaggtgaatccgtgtgccatgcatggaacacctatgagaataccgaaacaccatcaacatccagccttgcttgatggaagccacacacgctgccagcccaaaagagtctgaacgcagaacgatgggctcggactctttaggctggcaaggctaggaacacacagtgaaccattcaatgtcacttgtgaatccgtaccctgataaaggtgaatacaacacattgtagaccaaaaaacaatcaggctttatacacattatcagggaaatactgaatgtacattgctaaataaagattgtatgaaggaaacaattcatctgtatggacagttacactcatattttgcttgtgttctcgttttcatcctactcaatgaatgagacaaatcaactggagcatattcatcttcatgtgcacaatgacaacgattctatggaggtggcaaaagatattttcaacaacatcaagacaagcataaggacacagaacgaagagcaaaaatatatgaacaaataaaatcgaaaagtacacaagcaaaaaggaaaaaaaaaaaaaaaaggaaaagaacacaacgaagacccagaaaggaatcaagaggggcaaaaaagagtagaaggagagacagacaagaaaaacaaaaggagacgaacaaaaagacgcaagaagaaaacacaaagcacgaggaacaaacccaaaaaagacaag

SEQ ID NO: 483358 - DNA, 246 bp, Homo sapiens
tctgctggataggaaggtgtcatccagcttcactgatgtggtcccctgaagtgtgcaaatgagggaggctcaccgtgctaaggatgagacgagtgctagtgatggagaggagagcagtctccggaagctcatctatcccttctccccttcataactcaagggtcatgccccttcctgatcttctttcttgactctgctctgtgctgcctcaccagccagctataccctgagctacctcctccagcc

SEQ ID NO: 483359 - DNA, 338 bp, Homo sapiens
gaccccggacccggacccaaagtggtatgatgtgtagcttgtgagggatacgtgtttacagttggatgagccaaccgtggactagtggccacctatctactagtagccaacatccccatagctgccaactgtgtgaaagtagcataccctggcctagtagccaaccgtgaaatagcagccaaccgaatactagtagccaaccgtggactagtagccaaccataaactagtagccaaccgtggactagtagccaaccgtggactagtagccaaccgtgccctagtagccaaccgtgtattagtagccaaccatagactagtagtcaaccaagctctagt

SEQ ID NO: 483360 - DNA, 389 bp, Homo sapiens
gatgaatggataaacaaaatgtgatatatcccacagaagggaatcctgttccagctgtgagaaggaatgaagtatggacatgtgcctataatgtggatgtgccgttaaagacattatgcctaagtgaaagaagcccagacacaaagaccatacatttcacgattccacttacatgaaatgtacagaatagcctaaatctaaggacataaagtaggttagctaatgggtacaggtttcattctgggttgatgaaatgttccaaaattgattgtgctgatggttgtatttaaaactctgcatatactgaaaaccatttaattgtacattttaaatgagtgaattgtatgctatgtgaattatatctcaataaagttgttcaaaaaaaaaaa

SEQ ID NO: 483361 - DNA, 448 bp, Homo sapiens
  misc_feature (26)..(26): n is a, c, g, or t
  misc_feature (37)..(37): n is a, c, g, or t
  misc_feature (48)..(48): n is a, c, g, or t
  misc_feature (437)..(437): n is a, c, g, or t
ccttgaaaccgggtaaattgagagtntccccagtccnggggaacaagnaaggaaaaaggatgaagaaaaattaaccagagccctaggagacccggaggacattaaggcccctcaatacaccccctaaagagccgtcctcagagaagagagagaaaggggtagaacccatgatttgaagaaataatggtgaaactttgcaaatttgataaaaaatatcaatctatacatacaaaaagctcaatgaactccaagtaagataaactagaatagatctgcactgagatacatcataatcaaactgttgaaaatcaaagacgaatagagaatctcaaaagcagtaagagagaagcaacttattatatagaagaaatcctcagtaaaattatcaactgatttctcatcacaaaccatggagccaaaggcagtgtgatgacatngcaaagtgctg

SEQ ID NO: 483362 - DNA, 598 bp, Homo sapiens
agggtgcagtttggcataggccactcgtggtgggtgccgggtgcaagcctccagctcaccacgagtggcctatgccttacctgtcgccatagggtgcagatttgggatgtacgcgctctacagcaacgagatactgcctacgctcctgatgccctagactgtcaacgctatgcggcacacctatcttcaagtggacaatgcacgtcgaagcagctggcgtggagccagcgtgcgcacctggcgctcctcacctgcctaagagccgcgatccacgacgacgatgtgtgcagacgtatctgcagctgtcgttgcgtgcagggatgcttggcatcggtggcctgctgggggcgccccaccgcgaggcatggctcatggttgcgctcgtcgggagggcccaggagccgttggtgcgctatccgagctgcgtgcactggcaagcgcaccttgctaggccactggatccgccatcccacgggctcgttgacttgttcacaccctcgagcggcgcaccgcgtggtgcaagctaggtgctgacaacggatcgacgtcctgtgggcgcgcgacttggtgtctgccacacagtccgctgcgcccgcag

SEQ ID NO: 483363 - DNA, 653 bp, Homo sapiens
  misc_feature (593)..(593): n is a, c, g, or t
  misc_feature (606)..(606): n is a, c, g, or t
ccagcagctcacactgaagaagcatccttgcttgggtttgcagtcttctgcggcaggcattctcggaggaaaccagccaaggactaactacgaccatgagattggcagtgatttgcttttgcctgtttggcattgcctcctccctcccggtgaaagtgactgattctggcagctcagaggagaagctttacagcctgcacccagatcctatagccacatggctggtgcctgacccatctcagaagcagaatctccttgcgccacagaatgctgtgtcctctgaagaaaaggatgactttaagcaagaaactcttccaagcaattccaatgaaagccatgaccacatggacgacgatgatgacgatgatgatgacgatggagaccatgcagagagcgaggattctgtggactcggatgaatctgacgaatctcaccattcggatgagtctgatgagaccgtcactgctagtacacaagcagacactttcactccaatcgtccctacagtcgatgtccccacggccgaggtgatacttggcttatggactgaggtcaagtctagggtttccagtttctgatgacatatcctgatncccagatgagggnctcacctctcaaatgaagagcggtgagtctaaggagtccccgatgta

SEQ ID NO: 483364 - DNA, 182 bp, Homo sapiens
  misc_feature (139)..(139): n is a, c, g, or t
  misc_feature (181)..(181): n is a, c, g, or t
ctctacggctggttggtgtaaggagtgtttcaccacacggagatgtggtcacgtaacttgtcaactttaacccaggatgtctcccttctaacttccccttagcaaccaagtcgcggcgcttggttccccagcaaccggnagacgcgtctgctgcgtggaaccgccgagttcccagcgcttna

SEQ ID NO: 483365 - DNA, 147 bp, Homo sapiens
gactctccaggcaggaagatgtactgccttccccgtatatgccatccttcctcagtgtatgctctatgagctagtgttattgccattgatcaggatggtgcctaaccaggctcctcgaattcctctgccagtctctgaatgacaaga

SEQ ID NO: 483366 - DNA, 406 bp, Homo sapiens
  misc_feature (207)..(207): n is a, c, g, or t
cgtcatcagaaactccgctgcagcagtcacaaaagataaaacacacaaccaccaggtcatcaccaactccactgccaggcacatgcgaaagagctgaaagcagggtctgaagagatttttacgcccacgttcacagcagctctattcacaattgcctagaggtggaaaccacccaagtgtccacccacagatgagggaaacacccanatgcagctgctccacactaacaaatattgtgcaatctttttttttttttttgggagacagagtctcgtcctgcgacccgggttgtgtgcacagccggggttgcacactcaggccgcaccatttgagccccctcttcgtgagaggcaggccacagacgggcccgagggccagtgcagttggcaccaggaggggggctcag

SEQ ID NO: 483367 - DNA, 1278 bp, Homo sapiens
  misc_feature (711)..(711): n is a, c, g, or t
  misc_feature (1278)..(1278): n is a, c, g, or t
ggtccagagcagagtcagccagatatgaccgagcgccgcgtccctgttctcgctcctgcggggccccatgctgtggacctcgctttctcgcgtagctggttacctcgcattatgcgcgccatcttcgtactcaggaccttctggggctgcctcctgtgcttgcacggaagcgactgcgtggcacgcctggttatgtgcggcatgccatgctggtgccaggtgctacctgtgcgaccctccatgcacccgccagtcggctctatcggatgaggccgccggcagctggaccgtcgccacgcctacgatggtctgtcgctgcttcacgtccaggctagatcgtcaagcatgtcggtgcgtctcggcgagataccggctacacttgcggagccgactgagctgccgtgtcctcgtggattgtcgagaccatccgttcgccacccggaacgagggtctgagacggtcacaggacctacagggaactggctgctgtgtggaggactcaccccgtgcgaatgccacgacgtgacgcgcgacaggagctgaagcacttggctatcacttctcccaggtcgtctttcatcgctggacaatacagtcgctggtcccaccggtcgtgtgtacgcccacccagagttgtgcctacctcccgtgtgccgcctgcagaggcacatctagaccagtggacggccctccaatgcccataggcatagngcagcgtcgagtccaaccgagaatcatcatcaccagtcatccttcgtagtcagcagggcccagtcttggggggcccaggaagctgccaaaatccgatgagactgtcgcgccagtaaagccttagccctggatggccacccttgttgtcgccatgggtgtgtctccatgaccacctgtgtgtccttcgctacgtgtatcttcctggtttctcacctaaagtcaacaggagtacaacaaagggaatgccgggaagttctcaccagaaatatcccgggcttattgactcgggagaaaaagggttcagaagcggccactaagtcctgctcccctgctttgtgataacctgtggaaaatcgcgccccaatataaggggggacaaaattgaaagacagctgagagaagataaaagaagaagaagagggattcacagttaaaagacccaaaggaggacatgcacacaatgctaaagagaaacgtacctcagacaacactatgcagaacgacgacaaacgaccaataacataagagacgatcacacacgacgaatagcatactatcagacaagcn

SEQ ID NO: 483368 - DNA, 428 bp, Homo sapiens
tataacaaggcactcacaccgatgacgatgagattaactgtcacacttttaatgaaggttaattccaaagcaatgaccataatcacgccaaattttatcagtgggttcatgatgcgtcacctcgaaaagttagttgctggtcttcaaacactaagtggtagtcaaaccaatccgttactgcgtgtaattgatggctaatcatcaccacggtttggttttgcttggtggtcatgtcagcgatgacagctaacagttgtgcctgtgacgcactgtccaagccagccaagggttcatcaaataacaaaaccggcgtgccagtcatgagcatgagcaatacttgcagttttttttgttgccaccagataattggtaacgatgtgctcacgacatgactcaaattaagctgtaccaagatgtcattgagcaaa

SEQ ID NO: 483369 - DNA, 514 bp, Homo sapiens
tgacttctttcactctcgttgtctgatagctgccctgtgaacctacctcaccagctcttcctacttagtctaatttccagtcaccttttgaacttgaaaataaggcttacagacaaacagattacgcacatgacatttattttcaagttgcctactttttcaggccacttgtgtccatgggttaggaacatggaacttactggtaccctttgcactgggtctgtaacagtctcttccagatagacatgggcccgcagtaagacacattgatgaagaataccctgtgtttccctcctgctaattttctcatagtaatgcttttgttttatagataagaataaggtgagaaacttaggaagcctacgttaatatgccttctgttatatagtttttaatggccacacttggtggtttatatcggaacttgttttgttgttgttaaactctgtgataattcctgaaggaagtgggacaggtcttcacaggagggggagtgggggttgaactgtgcaca

SEQ ID NO: 483370 - DNA, 335 bp, Homo sapiens
  misc_feature (19)..(19): n is a, c, g, or t
acaaaaagggtttttttcncccgggcccctttttcccccgggggggggggggggcttttttgggaccccccccggggttttttttctttcccctcccccaaaaaaagggaaagggggtggccggggggggggggggcccccccccgggtttcggggggggggttttccccccctttttggcccaaaatttgacttttgggggggggggccccccccttccattgggcccccccagggggcgggttggttcctttccccccttccccgggccccccccggggtttttccagggggggggtaaagcctttttttttttttttttttttttcctttta

SEQ ID NO: 483371 - DNA, 229 bp, Homo sapiens
agagtgaaactccatcttaaaaaaaaaaaaggcccttacaagtgtggactgatggcaagataacaccccgtacaaggtggcactgaagataaaagataaaggttaggcctggcaataggcaacgtctgggatgccctatttttacctttacttccataatagaataaataggcctcatatggtaaggtgcggcagcacttttgtaaggcttaaactggggaaagcatct

SEQ ID NO: 483372 - DNA, 942 bp, Homo sapiens
  misc_feature (292)..(293): n is a, c, g, or t
  misc_feature (296)..(299): n is a, c, g, or t
  misc_feature (302)..(302): n is a, c, g, or t
  misc_feature (310)..(310): n is a, c, g, or t
  misc_feature (313)..(313): n is a, c, g, or t
  misc_feature (315)..(316): n is a, c, g, or t
  misc_feature (319)..(320): n is a, c, g, or t
  misc_feature (325)..(325): n is a, c, g, or t
  misc_feature (328)..(328): n is a, c, g, or t
  misc_feature (330)..(333): n is a, c, g, or t
  misc_feature (340)..(340): n is a, c, g, or t
  misc_feature (348)..(348): n is a, c, g, or t
  misc_feature (353)..(355): n is a, c, g, or t
  misc_feature (361)..(361): n is a, c, g, or t
  misc_feature (371)..(371): n is a, c, g, or t
  misc_feature (393)..(394): n is a, c, g, or t
  misc_feature (405)..(405): n is a, c, g, or t
  misc_feature (411)..(411): n is a, c, g, or t
  misc_feature (413)..(413): n is a, c, g, or t
  misc_feature (418)..(418): n is a, c, g, or t
  misc_feature (430)..(430): n is a, c, g, or t
  misc_feature (439)..(440): n is a, c, g, or t
  misc_feature (456)..(457): n is a, c, g, or t
  misc_feature (460)..(460): n is a, c, g, or t
  misc_feature (466)..(466): n is a, c, g, or t
  misc_feature (470)..(470): n is a, c, g, or t
  misc_feature (472)..(472): n is a, c, g, or t
  misc_feature (476)..(476): n is a, c, g, or t
  misc_feature (492)..(492): n is a, c, g, or t
  misc_feature (508)..(508): n is a, c, g, or t
  misc_feature (848)..(848): n is a, c, g, or t
  misc_feature (932)..(932): n is a, c, g, or t
cccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactgtgtggcttaccacgtggagtctaaggtgtatgctgtggccaccagcaccaacacgccgtgtgcccgcatcccacgcatgactggcgaggagaaggagtttgagaccatcgagagagatgaggggtagatnnagnnnnagnaggagggnttntnnatnnaggtnatntnnnnggtgagntgggaggntattnnnaatggnaggatggagntggaggagtgggaggatgtganntggatgaaganagtgtntntgggnagtgaggagacngtgtcgggnntcaaaggctaggtggnngcngggacntggntnatgnagggggaggaggtcangtgccgagggcggatnttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggcagaaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccntggaggtgtacagcgtggacttcatggtggacatgccagctgggttttctggtgtctgacgcgaccgcaactcatggtgtaatntactgcccga

SEQ ID NO: 483373 - DNA, 935 bp, Homo sapiens
  misc_feature (629)..(629): n is a, c, g, or t
gctttttccgctcggtgttttcctgcgcaggagccgcaggccgtaggagccatgggcccagccgaatgcatggtcttgaagccccacttccacaaggatggcagcggcgcgtggccaccgtgtttcaaccaagcgcggcccggtaagatccgcagttgagccctgcgcctcgggggcttgccccgtggggctccgttgcccggggttgcgccttggggtgggcgggggtggggcccgattgccaaggctggggggggggcgctgtgttcttgggaaacccggtcgggggaagggtttggccttggggggggccttttaagggcaggggcttgaccggcggcgggcgatttcgttcttcacaacaaagaaacgttagggccgggcaaaggccaaagggggcgcctggacggtaaattcggcccgcggcgacccgcggggtgtggggtgtctccccaaactgcgtgcccccagtcggtgggggctgggcccaccagtggggtgggcggtaccccaacacgcgaaaggggtggccgccagacacggcaagcgggcggacacaccaagccagggaaggggaagcacagggggggccggggcacattccaccaaaagagggggtggccgggganccaaatcgggcattctgttgggaaccaccgacggagggccggaacaccaaaggtccaaagaggagttccccgtgaggggcacaacgggggtcgcaaggcgggttcggacagcagagtcccgggccaaaaacgtcaattccttttgccacagaggagaaggccttgggacccccatagaagggggacacacaggtcgtgctggacagaaactggaacgtgggacaccaggcttgaccgcagcccggtgatgtgccggcccgggaagcgacaacatcaacaggacaaagcgcgacgacacccactgtg

SEQ ID NO: 483374 - DNA, 552 bp, Homo sapiens
  misc_feature (189)..(189): n is a, c, g, or t
gtttgtgttttggggcgaaaggcccagctcaccattgcctttggctccctgtgggcgccatgcctagggggcatatctttgtctgcctggaggaaaagccttgaacccgtggcaagttgggccgggcctcaggggaatatgcccccgtttttttcccccacccttgggccaaaaagacccgtgttaagntgccccccgggtcccaaaaggttttttccccccccccccaaactttggttgggttggggggtggggggggcccaatttcacaacccctttttaggggtggccggggggccccccaattttaggcaaaaagggacttttggccccgggttcgggggggggcccttattcctttggggccccctttttgggggggcccccccccgccctttggggagcccccccccctccccaaagatgccccttttggcccccaagtgggtttttttttttccccccgggttgggggtttccgggggacccaacttttgccggggaaaaagaacttgtttttggggccccctttaagttttttttttttcccca

SEQ ID NO: 483375 - DNA, 200 bp, Homo sapiens
gcataagaccctcttgtttaaaagagagtcaagtaggtaaccaaagccaagctcttttcaaggtgctttggagttgtaaattgaggagtgccatccttcctgtcttgacccattcttgtttgcaatggtgaagaccttcaataacctagccttgcagggcccgccacacacaccctggagtcctagagttggaggaccct

SEQ ID NO: 483376 - DNA, 177 bp, Homo sapiens
ttttaaaaaaaaaaaaagacaaatgtttttttaaaaaaaagcaccccccccccctgtttctgtatatagtcagcttatctcgtgttcaatcgtcttatctctacagagagaagtggaaaattctttttcaagggggggctttgctttccctttccaataaaggtgtgggaagcttca

SEQ ID NO: 483377 - DNA, 1427 bp, Homo sapiens
  misc_feature (1)..(1): n is a, c, g, or t
ntttcgacaggaagatgggatgggttgttgcacaccgccacaagaattggtggtgtacctctcccttctttcatagggtaacaatttgtgctaacgaggaggatgtgtcttaagttgtggacatagtaccgacacctcgtcgctcgacgatagatggtgggggggtacactctccccctcgccttccgtaggctgtttgtgtgtggggacgtcgcccccagatgaagtctctgcctgttttgtaggaactccgcctttgtggcgcacaacacacaatgtttggtcactcatggggcctttgtgtagtaaaatatttggtggcaagagtgtctcctccacgaaaaactatttatttgacgtgcgcggtgtggtgccttgtggcccaagtggagaagccgtgttggaaaaagtgttcctggtgagtggttcgtccctttatggtccactacctcccgtgggtggtgtattgatcctcagcccccctcttgtgagatcccctgtggcgaatactgcctcatcgtgggcagccgtctgccttctggatctgcctccctccctctctggcgttatggcggccgccttcccctgtctctcattgtgtcgatggccgcaagcctaatgcgtctagcaaggcgggcaatttcactccacgggagactactcccacaatagggagagagggtctttctctgagatgagcgccctctccccctttcacagagaaggatagagtgccccccggtgagccaccccccccccttgtgtagacacgcgggagagtttcgcgagtgaagcgaattttttcgaagaggagaggaaaccccaccacttcccccacatataggttcacctcgtggtgggccacattctataccacgctcttgtaaaggggtgtccacgcgcgagagggcgacactatattctctctatattggccccgagagggtggtaatagaccctccaagtgttttattggagaagaaagaccaaagggggagccgcgcgttggagccaccggtgtgcacagcgccgcgagataagaagggaaggccgaaggcgcgtgacacgtggcccacaccctccttacgctcgccgaagtcacacgcctcacaattgagacaccctcgccacgaagaccgggaaagaaggggggctttcggcttctgcttttgggccccgcgggggtcccacggagcctatggcacctttatatttttgaaccccgctggcttcggctgagagcccgtgtaacctcgctgccccctccacccccccaacccacgtcctatcctgtcaccacccggagcggagaccccctgtgccttttaaccactcgttccacccacttgatgtacatactcattttttacatcttttttttctgcccctctggctccggccctccttcgttttaaaccaaaatggga

SEQ ID NO: 483378 - DNA, 364 bp, Homo sapiens
atcaccgcggggggagaggttctatagggagctgagggtgcaatagcaccccagaccctcccaccaggctcaaggggctctaaagccttcacttgtggttgagagtcctccctccctcctgccctcttctcccgattagctgggattacaggtgcctgcctagcacgccccagctaattctttgtatttttagtcacagatggggtaacactgtgtaggccaggctggtcttgcaactcctgacttcaggtgatctacctgcctcggcctcccaaagtgctgggattacaggcgtgcagttaaaccaggcccagcttacctcattttcaattcagatagctgctctgagcagcagggacagaca

SEQ ID NO: 483379 - DNA, 249 bp, Homo sapiens
ggatgtagaaatccctcaaacacactgctgtgttctatgctagtgacactctcgatcgtagaattgtattacttgtggttgcagcgagccgagattgcgccactagcctggggtgacagagtgagacctgtctcaaaaaccaaaccaaaaaactgtattacttgtatgataaggaaaataatcaaatttgtgtatgtgggtgggtttgtttagtttttctgagacagggtcccactcatgtcgcccagg

SEQ ID NO: 483380 - DNA, 211 bp, Homo sapiens
tactgcccaacaatatttgcatgttgtagctcggcacacggaccattgaccatttcggtccattgttcttttgcgtaattcggtaaaaaatttgggacgttccagcaaaggatttttgcggatcccgtggcctcagccaaaacgcgatcattaaaagccaaccagctgatttccacgattgacataaattttggggttgtttcaatcaacc

SEQ ID NO: 483381 - DNA, 534 bp, Homo sapiens
  misc_feature (23)..(23): n is a, c, g, or t
  misc_feature (350)..(350): n is a, c, g, or t
tcaacgctttatacttcctcaangctatactttctcaacgctttatacttcctcaacgctctatactttctcaaggctttatacttcctcaacgctttatactttctcaacgctttatacttcctctagatagtcaagttcgaccgtcttcccagcgcagaaaggctgaaaattccaaaaaccagaatgcctcttctcctccaaaggatcataactccttgccagcaagggaacaaaactggacagagaatgagtttgatgaatggacagaagtaggcttcagaaggtggatattaacaaacctccccgagctaagggaacatgttctaaccaatgcaaggaagctaagnaccttgaaaagaggttaggggaatggctaattagaataattagtttagagaaaaacataaatgacttgatggagctgaaaaacacagcacaagaactttgtgaagcatacacaagtatcaatagctgaatcaactaagcaggagaaaggatatcagagattgaagatcaccgtaatggaatgaa

SEQ ID NO: 483382 - DNA, 407 bp, Homo sapiens
agagggttctggatctcgagcaagaaagaatacaggtccaagtgtaagcaagtttgttaggaaggtaaaggaaaaaaaaaaagaaagtaagggaagaaaagaagggctattccatagacaaagcagccctgagggctgtgggtggcccatttttatggttatttctggatgatatgctaaaccagggggattattcatgcctccccttttaagaccatagagggtaacttcctgacatcgccagggcattcgtaaccggtcagggcgctgataggagtatagtagtacggcataccagaggtctcttccagggccatctgggtttgggggggattaagccggcttatttacggcaaccggttttatcaccaaggtctttatgacctgtatcttgtgcctgccgaaat

SEQ ID NO: 483383 - DNA, 248 bp, Homo sapiens
attcggcaacatagtatacctgaatactgatcacgcgcagcttgaatgcacttacttactatgccgaccggcagtcgaaaacccaacgcgcgggatcagaatcgtagaatactgtggatgtcttgagggtcatgaggggtaccgccctagattgcagcgttcgtggatgatgctggtgtgaccagcatttactatgttggttgtaaaacaatgcttttctgactccagtattctctccacattcgtaa

SEQ ID NO: 483384 - DNA, 785 bp, Homo sapiens
catgacccaatgcagcgcaactaggtctacaataaacgtctacttccccttatcatagaatgagcttcttcacctattcatgatcatcgacccatcagtaatcatttcttccttcatctgacatatcctacctcctgtatgcccttttcttaagaactcactaaaaaatactaatctaatagtaacatctcgagatcgtctcagcgaaataagtacaaccgtcatgaactatctctgcactctgccatcatccctagtcctcatcgccctcccatccctacgcatcctttacataacagacgaggtcaacgatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcctaaaaacagatgcaattcccggacgtctaaaccaaaaccactttcaccggtacacgaccgggggtatactacggtccaatgctctgaaaatctgtggagcagaccacagtgtcatgccccatcgtcctaagaattaattccccttaaaaatctttgacatagggcccgtatttaccctatatgcaccccatctaacccctctagaagccaaaactaaaaaaacaaaaaaaatatcacact

SEQ ID NO: 483385 - DNA, 460 bp, Homo sapiens
atggccggcggaaagagagcgaatggttttttttctggatcatgagctccatgaggaggaggcccagtgggtgaactatcatgaggatgagctgtgtgggaaagacgagccagccttctggatctttgacaccctgatcacacatactaatgaggttctgtgtccaattagagaaaatcagaggccaacgctactcgtgtagacatatagcaaaataagcgctctccgagtgctaatgattgtttctcacaaatataacctgcccctgcagaccaagctattatctcaccctgcacctatagggtagaaattgctttcctggacttgacaaccctgcctttatgattgggttaagaagttacagggggccttttccagagtttaaaatgacggcccctttttttcccaaattaaaaagcccaaaaatttcacgttttggcaggaggctgtttaagatatc

SEQ ID NO: 483386 - DNA, 176 bp, Homo sapiens
tcataaggcaggatgaaaggactgtgaaccttcgtgtttgataccagtctgggctacatggcaaaaccctccctctaggttcaaaaaaaaacaaattagccagacatggtgtcatgcacccgcaggtcccatgctacattgtgaggctggggcacggagaatcactctgatcccag

SEQ ID NO: 483387 - DNA, 383 bp, Homo sapiens
ctgtgcgtacagcgccgggctcaaccccaacatcgacgcgctcagatggcgctggtatatgcgcaggggatgttcgaaaacgcgcagggcatagacatccgcagctcgtacctgaacgagctactgcagaagttgcgccagctagcgtacacgagctgatgatgtgcttgacgagctggtgtacttccgcatccaggacgcgcttgaaggcacctaccatgccactgccgtttatgatccaggctgcaatcgacggccttgttgtccacgttccccacatcgctaaagatgtcgccagtacactcaagctcccctcatgctcatgtgctgctagcagtggtgatctcgacgaacgagaaaatggtggcacacagggatgcctc

SEQ ID NO: 483388 - DNA, 180 bp, Homo sapiens
tgtcttacggctacggagtgtaaacctacttttatctgcactgggaaaccaaaaaatcatgttacttactttattgtgatatttactttattgcagtaatctgaaactgaacctgcagtgtctctgaagtatgcctgtgcatattgtgatatgattaccacaataagtttagtttagatc

SEQ ID NO: 483389 - DNA, 255 bp, Homo sapiens
ggtcagcgagagtcgagactgccttcatggcagctccgtgtctgggtgccccgggtcaggtgggtgggtgggggccatcttgccctgagcacaggctgggagggagtggagggatgagcaggatgggatgggctgtccctcgggtttggtatatttgctcctagagcagcccaggaggcacggtggctctgaagcatcactcacttctgtcccgttcttgacagcgccattcgcgaacgatttcccagtgcttca

SEQ ID NO: 483390 - DNA, 293 bp, Homo sapiens
ggtcgacaacttttgggccaggcatggtggttcccgactgtaataccaacactctaggaggctgaggtgagaggatcccttgagcccaggagtttgaaaccaacctgggctacatggcaaggctccctctacaaatgtaaaaaaaaattagccaggtgtggtggcatgcgccatgtagtcccagctacttgggaggctgaggtggaggactgtttgagcccagaagttcaaggttgcaggagctaggatcgcaccactatacaagcctgggtggcagcaagaccctgtttaaa

SEQ ID NO: 483391 - DNA, 339 bp, Homo sapiens
  misc_feature (86)..(86): n is a, c, g, or t
tctctaccgcacgctaagggggttgaggcgtacatccagggggcaagacaggaggaacggactaaggcatcgaggcatccgggagngcagaaggatgtccctagtagccacagacgtttgctccaaggcctgtacttccctgtcatccagcacgtcatcaattatgacatgccagaggagattgagaactatgtacaccggattgggcgcaccgggcgctcgggaaacacaggcatcgccactaccttcatcaacaaagcgtgtgatgagtcagtgctgatggacctcaaagcgctgctgctagaagccaagcagaaggtgccgcccgtgctgcaggtg

SEQ ID NO: 483392 - DNA, 128 bp, Homo sapiens
cctggccaggtcctggccaaattcgatgtcgaaacccgtcaggtggtcgtcttgtttgaatgcgtacggcgaattatcagcctgtacggcaatgcgcagttcgccccggtcggcgatttcgtcgatca

SEQ ID NO: 483393 - DNA, 100 bp, Homo sapiens
gtcatccctgtcatttcccacacccaattcggcttcttcctcttcgcaaaagaggggccacctcattagatcactgaaccaggaactttttgcacaaatt

SEQ ID NO: 483394 - DNA, 350 bp, Homo sapiens
  misc_feature (103)..(103): n is a, c, g, or t
  misc_feature (147)..(147): n is a, c, g, or t
  misc_feature (183)..(183): n is a, c, g, or t
  misc_feature (246)..(246): n is a, c, g, or t
  misc_feature (259)..(259): n is a, c, g, or t
  misc_feature (308)..(308): n is a, c, g, or t
  misc_feature (316)..(316): n is a, c, g, or t
tagtagacacggggtttcaccatgttagccaggatggtctcgatctcctgacctcgtgatccgcccgcctcagcctcccaaagtgctagggttacaggcgtgngtaccagatatttttaatgatttaaaaagtgaaaacagcatatnatggttctctaaatatataccatttccattgctctntctgcattcctgaagttccaggttccctctggtatcattcccttcaggctaaatacctgtctntagcatgggcttntaaagttggcaggtgaagcactttggggaggccaaggcgggcagatcangttgaggncaggagtcaagaccagtatggccaacatgggaag

SEQ ID NO: 483395 - DNA, 785 bp, Homo sapiens
gcgccactcgggagaggctgggtgaggcgccgtgtgagactgaccctggatcctcgaaatgcattgtgatcattactctgctctttggaaatggctgtatcattattggtactaatgtgaattgttcctcagaaacgcttcttttccatcctaggtgagaagctggccctgcaggtggtggcagcaatggtgtgtaagatttctctcccgtagttatattctcctcatggatttgactgaaagtgccaataacacgtccactttcaacgtgtagtttacgcggagcactttcgaggcctggcgggattgggcctacttctcacctgggcctatcttctgaactcgctaggttcttatcaacattggagggataacttcgtatatgttttcattgggcatatttctttaccagtttctgattattattctcaatatattttgctaaacctatttcacaaatcaccaccgactgaagtgtgtgttaactgactgcggacctgagactccactggcgaacggagtgactttgcaggacgtgagaccgcagtctgctaacagcacaggcacagtgacacaataagggagccccgacaagggcgctgcaggccccggggaccccagacacgtaggagtctaaagagaagacggagtctaggctctcatgccacccagaagtggccaccacacacagaaatcagcggggcctggtcgatcgacgaagcacacacacggagaacaccagctgcacctgccaaggaccgaccgcaaggtgaagcaccagcaga

SEQ ID NO: 483396 - DNA, 381 bp, Homo sapiens
aagagggaccagtgttacagatggctgtaaatgacgagttgagtccttcagtgtctcctaatactcgcaggtccacctcagaccgcaggtcttcataagctgagatgatcagctggagaatgattccggagtccttctgaagtagacctactcgagctccaggaataagttttgcgtgattcttatataaatgaacttggtcttgggttacagcgaagatcaataacacgttggtttgtaccagtttatcaatgaggtgtccaattggtggatattccaagacaggtgacatggagtattcattcttgctgcccaagtgacagagcccggcattaggaatgacgatgcctgcttgtttgctgtccattccaaaatgaggat

SEQ ID NO: 483397 - DNA, 1114 bp, Homo sapiens
aagatggacctgacaaggccaggcatggtggttcaacagcactttgagaggctgaggcaggatgatgcctgagcctgggagttcaaggttgcagtgaactgtgatcacatcctgccttctagcctgggtgacagagcgagaccctgtctcaaaaaaaaaaaaaaaaaaggaaaggaaatttttttttgaagaaaacttaaaggtcgatgtccccgatacacgttgaaagagagaggcaatgagacaagtatttgcagaagttggaagatacgagtttctggacacagggagatggatataaatatgtgtggactctgtgtattgtagtaaagaggctaaattattgagggtgtgacaaaaagtggggctgacggggaacactcattgcgcgtggagaggctccaagccatcacaaaacagagaacaaggcggccatgagtggaactcaaagcacgtgtgagaagggggcttatccagaaccgtggacaggctgcagagcacaatttgcaaaaagaacctacaaagagtgcaggcgccggacatctcacgagagaacaccgcagagcatgataacaagaggctcccacgagacagacaagagaaaagtgactcgggggaaaccgtaagaggcgagggagcgacaagaggcccagagcggaagacaaaagagggaggaagactcccacacgcggggggaaacaaacagggggggggtaagaaacaacaggggggggacatataagccgacagcggagggggagtggaacgaagaagacgcggcacaccaacgagagaaagtggccagaagggctgcggcgccacacatcgggcgtcgcagagagcaagaagaaaaggccgtgatcaaaaagagcaaggcgaaacaagggtgtatcgcatattgggagggagaagatacgtggtgtagagcgaagacccaccgccaccgatgaagcgagggagacccccggggtgggcaaagcagggaagaacgtactaccacgaaggagcggcaccacatacggtggggagcgacggagagaaaacaggaaaaccacacacgacgaaggatcgagtaggcaaaacggcgacgaggcgagacaaaccaggagacagc

SEQ ID NO: 483398 - DNA, 654 bp, Homo sapiens
actgctctgtacgccgccatggcccaatgctgacatctgctgctgatctggattggccgtcatgggccagaacttaacttctgaacatgaatgaccacggcatttgtggtctgtgctttaatatgtgactgtctccaaagttgatgatttcttggccaactgagtgcacagggaaccaaagtggtgtgtgcccagtccctgaaagagatggtctccaagctgaagaagccccggcggatcatcctcctggtgaaggctagggcaatgctgtaggatgattatcatcgatgaaattggtaccattgtaggatactggtgacatcatcattgacgtgaggaaacttctgaatatagggacaccacaagacggttgccgagacctcaaggaccaaggggaatttcatttatgtggggagcggagtcagtggtggagagtgacggggcccggtatggcccatcgctcatgccagtgagggacaaagaagcgtggccccacatcaagagcatcttccaaggcattgctgcaaaagtgggcacttgttagaaccctgctgtgactggggtgggaagatgagggaagcatgtccacttcgttgaagcataggtgcccaagggcaaatgagactggggacctgcgctgatctggagggcgaa

SEQ ID NO: 483399 - DNA, 802 bp, Homo sapiens
gttgccttaattatcgtcgcttcttctgttctcctcgttccggttagttgcccccgccctcgttttttttcttcggctcccccccccgtgggggggtgcacccccccgatatatatttcgtcccgacatactcgtggggggcgcctcttcggggcctcttttggaccacctgtgggggacaccccgcttgtcctctgtggacccgtgggggtgtctttgccccccttggtctctgccccgcccctggggggaccaccaaaccgcagcggtggttctcaccagagtgccctccccccctggggtgcacactcgcccctcatgcgaggtttcgtttacctctccgcgcgggtgcaccacccccacaaatgtgtctcactagttccgggcatattccccgccgcgttatactccttcctctccgatatgtctcgtctggtagtgattccccgcgctgtggttgacacacacgcgccccctttgtttctctggggctgagagaccacatcccccctgtcccactctttgtgtgattgagatctccccccaatagtttctctccccccgcgggggttttaatatttgtcctagcccggcaatatgatgccccggacgttgctccagcgtctgcccctgaaaaaggaacgccctgaactgcattgcgtggagatagtctctgtcttctcctgcatatctctccgcctctcagccttctaccccacgtgataaaggcctcaccctcgcgcaccacgcctgaggaggaagcaagacactgttttcacgcagcgaaaaagacaacataaca

SEQ ID NO: 483400 - DNA, 183 bp, Homo sapiens
  misc_feature (83)..(83): n is a, c, g, or t
  misc_feature (133)..(133): n is a, c, g, or t
  misc_feature (160)..(160): n is a, c, g, or t
catcatggagaggattagattggcaagccttttctatgcttttccaatgctgctggaatcaatttattgaccacttctttcangtcatttgctgcacctctcgggcatgatttcatcatcttcttccggattnggcggacctggtggtgctgagcatgangtcttccgtatctgtggtgcgtt

SEQ ID NO: 483401 - DNA, 962 bp, Homo sapiens
ggaacgggagtgatcacacgtcggattgcgtgggaagatctggatctcgctattcaggtcacctagtcagaaaagctaagttagctgtatagtgagggatccaaggagatctgatcctgatggcaagaaccttccctgattacagaatctttgggatgatttcacaaaagttcatcttcattgcagataccgtgtcctgtctttctaggttgtatctcccacttcgaatccgttcatagaccatcccagaagatctataagatttcatctgggaaatcaatagtgagttggcttgagagatgggaaagaaggaagatcgtggttaggaataaaaagagggttgaatgagttccagaaagcgagggttctcaagctcgtgtgactaggcaagtactgtagaagaagagaatttcagaaagaaccgaactaggaagcaacatgcagagaagtaaaatgagaggggtctcctcaggaaagaagacaggtggtccacaggagaaaaatgcttgaaccaggtctcccaggaagatggggtggtcgctcgttgcgagtagaaccccccttcaggatccgtgaggaagaccagaaagaacaagcagaagatcctggaagacggagatggggcagtagcagcgaagagctcagcccctcggatgaaaagggccgggagaccccactgtggaaagtgaggaggcgttaagaaataggaatggaggttacagtgaatgattctgaagaaataaaaacgtggttggttgaggatggacttagtgagcatgaagaagcagtgttaaattccctgccaagaaaatgttatgcaatctggaggatatgcaatggcagaatggaggaatgttgatatcaggaattgggtaaaagtggggaggcaaaaatttgcgggattggacaatggtaaattgaagccaatggaaatttgaaacgaagatcagtcaggtggaaac

SEQ ID NO: 483402 - DNA, 943 bp, Homo sapiens
  misc_feature (635)..(635): n is a, c, g, or t
cagctccgagcttactaccatgacaacctgtagtcgaaccagttacctcaagataaatgtatatgcgcgatagtaggctttgaatacgcgtggcgcatatagcatatagttaccgcgtcacggggaaatgatgaatgaacattatgcgccagagctataagtatatcaaggagctatgccctataccttctgcatgaatgagattaactagaaactacattttgcaatggagcagccagtagtgtacgcaccccacgaaaactggattgacgctagcctagaggaacgagctaatagagcacacccgtctatgtagcgaaagagggggcagattatagtgtcgatggcggtacaataccatcacgtaccggagtcctggtgactcatgctggtatgtccgaagatatgaagtctctcagtgtcaaccttctatatgtgcccacagaagcctctaaatcccgttgtaagatttaagcgtgtcagtccaggacgaggagacaggctctctggaccacttaggacataaaaccttgtagagagagtagagatattctaagacagatagtatggctatgaagcagccggcagataagacagcgttcaaagcatctaagagccattatctaggaatatcncaaacatatgaatgaaatgctgcacgtccaatggagcgaattgtatcacccgtatagaaggaaccaaatgttagtgtaggtaccatgagacatttctcttcgcataagcctggttcgattaaccttgaactgccaatcgcggcgatatcacagacaacaaacgtctttttccttcatgtcaccaaacaggctgccctaaggagcacagagtaagaaacagaattaccgcgtgcaagaatcacttgtcggataagcgagggcgagtaacagacaaaaaagggcgcccaaacatcggggcaaaagaacag

SEQ ID NO: 483403 - DNA, 394 bp, Homo sapiens
ggtttcaccatgctggagtctcgctctgctctgtcgccaggctggggtgcagtggcaccatcttggttcactgcaatctctgcctcccaggctcaagcaattctcctgcctcagcctcctgagtagctgggattacaggcgtgcaccaccacacccagctaatgttgctaatatttttgtattttttgtagagatagggtttcaccatgctggccaggatggcctcgatctgctgacctcgtgatctgtccgcctcggcctcccaaagtgctgagattacaggtgtgagccaccgtgcccagccgaaatacaaaatttttagtattttttttttttttttgaaatggaccctgctctgtggcccaggctagattacagtggcaaaagcaggaag

SEQ ID NO: 483404 - DNA, 180 bp, Homo sapiens
  misc_feature (176)..(176): n is a, c, g, or t
atccgggaggggctgggggctgaagtgagcaagaaagctgtagctgtgtggggctggcaggatgttgaagactgctctagtgctctcacatggggactgggcccagatactagcttggttcacaccccagcccgagaagacgggtcctccagttccagttgactcttatcggtggnagcg

SEQ ID NO: 483405 - DNA, 120 bp, Homo sapiens
ggtgtgtatagggcagtctctttggccgacctttattgtggcaaatgttgtctgacttactgtttcaacaaaccagaagacaagtaactgtattagtttatacaagaccaagggaaaaca

SEQ ID NO: 483406 - DNA, 118 bp, Homo sapiens
gcaggcagttgctcgctgaggtcgttctatgagatcccccgtatagttttctctcttcttttcctttcctgaagtttcctacttctattccctaggtatcacttccccaaactaacta

SEQ ID NO: 483407 - DNA, 704 bp, Homo sapiens
ggcagaggtgggctgtagagcccaagtggggtgggagcgcgaagatggatagctgctgagcgaggagccgaagcgccaaaaatctgaaggtggaggcgccgtgaagcgctgaggtattctcgtgagaaccaaatgaccaaatcttggctgaagacaaacgagcaaggaactgtgtgatgaacttggtgaaaaaattcaagagtcgaagtatcatgctggtggctcatacgcacagaattgcaattaagagatggcgtcagtggatgagttcaactagaccacgacaaatgcagacaacattttttggatgcattgggatagataaatttggggagatcctgaaggagacaaagctgctggaaggccatgtggtatgctcattactacgagacagaagatgagcagccagacaggaacttgtgctgcggatgcatcactgggtggacagacaggtccctcatagctatatctaggctgctgcctaattgttgatagcaaggaagagaacatcttgatctggagaaagaacgggatgttggtagaaaaagcaagagatttgttatatagcagggtttttaacttattagtttactcgagagttcagtattatacggtgggtcaccgatgtcttctgaataatagcaggattttctactttgatatctatctgaggcgattattagtcagtgtctacatgggaatca

SEQ ID NO: 483408 - DNA, 124 bp, Homo sapiens
cctccccttataccccacgatcacatgcctcttttacacccaacccccatagtattgtggtgagtagaattcaactacgttacaaccccacgatcacaagggttggtgtaacaatagtgcacgg

SEQ ID NO: 483409 - DNA, 122 bp, Homo sapiens
  misc_feature (4)..(4): n is a, c, g, or t
  misc_feature (14)..(14): n is a, c, g, or t
  misc_feature (86)..(86): n is a, c, g, or t
gctnttcccagggntagtgatccgtgtatatattgcatcttcctaatggctctacagagattaagaagaaacaacaagatgtgctnggtttcctagaagccaacaaaataggatttgaagaa

SEQ ID NO: 483410 - DNA, 1289 bp, Homo sapiens
caaggtttgcagacaagccaggatgcacgctttatatgctctgtcgagcccagtttcgcagcctttcagccaacaacaggccagacgctggtgcgtgccagcttccacggctgacaacatgacgcagaaccatcgcactgtgggggcggctatgtgcaagctgtttcctaatacgctttggacccagacagcacatgcacggagactcagaagtacaacatcactgatatggctcccgacactcatgtggacccatggcaccaacgaagcgttcactgctcaatcttcacagcgtaccaacgggcaacgacacgtgctgcatcacaccaaggcacatcacgattgcaccacagggcactgcactgagctcttacacaacactgatacacacctggaatcagtgcagcgaccccagaacccaaccaacctcatgacggctgcaccgattcgcaccaaacaagcccagcgatgcgcagcgtccgagcatccccttggcaacgaacgactcgggcgcacctaccctgaccaaccacaaacgaacagatacacggaataccctgacatgcattcaacaacaccggacacacccagggactgacgccgcggaccaaagaatcgcgtgactccgcaccacgagctccacaggcgcacgacgacctgggggaaacagcccccgacgcatacgtacccgcaccccgcactgctaacgcaacgcccgagggacagggacgtgccagcagcatgggacagcagacgatgcgcaacgcgcacaagagcacacccgcaaccccgtgcagctcacaaggcgatgaactgaaacagaccccgggccagaatcgaccaacgccacgactaaaaaaagcaattagaatacaacccccgaacaaattgaaaacaccgaagcatacccacgcaaagcaaacaaccaaagcgcaagacaaaccacgaagatgctggccacgaagacacaggaagcaaagaacgagacacttcgaaaaaatcctcaaaacaccacacaggactagccgccaaagacggcacaaaccaaggaccacacagcaaaacacaacacgaaggacaaggaacagaacagacacaggagagaaacacaaccaaaacggaagcgccaagaagaagacaccacaatcagaacgagcacacaacaaaaagacatccccgcgccaaacgcactcaagaacaacaaaccaagaaaaaacaaaacaaagagagagagcaaagaacacagacacagaaagaagaatcacaaagcaccaaacacaaagccacac

SEQ ID NO: 483411 - DNA, 204 bp, Homo sapiens
aggaagtccccaatatggccctgggcatatctgttgtcccaagccaaagactaagaagtgctttgggagtaccttcctatgtgtccgtaccaaatgatagctcataaacctctagaaatggagcaaatctcttacaaaggagttcgcagaagtcttcagaaagactaaaatattggctcttcctgcaaaagaagagcactcggt

SEQ ID NO: 483412 - DNA, 301 bp, Homo sapiens
aaactcataaataaggaaaattgggagttcttatccatgatcatgaggtacattggagaagagttggctgggcgcagggctcatgcctataattcccagcaactttgggaggccgaggcgggtggatcatttgaggtcagcagtttgagaccagcctgacgaacatggtgaaaccccgtctctactaaaaatacaaaaaattagcccggcttggtggtgggtacttgtaatcccagctactcaggaggctgaggcaggagaatcacttgaacctgggaggcagaggttgcagtgagctgag

SEQ ID NO: 483413 - DNA, 4678 bp, Homo sapiens
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctttcaaaaaaaaaaaaaaaaaaacaaaaaacaaaacaaaaaaaaaaaaaaccccgcgggccttttttttgggggggcggaaaaaagggctttaaaaagggccatggtgattttgttgtttcccccccccttttttgtcagggggaaaatcgcgggcccccctaaggaggcgaaaattaaaacggggtcct

SEQ ID NO: 483414 - DNA, 108 bp, Homo sapiens
gtatcagagacgttacagtgatgggatcagagttacagagcttcacgaccacctcagtgacaccgtgaaggaacgtccgagtcagaagtgtgggaagccaccgtggtg

SEQ ID NO: 483415 - DNA, 147 bp, Homo sapiens
tttatccatattgtgttccagaacaggacatcctccagactactactggcagaacaaggcttggattgcctcttgtgccacctgtctgtgacacctgagcagaaactccatgaaacactacatgccataatggcaaagtgagtggga

SEQ ID NO: 483416 - DNA, 3941 bp, Homo sapiens
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagtta

SEQ ID NO: 483417 - DNA, 3714 bp, Homo sapiens
agcggcaagttaaccccaggagaggtgccagtcagcagataatctgcaaacgaacgtattctcctcctcctacgaggatatgagcctcacgaaataatcttttcatcctgaatctccctgccgcagtcgagctgccttccgtccaggtagggtcccctccccgcccgggtcccctccccctcccggtcccctcccccgcccgggctcatctctgtctccccctcccggactgcgtcctcgctccgccgggccctcctagccgccagcttgtgaatgagacgctcagtttctcaatggagccgcggggggctcgggcggccgcccgagcggagcccggctgaggcagccgcgcaggtcgcagggccagcgtccgcgaggacggcccggctgggcggccccgagctctgtggcgctgtggaggagcgggagcgcggccgaggaagcggggcgccgagggggtcggcggccttcgggaaatttccgccgacccttcgctcccggctctaaaagttcctgatttcctatttccttttaaatcccgagtggctgttagctcttcgcctgcactttttcttccccaggagataagggggagtgtgaggaacggagcgaataatataaaaaaggatttcctcccggaagagagcggcagttcggagagatttttcttaaggaagcagaagcggcgtttgcggccgctgcaggcgccgggccctgccggccacactatgcgcgagccggccccgggctgctgaggcgcggggacgcggaagcggaggccgagcgcgccgggctcccgcgctcgcgagcgagttttgtccgcccggcggcggtggcggggggatggagcccgcgaccgcgccccggcccgacatggcgccggagctgaccccggaggaggagcaggctaccaagcagtttctcgaagagattaacaagtggacagttcagtacaatgtttccccgctgtcttggaatgtggctgtcaagttcctcatggcaaggaagtttgatgtgctccgtgccatagaattgttccactcctacagagaaactcgaaggaaggaaggcattgtaaagctgaaacctcatgaggaacctcttcgttctgagatcctcagtggaaaattcaccatcttaaatgttcgggacccaacaggagcctccattgccctctttactgccaggttgcatcatccccacaagtcagtccaacatgtggtacttcaggctctgttttacttgctagacagagctgtggatagctttgaaactcagaggaatggactggtgtttatctatgacatgtgtggttctaattatgccaactttgagctggatcttggcaagaaagtcctaaacctgctgaagggagcatttccagctcgtttgaagaaggtgctgattgtgggggcacccatatggttccgagtgccctattccatcatcagtctcctcctgaaggacaaagtccgggagaggattcaaatattaaagacatctgaggtcacgcagcatctgcccagggagtgtcttccagaaaacctgggtgggtacgtcaaaattgatctcgccacttggaatttccagttcctaccccaggtgaacggccacccagatcccttcgatgagatcatcctgttctccctccctcctgccttagactgggactcagtacatgttccaggtccccatgctatgaccatccaagagttggtggactatgttaatgccaggcaaaagcaaggaatctatgaggaatatgaagacattcgtcgtgagaaccctgttggcactttccactgttccatgtctccaggaaacctagagaaaaaccgttatggggatgtaccctgcctggaccaaactagagtgaagctaacaaagcgaagtggccatactcagacagattacatcaatgccagtttcatggatggctacaagcagaagaatgcttacattggcacacaaggtcctttggagaatacctatcgtgatttctggctcatggtatgggagcaaaaagtcttggtgattgtcatgaccacccgctttgaggaaggcggcaggagaaagtgtggccagtactggcctttagaaaaagactctcggatccgatttggcttcctcacagtgaccaatctaggcgtggagaacatgaatcattataagaaaacaacgctagaaattcacaacacagaggaacggcagaaacgccaggtgacccacttccagttcttgagctggccagactatggtgtcccttcctcagcagcttccctcattgacttcttgagagtggtcagaaaccagcagagtctggctgtgagcaacatgggagcacgctccaaagggcagtgccctgagccacccattgtggtccattgcagtgcaggcattggcaggacaggtaccttctgctcactggacatctgcctggcacagctggaggagcttggcacccttaatgtgttccagacggtgtcacgcatgaggacccagagggccttcagcatccagacccctgagcagtactatttttgctacaaggccatcctggagttcgcagagaaggagggcatggtatcctctggccaaaacctgctggccgtggagagtcagtaactctcctacgaacctcctacctgttggccagccttccttaaactaccctggacaccgctgagcctataggttgccatcagttacgctgaagccatggatcaacttctttcttgtgtctcccagcacacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctgaggtctcctgtctcccactccttccctttcctaggattttatggggaggtttgatgagcatttgcctttctccccagagagcttgaccaagttacatattctagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttctggtgggttctgtgtcaataaaaagcttcaccccctggctgagtgaggtggtcccctgcaatcactgtttgtcccctacccacccaacctgtccctgcctgctcccagcccactcatccttatgtgctagggataaatcaagagtcctcagcactccacattcccaaaaaatcccaggaactcctaaaccttcccctgtgacagaagatgaggttggcagctgatcagacctcaataattttatactgtaataagctctttgaatgtgtatattattattttttacaatcatttcattttgtatttaatatcaatggactgagtctgattcagaaaataattgtaatgttcatattcaatatcttacagtgatacagttttgtatttacatataaatataccgacatgatcaaaa

SEQ ID NO: 483418 - DNA, 199 bp, Homo sapiens
  misc_feature (117)..(117): n is a, c, g, or t
  misc_feature (146)..(146): n is a, c, g, or t
  misc_feature (187)..(187): n is a, c, g, or t
tgagtcaatctgggccttccacaggtcctctgaaccaagccccactcccttgctaggggtgaaagcattacagagagatggagccatctatccaagaagccttcactcacccttctncgtgctgctgttgcaacttcggctgttcntggactctgactgtgtgtggacgggactggggaatagaacnattgactggtgt

SEQ ID NO: 483419 - DNA, 3484 bp, Homo sapiens
gggaggagaataatgaggaggacggcagtgtgattcattatgcactatgagcgccaagtccgcatcgcggtgatcaggaccgggtaacgctcggatgccaactggaggggactacctgacgtgctcgaacatcaatcattctcatccagtctccatctcgaggttcgctcagtacgtctctgagtttaaaaacccttccgcgggaatattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctt

SEQ ID NO: 483420 - DNA, 3340 bp, Homo sapiens
agcggcaagttaaccccaggagaggtgccagtcagcagataatctgcaaacgaacgtattctcctcctcctacgaggatatgagcctcacgaaataatcttttcatcctgaatctccctgccgcagtcgagctgccttccgtccaggtagggtcccctccccgcccgggtcccctccccctcccggtcccctcccccgcccgggctcatctctgtctccccctcccggactgcgtcctcgctccgccgggccctcctagccgccagcttgtgaatgagacgctcagtttctcaatggagccgcggggggctcgggcggccgcccgagcggagcccggctgaggcagccgcgcaggtcgcagggccagcgtccgcgaggacggcccggctgggcggccccgagctctgtggcgctgtggaggagcgggagcgcggccgaggaagcggggcgccgagggggtcggcggccttcgggaaatttccgccgacccttcgctcccggctctaaaagttcctgatttcctatttccttttaaatcccgagtggctgttagctcttcgcctgcactttttcttccccaggagataagggggagtgtgaggaacggagcgaataatataaaaaaggatttcctcccggaagagagcggcagttcggagagatttttcttaaggaagcagaagcggcgtttgcggccgctgcaggcgccgggccctgccggccacactatgcgcgagccggccccgggctgctgaggcgcggggacgcggaagcggaggccgagcgcgccgggctcccgcgctcgcgagcgagttttgtccgcccggcggcggtggcggggggatggagcccgcgaccgcgccccggcccgacatggcgccggagctgaccccggaggaggagcaggctaccaagcagtttctcgaagagattaacaagtggacagttcagtacaatgtttccccgctgtcttggaatgtggctgtcaagttcctcatggcaaggaagtttgatgtgctccgtgccatagaattgttccactcctacagagaaactcgaaggaaggaaggcattgtaaagctgaaacctcatgaggaacctcttcgttctgagatcctcagtggaaaattcaccatcttaaatgttcgggacccaacaggagcctccattgccctctttactgccaggttgcatcatccccacaagtcagtccaacatgtggtacttcaggctctgttttacttgctagacagagctgtggatagctttgaaactcagaggaatggactggtgtttatctatgacatgtgtggttctaattatgccaactttgagctggatcttggcaagaaagtcctaaacctgctgaagggagcatttccagctcgtttgaagaaggtgctgattgtgggggcacccatatggttccgagtgccctattccatcatcagtctcctcctgaaggacaaagtccgggagaggattcaaatattaaagacatctgaggtcacgcagcatctgcccagggagtgtcttccagaaaacctgggtgggtacgtcaaaattgatctcgccacttggaatttccagttcctaccccaggtgaacggccacccagatcccttcgatgagatcatcctgttctccctccctcctgccttagactgggactcagtacatgttccaggtccccatgctatgaccatccaagagttggtggactatgttaatgccaggcaaaagcaaggaatctatgaggaatatgaagacattcgtcgtgagaaccctgttggcactttccactgttccatgtctccaggaaacctagagaaaaaccgttatggggatgtaccctgcctggaccaaactagagtgaagctaacaaagcgaagtggccatactcagacagattacatcaatgccagtttcatggatggctacaagcagaagaatgcttacattggcacacaaggtcctttggagaatacctatcgtgatttctggctcatggtatgggagcaaaaagtcttggtgattgtcatgaccacccgctttgaggaaggcggcaggagaaagtgtggccagtactggcctttagaaaaagactctcggatccgatttggcttcctcacagtgaccaatctaggcgtggagaacatgaatcattataagaaaacaacgctagaaattcacaacacagaggaacggcagaaacgccaggtgacccacttccagttcttgagctggccagactatggtgtcccttcctcagcagcttccctcattgacttcttgagagtggtcagaaaccagcagagtctggctgtgagcaacatgggagcacgctccaaagggcagtgccctgagccacccattgtggtccattgcagtgcaggcattggcaggacaggtaccttctgctcactggacatctgcctggcacagctggaggagcttggcacccttaatgtgttccagacggtgtcacgcatgaggacccagagggccttcagcatccagacccctgagcagtactatttttgctacaaggccatcctggagttcgcagagaaggagggcatggtatcctctggccaaaacctgctggccgtggagagtcagtaactctcctacgaacctcctacctgttggccagccttccttaaactaccctggacaccgctgagcctataggttgccatcagttacgctgaagccatggatcaacttctttcttgtgtctcccagcacacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctggagtgaggtggtcccctgcaatcactgtttgtcccctacccacccaacctgtccctgcctgctcccagcccactcatccttatgtgctagggataaatcaagagtcctcagcactccacattcccaaaaaatcccaggaactcctaaaccttcccctgtgacagaagatgaggttggcagctgatcagacctcaataattttatactgtaataagctctttgaatgtgtatattattattttttacaatcatttcattttgtatttaatatcaatggactgagtctgattcagaaaataattgtaatgttcatattcaatatcttacagtgatacagttttgtatttacatataaatataccgacatgatcaaaa

SEQ ID NO: 483421 - DNA, 3746 bp, Homo sapiens
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctt

SEQ ID NO: 483422 - DNA, 2412 bp, Homo sapiens
agcggcaagttaaccccaggagaggtgccagtcagcagataatctgcaaacgaacgtattctcctcctcctacgaggatatgagcctcacgaaataatcttttcatcctgaatctccctgccgcagtcgagctgccttccgtccaggtagggtcccctccccgcccgggtcccctccccctcccggtcccctcccccgcccgggctcatctctgtctccccctcccggactgcgtcctcgctccgccgggccctcctagccgccagcttgtgaatgagacgctcagtttctcaatggagccgcggggggctcgggcggccgcccgagcggagcccggctgaggcagccgcgcaggtcgcagggccagcgtccgcgaggacggcccggctgggcggccccgagctctgtggcgctgtggaggagcgggagcgcggccgaggaagcggggcgccgagggggtcggcggccttcgggaaatttccgccgacccttcgctcccggctctaaaagttcctgatttcctatttccttttaaatcccgagtggctgttagctcttcgcctgcactttttcttccccaggagataagggggagtgtgaggaacggagcgaataatataaaaaaggatttcctcccggaagagagcggcagttcggagagatttttcttaaggaagcagaagcggcgtttgcggccgctgcaggcgccgggccctgccggccacactatgcgcgagccggccccgggctgctgaggcgcggggacgcggaagcggaggccgagcgcgccgggctcccgcgctcgcgagcgagttttgtccgcccggcggcggtggcggggggatggagcccgcgaccgcgccccggcccgacatggcgccggagctgaccccggaggaggagcaggctaccaagcagtttctcgaagagattaacaagtggacagttcagtacaatgtttccccgctgtcttggaatgtggctgtcaagttcctcatggcaaggaagtttgatgtgctccgtgccatagaattgttccactcctacagagaaactcgaaggaaggaaggcattgtaaagctgaaacctcatgaggaacctcttcgttctgagatcctcagtggaaaattcaccatcttaaatgttcgggacccaacaggagcctccattgccctctttactgccaggttgcatcatccccacaagtcagtccaacatgtggtacttcaggctctgttttacttgctagacagagctgtggatagctttgaaactcagaggaatggactggtgtttatctatgacatgtgtggttctaattatgccaactttgagctggatcttggcaagaaagtcctaaacctgctgaagggagcatttccagctcgtttgaagaaggtgctgattgtgggggcacccatatggttccgagtgccctattccatcatcagtctcctcctgaaggacaaagtccgggagaggattcaaatattaaagacatctgaggtcacgcagcatctgcccagggagtgtcttccagaaaacctgggtgggtacgtcaaaattgatctcgccacttggaatttccagttcctaccccaggtgaacggccacccagatcccttcgatgagatcatcctgttctccctccctcctgccttagactgggactcagtacatgttccaggtccccatgctatgaccatccaagagttggtggactatgttaatgccaggcaaaagcaaggaatctatgaggaatatgaagacattcgtcgtgagaaccctgttggcactttccactgttccatgtctccaggaaacctagagaaaaaccgttatggggatgtaccctgcctggaccaaactagagtgaagctaacaaagcgaagtggccatactcagacagattacatcaatgccagtttcatggatggctacaagcagaagaatgcttacattggcacacaaggtcctttggagaatacctatcgtgatttctggctcatggtatgggagcaaaaagtcttggtgattgtcatgaccacccgctttgaggaaggcggcaggagaaagtgtggccagtactggcctttagaaaaagactctcggatccgatttggcttcctcacagtgaccaatctaggcgtggagaacatgaatcattataagaaaacaacgctagaaattcacaacacagaggtaaatccaggtttcttttttctcaccttgttgaaacagggggagaataattactgtaatgaaaatctccagagggaataggtaggataccagggaagttatgagttgcttctgtttttctagggacaggatgaggatatttaactcacagccagtatagccatattactgcagcacgataggaactaatatgaagtataaagcgttgag

SEQ ID NO: 483423 - DNA, 4370 bp, Homo sapiens
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggtttattggttgtacatataaattatactttcctttcaaaaaaaaaaaaaaaaaaacaaaaaacaaaacaaaaaaaaaaaaaaccccgcgggccttttttttgggggggcggaaaaaagggctttaaaaagggccatggtgattttgttgtttcccccccccttttttgtcagggggaaaatcgcgggcccccctaaggaggcgaaaattaaaacggggtcct

SEQ ID NO: 483424 - DNA, 1623 bp, Homo sapiens
  misc_feature (1623)..(1623): n is a, c, g, or t
agcggcaagttaaccccaggagaggtgccagtcagcagataatctgcaaacgaacgtattctcctcctcctacgaggatatgagcctcacgaaataatcttttcatcctgaatctccctgccgcagtcgagctgccttccgtccaggtagggtcccctccccgcccgggtcccctccccctcccggtcccctcccccgcccgggctcatctctgtctccccctcccggactgcgtcctcgctccgccgggccctcctagccgccagcttgtgaatgagacgctcagtttctcaatggagccgcggggggctcgggcggccgcccgagcggagcccggctgaggcagccgcgcaggtcgcagggccagcgtccgcgaggacggcccggctgggcggccccgagctctgtggcgctgtggaggagcgggagcgcggccgaggaagcggggcgccgagggggtcggcggccttcgggaaatttccgccgacccttcgctcccggctctaaaagttcctgatttcctatttccttttaaatcccgagtggctgttagctcttcgcctgcactttttcttccccaggagataagggggagtgtgaggaacggagcgaataatataaaaaaggatttcctcccggaagagagcggcagttcggagagatttttcttaaggaagcagaagcggcgtttgcggccgctgcaggcgccgggccctgccggccacactatgcgcgagccggccccgggctgctgaggcgcggggacgcggaagcggaggccgagcgcgccgggctcccgcgctcgcgagcgagttttgtccgcccggcggcggtggcggggggatggagcccgcgaccgcgccccggcccgacatggcgccggagctgaccccggaggaggagcaggctaccaagcagtttctcgaagagattaacaagtggacagttcagtacaatgtttccccgctgtcttggaatgtggctgtcaagttcctcatggcaaggaagtttgatgtgctccgtgccatagaattgttccactcctacagagaaactcgaaggaaggaaggcattgtaaagctgaaacctcatgaggaacctcttcgttctgagatcctcagtggaaaattcaccatcttaaatgttcgggacccaacaggagcctccattgccctctttactgccaggttgcatcatccccacaagtcagtccaacatgtggtacttcaggctctgttttacttgctagacagagctgtggatagctttgaaactcagaggaatggactggtgtttatctatgacatgtgtggttctaattatgccaactttgagctggatcttggcaagaaagtcctaaacctgctgaagttaccctctagttctactgatttggagaaaccccagcactcctctatggagaatatacagcatctagaacaaacttctccaaaggcctcttcactgaagtgtgataaactactttcatcttttccttcaaagatgcaacaatttatttcaggacctaaatgtccaaggtccttttaccagcaaatcaaaaaccattctaggaaaacacctgttatttccacaaaataataaataaaaacggatgcggccagn

SEQ ID NO: 483425 - DNA, 484 bp, Homo sapiens
atgaaatctagaaagagatgacagcacaatgttctagtagcggaggtaactcagcagttgaggacgcgattcttaccaagtccagttgttattaagaaacgtattgaaggacttattgagagagaatatttggcacgaacacatgaggatcgcaaagtatacaaatatgtagcataaaatgcgttcagaaatttgatttattcttggactgtaatcttcgcatggaatgggaagttattttaaataattaaatattaagaagaaatactattatattaacttaaagtacatgttctagaacattgagatcaagcctttaatacatttgagagtttccaacataagttgattgagattaaggatttacaacgtatatccatgtagagatcatctttaaagttcctagggaaaatgtgaatgtgatgagttttgttttctttactgtatgaaaaaaggaaaataaaagagaaatttagaaaataaa

SEQ ID NO: 483426 - DNA, 4190 bp, Homo sapiens
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttaaaaaaaaaaaaaaaaaaaaaaaaaaaaaaaggggggggggctttttgaaattgggcccccccagcttttttgccaaaatggggctaaaaaaaaactttttttaatcccaataaaaaagggttaagggggggaacccccaaaggggggggaacctttaaagggcaccttggggctttcaaattttggaatggggggggttttaaacgagaaaaaacttttccccttttttcgggtttcaggggcggggtt

SEQ ID NO: 483427 - DNA, 1423 bp, Homo sapiens
  misc_feature (1292)..(1292): n is a, c, g, or t
agcggcaagttaaccccaggagaggtgccagtcagcagataatctgcaaacgaacgtattctcctcctcctacgaggatatgagcctcacgaaataatcttttcatcctgaatctccctgccgcagtcgagctgccttccgtccaggtagggtcccctccccgcccgggtcccctccccctcccggtcccctcccccgcccgggctcatctctgtctccccctcccggactgcgtcctcgctccgccgggccctcctagccgccagcttgtgaatgagacgctcagtttctcaatggagccgcggggggctcgggcggccgcccgagcggagcccggctgaggcagccgcgcaggtcgcagggccagcgtccgcgaggacggcccggctgggcggccccgagctctgtggcgctgtggaggagcgggagcgcggccgaggaagcggggcgccgagggggtcggcggccttcgggaaatttccgccgacccttcgctcccggctctaaaagttcctgatttcctatttccttttaaatcccgagtggctgttagctcttcgcctgcactttttcttccccaggagataagggggagtgtgaggaacggagcgaataatataaaaaaggatttcctcccggaagagagcggcagttcggagagatttttcttaaggaagcagaagcggcgtttgcggccgctgcaggcgccgggccctgccggccacactatgcgcgagccggccccgggctgctgaggcgcggggacgcggaagcggaggccgagcgcgccgggctcccgcgctcgcgagcgagttttgtccgcccggcggcggtggcggggggatggagcccgcgaccgcgccccggcccgacatggcgccggagctgaccccggaggaggagcaggctaccaagcagtttctcgaagagattaacaagtggacagttcagtacaatgtttccccgctgtcttggaatgtggctgtcaagttcctcatggcaaggaagtttgatgtgctccgtgccatagaattgttccactcctacagagaaactcgaaggaaggaaggcattgtaaagctgaaacctcatgaggaacctcttcgttctgagatcctcagtggaaaattcaccatcttaaatgttcgggacccaacaggagcctccattgccctctttactgccaggttgcatcatccccacaagtcagtccaacatgtggtacttcaggctctgttttacttgctagacagagctgtggatagaaaaattagccgggtgtggtggcgggngcctgaagcaggagaatggcgtgaacccgggaggtggagcttgccaggagccaagattgcgccactgtactccagcctgggcgacagactgagattctgtctccaaagatccatacacagcagaagaacgc

SEQ ID NO: 483428 - DNA, 173 bp, Homo sapiens
agcagcttaagtctcatgggagtgcgaaccctgtgtgaactgcacatgcgaggatctaggttgtgcactccttatagaatctaatgcctgatgaatctaatgcctcatgatctgaggttgaatagcttcgtgccgaaaccaatcccccccccatcccgctaccccgagtccgt

SEQ ID NO: 483429 - DNA, 177 bp, Homo sapiens
agagaggagagaggagtcgttactgtggccagagcttacagagtagttttatcagacctggcccccgggcgaggatgaggaactactgtgtggttcacactataataatgtgcttgtttggccagtaggtgtatttctggttattttggccggacaagaggagggaggtatcagcta

SEQ ID NO: 483430 - DNA, 3870 bp, Homo sapiens
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaacatacgacagcctgacgcccccagtgcccagagaagaacgtagtagctcactttctag

SEQ ID NO: 483431 - DNA, 3458 bp, Homo sapiens
  misc_feature (3452)..(3452): n is a, c, g, or t
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcctgggctgtgcagcctcacttccaccttggcatatggtagaccttgcctttgagtcttttagaggcttntttcat

SEQ ID NO: 483432 - DNA, 235 bp, Homo sapiens
  misc_feature (95)..(95): n is a, c, g, or t
  misc_feature (135)..(135): n is a, c, g, or t
  misc_feature (181)..(181): n is a, c, g, or t
ttccggacgcatcagtgctttattaccaaggatgactgtgctgcaggaggcggctcaatgtgaagaactacgggtttccgcagggtgaagctcanaattatccacactgaccttctcagtcatgcatgatgccangaaaatcacaggcttccattctacagtgaagggcttggaggagcangcaataatccttaggaaagaggctgaatccaggggctgagcagaacagtccata

SEQ ID NO: 483433 - DNA, 192 bp, Homo sapiens
tatttgtcgatcgttaaaccatttgccagttgtatacttaaacccgtcctcattgcttggccctttctgaagctgcttcctctcataaaatagcttttgccgacacatcgtttttttagcagatcccacaatataatgacggggctggtgggatctttgtgtctgtgttcttctaatatattattattcttc

SEQ ID NO: 483434 - DNA, 412 bp, Homo sapiens
  misc_feature (3)..(3): n is a, c, g, or t
  misc_feature (15)..(15): n is a, c, g, or t
  misc_feature (74)..(74): n is a, c, g, or t
ccngaagggttctgncagtattcttgtggaagggccccattcacgggcttgtgttctttccttggcctactgtnggctcctttctttgagtcagaagcagctggctcagccaggcggggtggctcatgcctgtaattccagcactttaggaggccaaggcaggtggatcgcttgaggccaggaattcgagaccagcctggccaacatggtgaaaccccgtctctactaaaaatacaaaaaaattagcttgacatggtggctcacgcctgtaatcccttagctactcaggaggctgaggcaggagaatcacttgaacctggcaggtggaggttacagtgggccaagatcgtgccattgcactccagcctgggcaatagagtgagactctgtctcaaaacaaataaacaacaac

SEQ ID NO: 483435 - DNA, 2090 bp, Homo sapiens
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctt

SEQ ID NO: 483436 - DNA, 447 bp, Homo sapiens
ggaacgtcactagaggcaacagaggcaggcataggaatcagagggatggaaactcaagtccttagttttgccacttatatatactctgtggctttatgcactgacctaaccactgacctaactttcctgagcctcagtctccctcctctgtagaatgggacaactcataataccagtcttaagaatgggtgcagtggatcatgcttagtaatcccaatactttgggaggctgatttaggcggatcgcttgaggaccggagttccggaccagcctagacaacatagcaagaacccatctctacccaaaaatacaaaaattagccaggtgtgatgacagacaaccgtagtcccaactacttgggaggctgaggtgtgaggatcagctgagcccaggggtatagaggccaccagtgagcttatgactataccacttcattccagcctggg

SEQ ID NO: 483437 - DNA, 1871 bp, Homo sapiens
catcttcctttcctccatgctccctttttcttcttctttctctccatctgtcttctgtggtaatctggtctctctgtctcttttcctgacactttttcttttcccctgagtgcttctgttttccatctacttcttttactttcttgatctctggttctttgacatctgtgttctcctctctcgctctttttctgcctgtatctgtccatctgatgcctctcttttcctggctccatctctgtatttccctgtctttctcttgcccttctttctctgtggcccgggcccagttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctt

SEQ ID NO: 483438 - DNA, 719 bp, Homo sapiens
gtaggaatccggagcgagctcgcaagagagagacccggcagccagaaccgagggaaagggttttttttgggtagagagacccccccagccgcgccaagggaggcagactctaagaagacgtcccgcctggcacggaccaagcgagacacgaaggagcgcctcgtcgggccgagccgagaaagagggctccacaggggggggggagccggcccaccaccaaagaaagacagcgaccggcgcgcgcagcacccaccgggccgaccccagaaggaggcagggggggcgagaggcgcgacaagaagccaggcaccacccccccgaagaaaggagggagaaggaagaaccaaaaacaaacccccaaggcgggcccacccggcaggcaacaggaacccccggcgggtgagcccccccaccgcccgccggaaggccccagagcgggggaccgcacaccggaagaggaggcacacccgcagctttccgggcaccccgccaccgcagagcaccagaccggactcccccgcacccagagggcaaaacacgcccgacgccccgcggcgccgcccggggccaagcgggggcgcggcaggggggcacccaacaaggccggcggggggggcaaataaccccgccccccccaagccacgccggcgcgcaccgcgggagggaggggagcaacgccacaccgcgcccccacgcccccgccccccggcgcgggtgcg

SEQ ID NO: 483439 - DNA, 418 bp, Homo sapiens
cagtcaaatattgtgccaggcgtagggatatcatcgtggcatcgcgcgacgtattttctcaggataacatccccaactcatgttcaagctccgtcacgatgtccttggccactctttacacttctcaacggtacattttatatgtatagtaccaaaaaaaaaaaaaaaaaaaaatactagtttttttgaaacaaagtcttgctctgtcacccaggctggagtgcagtggtgcaatcgcggctcactgcagcctccacctcctgggctcaagcgatcctcccacctaacgctctcaaagagctggaataacgggattgagccaaccgtgcctggcctcatcttatagaaacaggtaaattatacttaactagctattaaaaaagttagatggaaaatgagccagaacaatcctccagcc

SEQ ID NO: 483440 - DNA, 223 bp, Homo sapiens
cggtgcaatggctcatgcttcatattctttcacttgggaggcaaggcaggaggattgcttgaacccacgacattcaagacctgcctgagcaacatggtgaaactccatctctacaaaaagtacaaaagttagccaggtgtgctggcatgcatttgtagtcccacctaagtgtcacaggtaggtgggactacaagtgcatgcaagccacagggctaactttgga

SEQ ID NO: 483441 - DNA, 768 bp, Homo sapiens
  misc_feature (491)..(491): n is a, c, g, or t
ggggcaacctgcgcggacgtacctgtcaggcccggaggcccccagcggctgaaatactgctagcaacccccagacacaacccgataggagcaggctctcctccaagggacctggtgtcctgcgcctacccaggtggccccgagtgcatggacgtagtctggtctccaagaagtgcatacaccgagacctggccgctcaggtaaattgtccatgggctgaccgggatgcgacaagtgctagacttgaaatggataggcaccaacgtttgagagctcgccacggggacacttcgatcagcaatcgactatcgaatgaaatgacaaccaacggccgacctgcctgtgaatcttggcatgggcacccgaaggggattatttgaccggattctatcaccccgaccgagagctgatgctgtggttctttcaggcggctggctccttgttgggagcagtagtcttacagcttcctcgtgcgtcgcgagtcccccatgnactccccgagtgatgacccatgctgcgcagtgatatcttatctgcacaagactttgactagcaaagggggacgaggtcgagctcggacgactcgggatcaagaagcccatggtacagcttggccaagcgcagatctggaagcgtggtaatcacttgtactgaagtcgtccggtgcaccttggctcgcgagaggttgcatggtcgaccccgtctagcaagagcaagccctggcgcttgccgccatggcaccgtgtggggttggcacatggaaccctgg

SEQ ID NO: 483442 - DNA, 168 bp, Homo sapiens
cagaggatcccacaagctgaactcttccggtcattatttcgttggcatgatgtatggcttcttcacgtttggtttttattggagcacggagtagaattccaggctgccttgacttcttcccgtgcatgctcccgtcccaggtgactttccttcccatttcacatagag

SEQ ID NO: 483443 - DNA, 1172 bp, Homo sapiens
agcggagtgctaaagtccccagcgacactccgcgacgccggactcagaatctcctcagacgccgagatgcgggtcacggcgccccgaaccctcctcctgctgctcgggggggcctgtggccctgtacctcgaccatcctggcgctggtcgtcccgagctcgcagtgagggtagtttccgacatccgtccgctgttccctggacccggctcagtcgcggggagctcccgctttcatcgatccgtgggcttatcgtggaacggactgctgctgtttcgtgaggttcgaacatgcgcagcgccgtcgagatccgcacgacgaggaggcccgtggtgcgcccgtgggactgggaggccaagagcgcggaccggcagtactggtgagaaccggcgaagaccaacaagaatcctgacaaaggtcccaacgtgtcaacctgaacttgaccccgcaagtacggtaacacctggcgaggatccgagagcttccggacatatacataatggcacgccaaaggagcagcagtcgctcccgggatctgcaaccaaagccctcactaaagcaaaggatggtaatagagagtgccaacaaatgttagggaggcgcagatgatagaggagaacggacacgtccacatacccgggaaggagttcacccgaagccatatgtgcacagcacttccaaggagacaggggcagaaaggggttgaaaaacaataacgggacccacataggagaaaccgagagagaaacccggggaagggctaccccttgggaaatcgcagacaccgtagggaaaccaaaccggtggatcgggactgtaccaggaactacggagcacactaaacgggcaacatactgggagggcaaagtgggccgggggcacacagtgcaagaatgggcgccaggagcaacgaccaatggctgtggcaatgaaggtcaccggaatacgccctggaggaaagggcgaagccgcacaggagtgtatccagtattgggcacagtgtggaggacttcaccggacaagagcacgtagaacgccgtagggaacacaaaaaccggcgcgtgcaagcagacaccaatgcgccattgtaacaagccgatgggaggggagagcccccacggcacacatacggacccatacaccgttggtgacaccacgagccgaaacggtccca

SEQ ID NO: 483444 - DNA, 829 bp, Homo sapiens
gacagctctcccccattatatggccaggaatcgaggctggtgactggtgcacaaggtctcctattctacccgtgttctgttcatctaagatgctagactatatttataaatcatagtgtcaatcatagttattgaatgacttcaagttgtattcccatggcaagatggactttctcagaataggactgcagcggcttggagtactttacatgttagatgttgaatctagaattttttattgatatgaaggagaaaatactgaccaatggatccatggacattacatcaaagaagataacatattcctaaattaacaagtacctagaagtcaaaactacaagaatagaatatctgaaaaaaaagcagattgactgcagatcaaaagagtaagtctggatgactaatccaggtggattagggagtcactgactgaacaaaaactgcctctaatagcttgaggatattcatttgatatgaaattatcatatgactttagtgcaaactgcctgctgatttaagttgacagtaaacctatggagtgctgcttaaagtcttcacatctacgaaaaatagctatcaggagttattaaagtcctactatgatgaagacagccatgcgtgtggtagcagaacgtgtactgtgtatcgacacgcactttcgaacttcacatacaccaaagtacaccagcgatgtaagtcgcggcgagaaaacctaccactgcgatcgcctctcactcacagactattaactggacaacaatgtgcttttacagatggtacacgggcatggacaggccacagtcctcggcggaaagggtcacacttaacc

SEQ ID NO: 483445 - DNA, 188 bp, Homo sapiens
gataaaaccagaagcaacagacacagatatacatatacacaaacaaataacaaaatcactttctgttgcagtagatcaaagatctagctgtgcccagggaagttgttctgtcttctgccttccttaccaaagcattttgctttattgagaaacttttataatccccaaatccttaaaaaccttagaaa

SEQ ID NO: 483446 - DNA, 107 bp, Homo sapiens
cagctgatctaaggatcccataaggcatactcttaatgcctttggcgatctctaatctgtaggagtgcttcattctttcttgtttattcttttggccccttatcgag

SEQ ID NO: 483447 - DNA, 406 bp, Homo sapiens
tgagccatcactgcgctgctgtttggggcacaccgtgttccctggctttgcgacagttatgcacaaggagatcattgtcctggcgtccatgcacgatgctgatcaagatcatttgctcctcctgagcgcaagtcctccgtgtggatcggcggctccttcctgtcctcgctgtccaccttcctgctgctgttgatcaacaggcagtgagtattacgatctccggtccctctcatcgtccatcgcaattgcttctaagctggctatgagttagttgctctacaccctttcttgacgcatcctagcttgcgcctgagcgacgatgagcattggtctggattgatttgtccctgtcgttttgttttggtttttttttttttttttgggtttgactcaggttttaccctag

SEQ ID NO: 483448 - DNA, 736 bp, Homo sapiens
  misc_feature (1)..(1): n is a, c, g, or t
  misc_feature (140)..(140): n is a, c, g, or t
  misc_feature (238)..(238): n is a, c, g, or t
  misc_feature (241)..(241): n is a, c, g, or t
  misc_feature (264)..(264): n is a, c, g, or t
  misc_feature (271)..(271): n is a, c, g, or t
  misc_feature (286)..(286): n is a, c, g, or t
  misc_feature (291)..(291): n is a, c, g, or t
  misc_feature (296)..(296): n is a, c, g, or t
  misc_feature (298)..(299): n is a, c, g, or t
  misc_feature (303)..(304): n is a, c, g, or t
  misc_feature (332)..(333): n is a, c, g, or t
  misc_feature (341)..(341): n is a, c, g, or t
  misc_feature (364)..(364): n is a, c, g, or t
  misc_feature (369)..(369): n is a, c, g, or t
  misc_feature (372)..(372): n is a, c, g, or t
  misc_feature (376)..(376): n is a, c, g, or t
  misc_feature (380)..(380): n is a, c, g, or t
  misc_feature (397)..(398): n is a, c, g, or t
  misc_feature (404)..(404): n is a, c, g, or t
  misc_feature (408)..(408): n is a, c, g, or t
  misc_feature (420)..(420): n is a, c, g, or t
  misc_feature (427)..(427): n is a, c, g, or t
  misc_feature (458)..(458): n is a, c, g, or t
  misc_feature (468)..(468): n is a, c, g, or t
  misc_feature (487)..(487): n is a, c, g, or t
  misc_feature (495)..(495): n is a, c, g, or t
  misc_feature (497)..(497): n is a, c, g, or t
  misc_feature (499)..(499): n is a, c, g, or t
  misc_feature (505)..(505): n is a, c, g, or t
  misc_feature (520)..(520): n is a, c, g, or t
  misc_feature (540)..(540): n is a, c, g, or t
  misc_feature (735)..(735): n is a, c, g, or t
ngacactagtggtggtgaagttcataaagttttggggtggcaaacaaacagcttattttgtcctttatcataattggtttacaaattgggtgcctggttttggcatactggttcagttgatcaagcgcaggatccctttngtctttgtaagaccagatgtataaggccgaatagggtcaagaacttgattgtcaggcgaacgatttactattaacacaaaacaatattactacaaacnccntctcttgtttaacccaagcgacngaggtgngttttctctcatggnctctncgggngnnttgnnagggttgcttcgtggtatgccatgtttnncagttggntcatgggggatggtaatcttggngtgtngtntggnagtntgggtggctgcgttttnngcttgnggtngctttggttatnccctgcnaagggcctcgtgtcctttgggagcgactcantgtttttgcncagctgttaaatacctccntgcgtttntntntcctgntttaatattgctatnaacaggaaagtgtgtaaaantaaaaagtgtatactatttacagatttaaagctttctttgaccttgtcaagggttaagcgactcatttgcatttagtataatgatatgcaaatcttttactttgatgtgtgaaattctgctatctcaaattgacagtatcattattttcagctatgatcatccgtttaagtaaatgttcccataattttgaggtnc

SEQ ID NO: 483449 - DNA, 156 bp, Homo sapiens
gctcgacatacattattgctttgaatgtaaatcagtacagccattatggaaaacagtatggaaatttttcaaagaactaaaaatagaactaccatacaacatagcaatctcattactaagtatttacacaaaagaaagaaaaaaaaaaagtcgacg

SEQ ID NO: 483450 - DNA, 253 bp, Homo sapiens
gccggtcgcgtcgcgacgtgttatcctgagtactcctacttcacaatgaagtaggagtatacaggaaaacacgccatgtgaatatccgtactcgtcatgggctatatccacaaagccacaacaggctacttgtatacccgagggctgtgagggctccaggttgtatcaccatcaccatatcattgagaccaactttgagatgatcaaacttatagatattgcagcgagagactgcacagggcatggcttactt

SEQ ID NO: 483451 - DNA, 196 bp, Homo sapiens
ttttctttttttgggggggggggggaaaaaaacccccaacctgggtttggaaaataaaccccgggtcggggtttcccggggatgttaaccccctaaaagtttttttccccctttggttttaaagggattgtggggccccccaagccaggaacccgtttttttttccttaaaaacccatgggggttgggttttttta

SEQ ID NO: 483452 - DNA, 656 bp, Homo sapiens
ggtctctgcggaatggcggctctagactgcccgtggtcgctcttcactagcctcggcctgagcgagcagaaggcccgcgatacgctcaagaactacgtgctctgagcgcgcagttgcgacgaggccgctactcaggctcagacggaccgctgtggttccacctattgacaaagctaccgggatccctgttatatggcttggcctcccgactcagggatacccggcgtctctccttccttgtaagctacatagaccagtaagaagatccacactgaggccccagctaaacgctgcccttgagtatgtgcggagtccaccccttggtaccccatcgacactgtggacttcgagcgggaatgtggcgtgggtgtcatggtgaccccagagcagattgaggacggctgaggaggctgttattaccaagcaacgggccccctcttggtgagaagtgatgacaatggttagatctgggctgcctggctcaataggagaggaagggctcgtggtctgtgccagagagtcgggcagatgtgacataactgactcaaccaattgtaagtcgcgcatgcgagggtcctccgcatgcgtatctaggtgtctcaccagatcggaaggaccgcatctggcaggaaaaaggtacaaaggtgtgcccacca

SEQ ID NO: 483453 - DNA, 899 bp, Homo sapiens
agaacgatgcgcgggtcccgctaggcgcatggtgtaagttcgacatgggcttcctttgtgacctggtagtgctgggtgttgctgatcatggcttgattttgaccaagctgaaagattgttccggtgggaccactggagctgttcgtgaagcacgctgtacatcagtccagagctgcatcgagcgtcttattgctgcgggtcctgatccagactcgttattccctccatatggttgcaaaatgtccttttgctactgaccagagatgagcaaaaatcctacgatccaggagcctccctcggactgggaaggtgccttttgaaattccataccagtgtgggggagtatgaccggtcaagttgtggtccatcagtatggtcctaaagctttgccagagacttttcaatccaacgtattgtttgggcacgcttatattgatgaacgaataccattcgaacattaagagtttgtgcctgggttacataggtccaaggtgagcagatcttacgtggcaccacgggagttgggcgcgcagcagttctactcctagtggagcgccatttccagcggatgaattgtcagtgcacggttcgcgtttaaatcggaaagtacctggttgccttgggaaaaattgctggtccgtcagtgattactggcaggcttgttgtttcttcggcacttggctccgaggcagactgaaactaaacatttaagcttaccatcttttggcccggttgcgggctccgtcttctccctgtggcaactgttacgttggccctgctgtgcggaagagcctatccagcactataagagcggacggtaggtagccgttggtgagtctccgggggctacagctttgagcgaccgcgtgggtcagtccacgggccacattgctctcctt

SEQ ID NO: 483454 - DNA, 360 bp, Homo sapiens
tgggatgattaaaatgttctggaaaaaggcccggcatggtggctcacacctgtcatcccagcactttgggatgacctgaggtcaggagaccaacctggccaacatggtgaaaacccgtttccactataaaaatacaaaaatcagccgggcgtggtggcacgcacctgtaatcccagctactcggctaatttttgtattttttttagcagagatggggtttcacgatgctggccaagctggtctcaaactcccggcctcaggtgatccacccgtctcagcctcccaaagtgctgtgatgacaggcgtgagccactgtgcccgtgctccttggggtctttctgctcaaggcatccgctttct

SEQ ID NO: 483455 - DNA, 102 bp, Homo sapiens
cagagataggcgcatctctggagttgatcgttactatgcgtcataggttttggcgaacaatgattaaggaagcatttcctgattgatgaaaaaaaataaagc

SEQ ID NO: 483456 - DNA, 1382 bp, Homo sapiens
ccacgcgtacgagaatactgggatacccgtcgcagcatggtgtttgccaggcacctgcgggaggtgggagacgagttcaggagcagacatctcaactccacggacgacgcagacaggcatccccttccagcgaggactggactgaacgatgaagcgtcaagctgggtctccgccgctaacggcggccccatacctgggagatccacctgattaagaccagatctcatctggggtcacagacaggcatgtacccagctctggaaggcggccgacgaggaagcatccgcatcctcatgcaacgcaccccaccggcctggcacaacggtcgtttgactggccacacgatgccgttcacgaccggcgactactgcacaccaccctacaaccagcctgctctcacccgaccactgccctgacagtctcgcaccccaccactccccacccacacctacccaaccccccataccacccgaccccccacccctccccaccctctcgacaccaccaggaatacctagctcccacaccaccaccatgtctccccaactaccgcacccccctccccctcccctcccacaccactctcactcctcacacacgcgactctccatacacacgcataccaccacacctcctcgcccccctccgccaacaccccacacaaaccacctaacacacaaaagcataccctaccctcaaccactcaacaaccaacacgcctattcttcacttctcatcacaccaccacacccgctcaacccacatcaacaccaacatgccacccaccctcatccctcccaaacaacccacatcaccacccacgcaccccacacactccacacccaccccacaccaccacgccaacaataacatctaccaccacccgcacctctcaacccatcacctaccccgccactaccccacaaacaacatacactcccaccactcccccacacaccaccacacaacagctacccataccccctacaccaccaagcactccaccttacctcaactatcctcaccaatcaaactccaccacccacacacccccctcacccatcctccactcgacctctccaccacatcctcgcccgcaccactctactaccattctcccacacccaaacacacacctcacacaaataacacctagcgtccgtcacccgcactctcccaccctctacacacaacacacagcacacagaccactccgcccacaaacctcccgccgcgcgcactgcctccaccacacaatcaacacaatataacatcaaacgcaagtaaaacagacataaccacagaacgacttaactcacttattcgatgacaactgcccactacctctattctttactatcactctcaccactccacttcac

SEQ ID NO: 483457 - DNA, 165 bp, Homo sapiens
agagagtgtaacaggatgatggagggaatagaagagagaggagtgtaacgggatgatggagggaatagaagagaaaggagtgtaacaggatgatggagggaatagaagagagaggagtgtaacaggatgatggagggaatagaagagagaggagtgtaacaggat

SEQ ID NO: 483458 - DNA, 314 bp, Homo sapiens
  misc_feature (54)..(54): n is a, c, g, or t
caatggcactatctcagctcgctgcaaccttcacctcctgggttcaagcaattntcctgcctcagcctcctgagtagctgggaatataggtgcacaccaccatgcctggctaatttttgtattttcagtagaagcagagtttcaccatattggccaggttggtctcgaactcctgacctcaagtgatctgcctgcctcagcctcccaaagtgctgggattacacgcgtgagccaccacacccagcctccatctttaaacttttaaaatgtgaaatttctatcatgtaccgttagcctaacaagattttttttcc

SEQ ID NO: 483459 - DNA, 439 bp, Homo sapiens
  misc_feature (15)..(15): n is a, c, g, or t
  misc_feature (226)..(226): n is a, c, g, or t
  misc_feature (229)..(229): n is a, c, g, or t
  misc_feature (233)..(233): n is a, c, g, or t
  misc_feature (243)..(243): n is a, c, g, or t
  misc_feature (371)..(371): n is a, c, g, or t
  misc_feature (383)..(383): n is a, c, g, or t
  misc_feature (408)..(408): n is a, c, g, or t
tcagttgacctttgncccctgatcagagtgggagaagagcccgaagaagaccctgaagagcaccggaagcccccccccgaaggccagggcaggcgaagattaagaaatggttgtggggcccaatgaagaagaagaacccgccaagggttttcccgctgaaaaagatgaattgtaaattattctctccccctttgggtcctgtgggagagggaatgtgaaatttacntcntttntttttggganagacttgttttggaagccccctaatccccttttcccctgccctgtaaaatgtgggattttgggtcccaggaaaaagtgggttttttagttgaattttttttacccttccccatgaaggtaaatttggnctatttaactgnctttttttgaggtaaaattttgtcntgggtttaaaaataaaaaaggtccccaatta

SEQ ID NO: 483460 - DNA, 376 bp, Homo sapiens
aggtgactagaggatccacagagggctgcgaaaaggcggagccaggtggtcctccatttcttccagctgagggcaggaggtgctgaacaggttcctgctgaccagcacggcagggctcccaggtctgcatggcgatgttgaaaaagaagttgcggggacaggcactggctctgcgccggggcccaagtgcttttcggctctgcacacagcgaggccttggttcttggaacaaagatccgaagcgtagcccaattctcttcggtccaaagggcttttgccaaacatccaggatgaaagggcacgccctcccaagcaaaggttggtcccatggttgcactaaggaacgggttgcaaaagggtcgggcgttacaggggt

SEQ ID NO: 483461 - DNA, 431 bp, Homo sapiens
gtagagacggggtttcgcctatgttggccaggctggtctcaaacctcctgacctcaagtgatccacctgcctcggcctcccaaagtgttaggataaacaggtgtgagccaccgtgcccggctgaagatttttcttaattgcaataaatattcagcagtttttctaatgaagaattcttaccagtagagcattttgagacttcagatagctttacggaagtgttaataatagtatggagaaccatgttttttaggttttttctttttttctgtcatgcgaataggaagggggcgcttagtacacttaaaacatatctcttcagagatgggaaggatcacaaagaatgaactctaaccggtcctccctcaaagagcctacagtatcgtatagcgcatacagtctctggatgaaattacttgacttacaacctt

SEQ ID NO: 483462 - DNA, 839 bp, Homo sapiens
gtcatgtgtgttttccccagagatcagccagaggaggagcgggggaagcaggagtcctctcctagcccatcttgggagggctaggcgcatggcatagagggtggcgcttcaaggaggacagttaggcgtagtgcctgggagtagactcaagccaggccccttgcaaggcagccagctctgaagtctgggggacctcagcaaaggcaagttcataccaggcattagggtccaggaggatggggaccttcatggtgccacgtggcacagtcacagacttcctggtccctccaagtggttctggaagctgaagggaggtctctagtgacagtgacaggtcctagggctctgtgctcagctcggtctgtaacacagatgaggacaaataccagaagctgattgcaattacagactgatacgttagaaagcagaacttagcaagcttctcagaattagtcctcgaccaactcaggacaagaccaatacaagcactaccctgaggtgccacagggcaggttccacatagattgcaccttgatcccttgactcacccatctgacttcgcggaatttgtcctacggatgtgtcccccatgtgctcaacgatgcgctccacaatgttcactggcgcctggtcttgacacgaccccaaacccggaagcctcgtgaccctaagggggacccaatgggggaccctgcacgcactagaaccggcccctccggccccttggcacggcgaccccccggcacaccgtccgacaatccacgaccgcacccggcactcccaaccttagaagccgggcccggaacacggccccacgccggacacgcggccccccccgg

SEQ ID NO: 483463 - DNA, 150 bp, Homo sapiens
  misc_feature (94)..(95): n is a, c, g, or t
  misc_feature (126)..(126): n is a, c, g, or t
  misc_feature (146)..(146): n is a, c, g, or t
gcacgagcttctctgtgcctcagttccctcaggaagaactcgagtattcactctttcccgtgcgctgagcacacgtggaggggatgagggcacnngagaggagcagctgcagtcaaccatgagggngatcagaggccagtgaaggnttat

SEQ ID NO: 483464 - DNA, 3314 bp, Homo sapiens
  misc_feature (3236)..(3236): n is a, c, g, or t
  misc_feature (3277)..(3277): n is a, c, g, or t
  misc_feature (3291)..(3291): n is a, c, g, or t
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggcctcacttcccacccttggcctnatggctagtgtcaacggctgatcgaagacccgacccggagnactgataacactgntgatccagctgcttaccagcccg

SEQ ID NO: 483465 - DNA, 2126 bp, Homo sapiens
catcttcctttcctccatgctccctttttcttcttctttctctccatctgtcttctgtggtaatctggtctctctgtctcttttcctgacactttttcttttcccctgagtgcttctgttttccatctacttcttttactttcttgatctctggttctttgacatctgtgttctcctctctcgctctttttctgcctgtatctgtccatctgatgcctctcttttcctggctccatctctgtatttccctgtctttctcttgcccttctttctctgtggcccgggcccagttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggtaaccctctttccccctagctccagttccctgtttgtgttcctcctgcacacatacaaacacttccatcagaatcctatacaatatggaaaaacaacttgctagaacacagtcatcacccttgagtgagtctccctgcctgtgtatcctacccttagcagttgtaggagtgtggctcataatgtctctcctacagcttctttcctctcacagactatgaactaactcccaacttctgcttcctctctgttccaggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctt

SEQ ID NO: 483466 - DNA, 211 bp, Homo sapiens
gacgtccacggcatatgcatcagatcctcctcgaaagtaacttccgggtccgggtccgaaagtgccaccgccaccacgtgaatccccaaagccaaagtggcctcctcttccactcctagaactctgaacttccggcatttctggtctagacaaagcctttcttacttctgcattatgaccatggatggtatggtatttctgcaatacgatt

SEQ ID NO: 483467 - DNA, 529 bp, Homo sapiens
gctgatactggcatttgtagatgtggttgactatttctgtatgtctccatctatgatgagggccttaaaaaaaaaaaaaaaaaaaaaaaaaaaaaaaaaaaaggggggggggaaaaatttcccccggggggccccattacgtccccagtttttggtgtttcaaaaggtgggcccttatagagggggtgcgattattaatagaagcatagaggcaagagggcggggttataacaaggctggggatcgtgggaaaaaagctggttagtgggggatatcttggggggagggaaccccctaatttggtgggggggggacatattggtggggaacaaacttcccttaaagaagagaatttaaaggcgctcaagggggaaaataataaaaatttttaagggtgtgttatagcgtggtggtaaaccaacagtgcggcaataatggcagtggcggcctagaaaagcattggggctcaggggggtatatgacttttggaaaacaatattttcacgcgggctgtgtagaaaaaaaagat

SEQ ID NO: 483468 - DNA, 3011 bp, Homo sapiens
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacaggttggggagactctcgctgctttctgctcctcaaggggatctgctcatcctcatggggtttctcgttttgcctgaggcttcctgctacctttaattccaagtaacttccaatgaagtatgttgcatgctgactccgatccttgctctaaatctttcttaagtatccctcttaactccaaagctggccctaatcccacctttattcttaattctaacgaacctggttagaactgagtttgttccaaacctaacctttacccattcctcttcaggagcccttagttccctttcattattcagtttctccatctctacctgtctgttggactgagtgcagtctgcaaaaccctgttacctcttctgtctgctgccttctttgcagagcttcacacactgtggcagaatgaggaacgggcagctatttcctcggggaaactcaatgagatctggcacagaagacatgactattggcttctggctgggattgtcctgtatcctttgatacacatgcaagaaggaaaaggttctctcaagctggca

SEQ ID NO: 483469 - DNA, 1775 bp, Homo sapiens
  misc_feature (626)..(626): n is a, c, g, or t
  misc_feature (1436)..(1436): n is a, c, g, or t
gcaacacttgctccctcgaaggaaactaaagcttatgcagagtcaacgcccgggccttggcaaaacagcactgcattctaaacatccctctcatccagacacagctggcttcttttgcttatgctggtacttgtgacgactggcagctcctcacttcatgctcaccacaaggacatgggaagatgcaagcttgtgctgaagacatctctgcggcctcaacactggccaaactcctatcccagccttcacacatagggtttcaaaggcccaaattccatccatgatcctcaagcgcctcccgatgaatgataagcctggcgactataccacgcgcatggccccgatcgccacacccagcatcgcccgtgttcctacaaatatctcatatgaataagtattaatttaaggcctaaagcacagcaagtgcgacgcggcatcatttcgaacgccaagtgtggagtatgagggcaccccaaggtgtacacttgcacattcttatgtgaacaaaccttcctccgtgtgtaaccctgttccgatgttggttgaatttctatgtgccctatggcccgtattggagccccgtttcgtctctaaacaagctatgcctaagggggaatttacactanaacgcggttggttggtactgcctttataactgcaattacaacggtgggcaatattacttttgaagacgcttaattgcggctcttatggtccaaccatcaccgatggaaaattttccctaatcccctgtttgagtcccaaatagaaacggttataatgaaaaacaacgagtttaaacctcgagttggagggaatccccagttggaccacctaatacccccaatatggaaatggcccttttgttggcatatggaaacttcgtactataacaacgtttccgaaatggaacagggattccagcgctggaccgaagataccaaacagaaacaggtgttcgttcatattccgaagaacacttattacatgatgctatacaatccatttctctaacgccttgtcaataaacttactgaaactttcaatcacgcttatcaatccttgattaaacattctcaactgttcgtagacattctcaacattcataaaggtccgtggaacagcaatccaaaaacaggaatgttaccttttgtggaccacctacccttgggtgtacaaggaccccgaccaaaggaaagccctgtggtggcacaggctttgtccaaccggagtgggggcttcgcctttggaaccttcctcacaccgagcgcttccttatatggcaattgtgccaagcgacgtccatgcggaaaccaccttttccgcccttaggtgattttaaccaagggggcgccacagtccccttgtgatcaccgagacgtcctttccgaagggtcccccttatacacctgtaggaaaagagatagaagggattnacaggaggtgcgaacactttaacccaagcgcggttaaagggtgtcacaacccccaaaaagccaaagataaatcgccccgcagagaccatttacaatataagcgtattagtacgtaataagtctatatataactatactatagagggttcaacgcatagcaacaatcaagccgcggattcatcgcccaatctcacttgggtctgggccccgggaggaggaataagagccgcacatccggaaaaaccgtttacccttaagtgagcctacaaacgacgaggaagacgccctttccctgtaatccctttgggcgaacagtcccaccaaaaagcgggtattgaa

SEQ ID NO: 483470 - DNA, 2313 bp, Homo sapiens
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagttgacgccgggagtaggggggagagataccttggatgacattccacggggacaactctctcg

SEQ ID NO: 483471 - DNA, 135 bp, Homo sapiens
gcgtatctgagatcccttggtgtcttttctggtagagtaaaggggtatttcttctcgagctatgaccgattatttatctttgcttattaataatattagaaaaatgtcccagaaatagaagtaacaagagctttg

SEQ ID NO: 483472 - DNA, 438 bp, Homo sapiens
  misc_feature (1)..(1): n is a, c, g, or t
  misc_feature (75)..(75): n is a, c, g, or t
  misc_feature (128)..(128): n is a, c, g, or t
  misc_feature (263)..(263): n is a, c, g, or t
  misc_feature (281)..(281): n is a, c, g, or t
  misc_feature (298)..(298): n is a, c, g, or t
  misc_feature (325)..(325): n is a, c, g, or t
  misc_feature (362)..(362): n is a, c, g, or t
  misc_feature (389)..(389): n is a, c, g, or t
nggccgccagtgtgctggaaaggtccgtcaggaaatcgtcgatgaccaccacgttggggcggtgttccaggtagnggcgctggacctgccccgggtgccacgatggcgagagagcgcgcgcgacccgnggcgcatcggcaacgtgaaccagccgcccgaaggcgcgcccgaccgtacgctcgtcctcgtcggtcagcggtgcccgggcgatgcccagaccggacagccttgccagcgcggccttgtagtcagcgatgatcgantccagtggggcatcgatnccccggcggcgcaagtnctcgaactgatcgatgtcgtggcgcanttgcccaccgacaggcgcgcgttggcaatcgggcgtntacggccgcccagccacgccgggtgcnacgcgctgccccgctcgagtcccgtcaggatcgtcgccagatcgccggc

SEQ ID NO: 483473 - DNA, 1455 bp, Homo sapiens
  misc_feature (1422)..(1422): n is a, c, g, or t
  misc_feature (1426)..(1426): n is a, c, g, or t
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggtcagancatnaggtgtatcctcaagagtcagctatggct

SEQ ID NO: 483474 - DNA, 1333 bp, Homo sapiens
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagctgtgcttcctctcctggttctcaaaaattccaacttatcttcccaatgtcccttttactccagcctcctcacagacttcacgaactgctgccacacttggctcagcctggtctccatac

SEQ ID NO: 483475 - DNA, 1372 bp, Homo sapiens
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaaggtgagaggctttgggggccagacattatctatcccaggccatctccaaaaggcagtatcctttactcagccttgaagtaggagggtctgtcccccttaaaacagtagtggacctcaaacaacttcttcgtctaatagctgagaccatcgtgcactcgaa

SEQ ID NO: 483476 - DNA, 233 bp, Homo sapiens
  misc_feature (12)..(12): n is a, c, g, or t
  misc_feature (176)..(177): n is a, c, g, or t
aggaagttgtgnccgtgcgccaggagctgtcccactaccgcgccgtgctgtcccgataccaggcccagcacggggccctgtgaggctgccccacatccccacctgggagctctccttcgccttgctgagacttacgccctgttcccttcctgccctggtgccacgggccggccagnngggtgccccagggacgtgataatgcagataaatacatttatatttttaagaaaaaa

SEQ ID NO: 483477 - DNA, 140 bp, Homo sapiens
aggtacctagatccgtatagagaggtagtgagcatgtgtcgacacttttcatttctaggagggatcagagagtgatgcagcagaaagagtgtgaggtcagcagattcggagtgaggatattgaatataggtttgtcactt

SEQ ID NO: 483478 - DNA, 119 bp, Homo sapiens
ccaaggattctcaactagggggacactcactctatctatttcgcacgccacatgataactgatgtgcgactggggaccgcgacggttgccactgcatggcataccacagcatccctact

SEQ ID NO: 483479 - DNA, 845 bp, Homo sapiens
agcggagtcgtccgttgggtttccgcgccagccgcagatcttggaccataatcatggtggacatgatggacttgcccagattcatcccaccggaaaaatgtttattctttcagagtggacgacacgggaacacagagtggaaccatcgagttgtaatggaaacccctgtgatgaatgacatctctggcaattgtggtaagtggttggagatgagtaaccgccaaggcgctactcatcttgtgtacagtcttatgtccacgtttacaatgaagatagctcatcgctttggactcttggagctttaccatgtgaagctgtgaaaccattgtccatgacttccctcaggtataatcctttagggacttgtgcgacatgagtggagtcttgatggattttcatacgacttgtaaattgagctatattaaaggtctattatgaggaatgccctctctgggtttgaggaatcgaacctcacaagcgacagatttctccacacggagtgggaatggccgggcacataagggggacccagaatgctgtgccgagggaggggtgcctcggaacgccaaactttgtgccacccttgtgattagcggggttaacatgtcacacgatcggggtgaggggaaagtcccccactggggaggggcaccaatctcgcgtggataagcacgggggtgtatgaacaagacttagtgaaaacgcgagggtcctaaacaaattgtcccactccgaacctccggggcacagccacaaacaagcgggaaccagggggaaacctatgatacgctgaatcaaagggctgcacttggaagggtgggggcccagagagagttacctggtga

SEQ ID NO: 483480 - DNA, 427 bp, Homo sapiens
ggtcggtacccggggccagagactggattaagtggccctaggagacgggacgtgctcttattctcgtgatctgatactgctgatttctgacccttggtctgatcagaatcctcctttatacagcttttatgaagttattgtccagctgggcacggtggctcgtgcctgttgtcccagtactttggtatgccaagctgggtgtcttctgaggtcaggatatcaagatcatcctggtgctaacacagtgaaaccccatctctactatgaaattcaaaaaacatgaacgaaattagccggcccttggttggcgggttgcctgtattcccagctacggggaaggctgaggaaggaaaatggcgtgaacccggaaggcggagctttgcagtgagccgagatcacgccattgctctccagtctctggcccccg

SEQ ID NO: 483481 - DNA, 121 bp, Homo sapiens
gagcagtggaagggaagaagagactgaaaataaactatataatcgcccattaagcaaggagatctctactgaagttcagctaagtacctaagctaccatataatttgtataaggactgagc

SEQ ID NO: 483482 - DNA, 754 bp, Homo sapiens
  misc_feature (187)..(187): n is a, c, g, or t
  misc_feature (192)..(192): n is a, c, g, or t
  misc_feature (197)..(197): n is a, c, g, or t
  misc_feature (205)..(205): n is a, c, g, or t
  misc_feature (243)..(243): n is a, c, g, or t
  misc_feature (255)..(256): n is a, c, g, or t
  misc_feature (307)..(307): n is a, c, g, or t
  misc_feature (331)..(332): n is a, c, g, or t
  misc_feature (341)..(341): n is a, c, g, or t
  misc_feature (362)..(363): n is a, c, g, or t
  misc_feature (427)..(427): n is a, c, g, or t
  misc_feature (430)..(431): n is a, c, g, or t
  misc_feature (435)..(436): n is a, c, g, or t
  misc_feature (439)..(439): n is a, c, g, or t
  misc_feature (457)..(457): n is a, c, g, or t
  misc_feature (461)..(461): n is a, c, g, or t
  misc_feature (466)..(466): n is a, c, g, or t
  misc_feature (469)..(469): n is a, c, g, or t
taacattaaaatgtacaactggtgatgttcaaatgttgtactactactcttcaatgtactgtgcaggaagtgggggaacagttcatactatagagagttacagtttagatgtatgtgtaaatcgattagctatttatccaactactgtatatttaggtaactagaatttcaaaatagaaaaaaaaanacggngtccngtttggcncatagaaagaagcagatcagatggtcctatgtggcgcngtatatatgaanngttgggacggtacatctaaagaatgattccgtcctaacacccacccagccngttggaacacattctaatggtctnnccattggtngcatttaagtatgagatgacnngatcttatgaatgtctcgtcagcacaactgtcataatttcaacagtcttggcgagtatacatgnttnnctanncangttgacaactgtttcatnctgnaaccnttncctaactttggtgtgatggccaggtaggagttcaaaaatccaaagaattacccactgtaaggtagctgagcaaagaaagcaaaaagaacaagacgacgaaacgcagcccagtgggggcacgcgaggcaccccccggacacgaggtcttcagaaacaatgtcggcggacgggcgaagcccggcagagagagaagacggacgcacgggcgccagaggagcagggggagacacgagggggtcgcaacagaaaaggcagcgggcccgacggctggacaaccccaacggg

SEQ ID NO: 483483 - DNA, 119 bp, Homo sapiens
caccagctattctattctaacagaagtgactatagggaattaatagctcatgacacactgagaaggttataattgtagatcggtgtgaatcccacagcagaatgtatcttggaagctct

SEQ ID NO: 483484 - DNA, 164 bp, Homo sapiens
ccagctctcgcagagatcgaggaagggctgctgtacagatttcctgccccaggaccccatcccgcgctgatggagggtcgcaggagcaacgtgaaagtggaggctgaggccagccgacaatgagggttggactggtgtcttcagacccaggacctcaaacttct

SEQ ID NO: 483485 - DNA, 112 bp, Homo sapiens
  misc_feature (84)..(84): n is a, c, g, or t
gattttcagttttgcctgcgtcataaaagagagcactccattgctttttttcctggccacactgctacaatccagcactactanccatgtccagggtaaggatcgagatcga

SEQ ID NO: 483486 - DNA, 87 bp, Homo sapiens
  misc_feature (13)..(13): n is a, c, g, or t
  misc_feature (33)..(33): n is a, c, g, or t
tcgcaaaagaagngtaccataactcctatttcnaatggctgattgtagtagcactggaagtttatcaaaacccaggtgtaaatatgc

SEQ ID NO: 483487 - DNA, 424 bp, Homo sapiens
agctctggtccagattgggtctgaagtagcaccccatcctagaagctctggacacaggataggtgctttagcctacataggtttccaagcttagagccttgctggatctctcaccctctgtaactttctttgaactacctttgaagtcattgccaaaaattccgaagattgggccagagagacattgactggattgactgaatatttaatccagtcccccctactccaaatggcaatgagtacaggttttgttttatttcatatcttatacttcaacaactacaaaaacatagtaattattagagcaaacaattttcactgtgagtaacccccaaactttcccacaattctcacgataaaacataaattaattgctatgcctaggaaatttgtattttcttaattaaaattttaagttaacagt

SEQ ID NO: 483488 - DNA, 111 bp, Homo sapiens
cacaggcaccacaatcctacctccatcgatacccactaaaacactcaccaagacctcaacccctgaaccccatgcctcaggatactcctcaatagccatctactgtatcgg

SEQ ID NO: 483489 - DNA, 726 bp, Homo sapiens
  misc_feature (74)..(74): n is a, c, g, or t
cttttgcggagcatgacgtgctcattttcgtacatctgaggaactgattacactgatgatctactgtgttaganaacaatagaagagaatgcctaattattaaacgaggaacttactggctaaggattaactatcttttgggaaggaatcacatagccaaacctaatgttcttaattctatttatccataacaacacacgttgacagttgttggaccaatgatagacattaaagcgcaaaagtctaaaagttgatggaagggatgaccttcctgtgaaaagggatgctctttcaacatgacgatcatgaggatatgtaatgaacctatattcataatcatttgcttatacaagaaagtgggataaattggttggtgagatcagagaagaagaaaagaatgaatagctggagggagatgcatcttttaacagattatttgagcacacctcattctatggatgctgttgagatgtacacgtgccatgatcgactcctttatggagtcgggtggtacagatttgactaccatctggactggatgttgccataggatagttgtagcacatcgtcctggtggtctggtatgcaaaaagaacttacagaataactttgttctcataaactaaacatctcaggtctcgatggcctctctcgtggaactcgactgtacgtataccgttatgtgaggggttaaacactgacccatgatgcctgactccataaaca

SEQ ID NO: 483490 - DNA, 174 bp, Homo sapiens
  misc_feature (89)..(89): n is a, c, g, or t
ttggcgagagacactataccccaatgcatccctgctgtccagaactgtcacccagaatgacacaggattctataccctacaagtcatanagtcagatcttgtgaatgaagaagcaaccggacagttccatgtatacccggagctgcccaagccctccatctccagcaacaactc

SEQ ID NO: 483491 - DNA, 600 bp, Homo sapiens
gcagaatcagactatcaggaaaggagctggccagggccacagccagtcaagatctctgagcaacttagagacatggtgtcagggtatgaagcttgcatttaatacatttatacataatacattgtacatttaattcataacgtctcttggtcacagatgccttatatataaaataagtgccagatctctaagatgcctagtacaccttgtatctcatttgatgtgatacccagaagagatcatggtttgttggttcgtttttcaagaagatccttcgtgatcaccatgctgttctcatggtaagaactggagttatgttctttaaattcggacatatgacattttatgtcagcactttatcaccaacgtgcaaagcgacaaataccaccgctgcttaatcactggcttggcttctcttttatcgaaccatgatagatcactatgtatctacaacagagtactaataatcaaaacacagtacaaccattctatttctctatggtctaccagcatgccagtcaatacatatggtaggaccaataaataaattatcaattaacacatctcgtgtcacctaattcaaagcatagcgataaatga

SEQ ID NO: 483492 - DNA, 385 bp, Homo sapiens
tttcctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggccttttttttttttccttgggggggcccaactttccccccccccattttttttgaccaagggggcccttttggggggtttttttttagcctgggcccgggccgtttttttccaccgtcggggtggggaaacctgtttcttggggttttttgggagggaccctttttttgggggggggcctttttgggccaccctccctccggaattttaaggctttggggaaattttaaattttttaggggtttagggggtaaacctccctgcttttcc

SEQ ID NO: 483493 - DNA, 797 bp, Homo sapiens
  misc_feature (202)..(202): n is a, c, g, or t
  misc_feature (288)..(288): n is a, c, g, or t
  misc_feature (345)..(345): n is a, c, g, or t
tgcccttttttttgtgcctcaaatctgaaggccttttatgtatagattgtactaggacctgcagatctagtgtctttactcatcataggtaacaattggatttagcgagaaaatataggtatttctgttttgagtttcgttaacagcaaattgtttagatgggattaaaggcccaaaatgtactctagttatctttgtggancccatggatgaacacctatatatatagagagagagtgtgtgtgtgtatgtatatgtatgtacgtgtgtatactcaccgttggactnaaactcaggtaattctactgcctcagcttcttgagtaggggggattacaagtgtgtnccactgtgcctagtttatgttgtgttttagtggtgtaaatcttgtgtaccaggtcagaataattgttttagttggaggagctaagttgaaataagtatttggttatcataagttacagttcataagcactttaaaaataaccccttttcttcaattaactatatattggcttggtgtgttggctcacacctgtaattctaacactttgagaggccaaggtgggtggattgcttgagcttaggagtttgaaacccccctgggcggcatggcaaaacctcgtctctaccaaaaatacaaaaattacctgggcatggtggtatgtgcctctggtcccagccactcaggaggctgaggtgggtggattgcttgagtccgtgaggtggaggctgcagtgagtggagatcgcaccactccactccagcctgggtgacagagtgagatcttgcctcaaa

SEQ ID NO: 483494 - DNA, 101 bp, Homo sapiens
gcaatgcagctcaaaacgtttagcctagccacacccccacgggaaacagcagtgattaccctttagcaataaccgaaagtttaactaagctattctacccc

SEQ ID NO: 483495 - DNA, 1192 bp, Homo sapiens
agcgggcttgctctctggagctggagccggagctgccgccagccgcccgcctcagtgctctctctgccagccgtgctggccagtgccctgcggggtggtcgggggggagccgggcggcaagagaaggagtggagcgggtacggtgcctcctagcctgaggaccggtaagccgaagcccttgagcctgctcgcttgcctgctgcctgccgccgcctgccgctgaccctgcgatggggaacaacggaccaacgccggccgagctaggctgccttgccccaaagccccgcgggaaacgcgcaaccccagccacccaaaatgccccaagaacaccgtgacccgttgcgttggcaccgtggccctcccgcagggcacccgagcatgacacgcgccaccacacgacgttctcacagccaccgggcacaggacctgtcccctttacaaacacgcctctaccacagcagacacattcatttatcacgttccattcccggacgcatccacatactcacccacactaaacacttatattacactcccatgaactcacacatattaattatataaataccatatacacgcacacaaaaaacctatactattaattacatatcacgtacctcaacaataatctattctactgtctacaatacacacactacacagcactagacccaccaaactaccacacctaccacccaccgtcagcaccccactatttccagaatgacacaccactccctaaatccaccccccaatactcacaaactaaatctcgaaacttacactacactaaccacactactaccacataccaacacaacgtctcccacatcctgtcttctcaaccatcaacagcgtaccacctcccaacacacacaacctactactaccctctcactagatcccatcttcagtccttcctttagttcatcatcaattagtctcttcagcaatcataaactttcataatctactcacatgtgtacacttcctacacttcacatcttctcttacttcctctacttaatatctcattatattcatatcactctatgtagtaccttactcctattactccaataactacactaccttatctctattaactaccctactttaatattatatactatcatctattttagtagattctcaatacacagcttaatctaatatgatctctctacttctt

SEQ ID NO: 483496 - DNA, 540 bp, Homo sapiens
  misc_feature (187)..(187): n is a, c, g, or t
  misc_feature (189)..(190): n is a, c, g, or t
  misc_feature (219)..(219): n is a, c, g, or t
  misc_feature (283)..(283): n is a, c, g, or t
  misc_feature (288)..(288): n is a, c, g, or t
  misc_feature (291)..(292): n is a, c, g, or t
  misc_feature (297)..(297): n is a, c, g, or t
  misc_feature (320)..(320): n is a, c, g, or t
  misc_feature (322)..(324): n is a, c, g, or t
  misc_feature (335)..(336): n is a, c, g, or t
  misc_feature (344)..(344): n is a, c, g, or t
  misc_feature (348)..(348): n is a, c, g, or t
  misc_feature (370)..(370): n is a, c, g, or t
  misc_feature (438)..(438): n is a, c, g, or t
  misc_feature (446)..(446): n is a, c, g, or t
  misc_feature (480)..(480): n is a, c, g, or t
  misc_feature (504)..(504): n is a, c, g, or t
tgagagttttaaataactctcaaagggggaactgtggaaatataaatttctatcaactaattccaaatgaaaaataatctacgtataactgaaaagttatattctctggtttttaattatataattttattaacatcccagctaggaaggacattaaccttttgtctctctgataacaggctaagcnanngtaatgcaaattgtcagtttcacagcatngggtgtctattgttttctcttttcgatcaaatggtcaggcggtttctgtctccagaacatgatnagatnaannctganaagcagtttaccctgccgacccnannnttaatttgcannctttgttnagcnatatcccctcctcctaagaacncaatatagccatgaaatctttgtcttaattcagacttgtgtgagacttgtgaaagaacttgcagactncggacctntagtaggctcttgcagacacggacatcttaaagncgctgtatgactgcagattaaccnacacgtctcaataaaggaattctgcttgtttcgaga

SEQ ID NO: 483497 - DNA, 804 bp, Homo sapiens
tcgcgggctcagaccgaaccgactcgaccgcgccccagccaggcgccatgctgccgcttctgctgggcctgctgggcccagcggcctgctgggccctgggcccgacccccggcccgggatcctctgagctgcgctcggccttctcggcggcacgcaccacccccctggagggcacgtcggagatggcggtgaccttcgacaaggtgtacgtgaacatcgggggcgacttcgatgtggccaccggccagtttcgctgccgcgtgcccggcgcctacttcttctccttcacggctggcaaggccccgcacaagagcctgtcggtgatgctggtgcgaaaccgcgacgaggtgcaggcgctggccttcgacgagcagcggcggcaggcgcgcggcgcgcagccagccagagcgccatgctgcagctcgactacggcgacacagtgtggcttgcggctgcatgtgcgccccgcagtacgcgctaggcgcgcccggcgccaccttcagcggctacctagtctacgccgacgccgaccgctgacgcgcctgcgcgcgggccgccggcccccccgagccgcgctcggcttctcggggcgcgcacgccgcaggttggtgggctcggacgctggccccgggccgcggcaccaaccactcgccttcgacaccgagttcgtcaacattgggcgggcgacttcgacgcggcggccggcggtgtcccgcttgccgtctgcccgggcgcctacttcttctccttcaccgctggcaagcctgccgcgtaagaacgctgttcggttaaggctgtgacaga

SEQ ID NO: 483498 - DNA, 421 bp, Homo sapiens
gttaaaaaaaaaaaggggaaaatgtgaaaaaaaaatatcttgggtcccttcaaaatgggaactgctcagggcaaatttgccttttattttattcaagtcatccatttgctcacaaagacaaatgcatattttgattgcctcctttggaaaaacttatcagaaactcaaaaaaatgcaaccatttgtttttcccctacctgttactttgaagcccccaataagggggtcttgctttgagctgtttccccctttccggacggaaataatgtactttttacaaagtgattgatgtttcatgtctccctaaaatgtataaaaccaaactgtggccggacccccttgggcacatgtcatcaggacttttttagggtatgtccctgggcatgttttcaaccttggcaaaataaacttttttaattta

SEQ ID NO: 483499 - DNA, 561 bp, Homo sapiens
  misc_feature (187)..(187): n is a, c, g, or t
  misc_feature (189)..(190): n is a, c, g, or t
  misc_feature (219)..(219): n is a, c, g, or t
  misc_feature (283)..(283): n is a, c, g, or t
  misc_feature (288)..(288): n is a, c, g, or t
  misc_feature (291)..(292): n is a, c, g, or t
  misc_feature (297)..(297): n is a, c, g, or t
  misc_feature (320)..(320): n is a, c, g, or t
  misc_feature (322)..(324): n is a, c, g, or t
  misc_feature (335)..(336): n is a, c, g, or t
  misc_feature (344)..(344): n is a, c, g, or t
  misc_feature (348)..(348): n is a, c, g, or t
  misc_feature (370)..(370): n is a, c, g, or t
  misc_feature (459)..(459): n is a, c, g, or t
  misc_feature (467)..(467): n is a, c, g, or t
  misc_feature (501)..(501): n is a, c, g, or t
  misc_feature (525)..(525): n is a, c, g, or t
tgagagttttaaataactctcaaagggggaactgtggaaatataaatttctatcaactaattccaaatgaaaaataatctacgtataactgaaaagttatattctctggtttttaattatataattttattaacatcccagctaggaaggacattaaccttttgtctctctgataacaggctaagcnanngtaatgcaaattgtcagtttcacagcatngggtgtctattgttttctcttttcgatcaaatggtcaggcggtttctgtctccagaacatgatnagatnaannctganaagcagtttaccctgccgacccnannnttaatttgcannctttgttnagcnatatcccctcctcctaagaacncaatatagccatgaaatctttgtcttaattcagactaattcagacttgtgtgagacctgtgtgagacttgtgaaagaacttgcagactncggacctntagtaggctcttgcagacacggacatcttaaagncgctgtatgactgcagattaaccnacacgtctcaataaaggaattctgcttgtttcgaga

SEQ ID NO: 483500 - DNA, 496 bp, Homo sapiens
ggaggtaatagatgagactgtagtaaaagtcatgtattggggaagaggaatgggggtatattctgtgggcgtcgaatgaggaagatatcagatggctagatgacgggacatctcctagaactggtgggtgctcccaggggctgccttctgggccttgccctaaggtgacctggcggactccaaggttccccaagctggggggaatactagttgatctgcctgaggcttaagagccaagcagtggaaaagaagaggcaagaccagtgtggggatccccctgggaaaggcaccaaggggttaggagggaagggaaaagggcaaggagttggggaataagaagcagcaggacttagtggggacgcaggttctacttcacagacgtcattcatgctccagcaccagcttgctcccagtgtccctggggagccctgtgctggtgttggaacccctgccccctgcctcacaggcagctcaaggccatgttggggcagatgca

SEQ ID NO: 483501 - DNA, 512 bp, Homo sapiens
cggcatgactgcagccgggcccagtgcaccatcaccgttgaccatgtagtcacgtgaggcctgatagtccgatgcagtagtcatggctgatgttgcagaagaatctgaaatcatttcggaactggttcagaccgtaagatttgggacggcaactatcttctgaacatatggagccacaactaacagatggactgcttgtggcccatcgtctccaagagaaggcttcttgctgtctggtgaaatggctgagcatcaaatggggaggctatctatgcctccaaaccatgagtcgggatgcaatgtggaaaacgaactacaacatctgtatggtataccgtcatgagggatcggcatgttgtatgccatttatctgcactggccagaaaatggagtcttaaaccttgaatcccccataactacctcaactacaaaggataacaatgctgggaattcaaggagatctgaagtggtccacagatccagtataagaggtctcttcatcgtctcgtacc

SEQ ID NO: 483502 - DNA, 366 bp, Homo sapiens
ttcgtactatatattgtacccagtatgtagtttatacttcccccttccctgctccgggtctcccgtatactgttataccactctgtgtgcttaactgtagcttagctcccacttaaagtgggaacatttggtatttggttttccattcctgagttacttcactaacgaataatatgctcccccatatctatccccagttgcttggccacgacattttttatggctaatattccatgggatctatataacacactttataccttcattgtgtgctgggtacttcggttgggcccctatcttttattatgaactgtctagccagtttttcactcgaaacagtcttgatataggtgaaccagttcctaa

SEQ ID NO: 483503 - DNA, 186 bp, Homo sapiens
gtgtccgcccacgggtccgggcatagcctagattcccagcctttccctgcagttctgtcccccccttccaggcggtttccattaaagccctatttttttttctttttatgtacaaagcctgtttttttgtaataatttttgtgtttttcactttttgcaattgttaaataaaacaaatttataata

SEQ ID NO: 483504 - DNA, 122 bp, Homo sapiens
cctgtggacctcagcgtagctgattgagcagaaccggcgagcggcggcggaaggcagcgacgatgatccgatcactgcagcagccgaccagagcccactcctccaagagtgagatctgatcc

SEQ ID NO: 483505 - DNA, 407 bp, Homo sapiens
atgggtgttacgccccttgatacatgattcagagaagagctaaagatgtttccagttccagggaactttgataggagagttgtgagtttacatcacagataaatcctcatttgatcaacaagtattcgttagcacttgctatattccactcttcgaaggtactggccatataaccttgaacaaacaagagttttactttcttagagcctgtagtacgtaattccagataatggtgataaatgtcacaagagaggactagcaaagcactcagtaaatttagaaagcaaggagcacatccatccaggaagctttcaaggagaagatgggccttaaagtaaaggcaggggtctgccagctaaagaaagggtctaaggcttccaggtatcaaggggcggtaacccatgggt

SEQ ID NO: 483506 - DNA, 895 bp, Homo sapiens
agctgtccgggctgctttcgcctccgcctgttgattctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccgtggctggcatctggtggagcggacccactcccctcacattccacaggcccatggactcacttttgtaccaaactccccccccccctgcccaataaaaaaaaatgtgggttttttttttttttttttttt

SEQ ID NO: 483507 - DNA, 840 bp, Homo sapiens
agctgtccgggctgctttcgcctccgcctgttgattctgcgcctctccgaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacatcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccgtggctggcatctggtggagcggacccactcccctcacattccacaggcccatggactcacttttgtaccaaactccccccccccctgcccaataaaaaaaaatgtgggttttttttttttttttttttt

SEQ ID NO: 483508 - DNA, 725 bp, Homo sapiens
ctctgacttcgaacaccagtgagaccgttctcgaccgtctacatcgagcaaactcctacaattgtgccatatatgcttgaatgtatcattatccttgtgtgtcttcatctggatacatgctaacgcagttgggacgagacaatgatgcttttgtatgccgacctaatgcgatgcactagtgccgggtgtactatgagagctgatacacatataacagaaataacgctctgatacggaatggggaatgcaatacaactgcccgaccatgccaaatgaagcagcgtttcccttctacaggctgttcaatgacagtttgccagcgacatttagggactacatgctacctgggtttccaggcacacctagaccaacaagggagaagagtgtcagaatcagaatcatggagaaaatgggcgggggtggtgtgggtgatgggactcattgtagaaaggaagccttgctcattcttgaggagcatcacggtatttcgaagagctgccaagggtgctggtgcggatggacactaatgcagccacgatgggagaatactttgcttcatagtattggagcacatgtactagttcattttggagcttgtggaagttgatgactttctgttttctgttgtaaattatttgctaagcatattttcttaataggttttcctttggggttctacagtcgtaaaagagataataagattagttggacagtttaaagcttta

SEQ ID NO: 483509 - DNA, 927 bp, Homo sapiens
tgcagctcagcgttctagaatgcatgcagtccggtgtggtgagtgtaacccagcgcaaggctcacacattgacatgtgagcgcggcatctggatgccctccggccatcacagctgccatctgattataaccacacaaatggggctaggtgcgacaagcagaagaccctcatgggaaaaccacagaatcatgaggagcaataactcggtgtaaaaaactactaaaataacaggatggtttgtagcacagcaatatacagctgatacactaagcaagctctaggaagctgaagagtttctaagtccctaggacggtcggcataggaatatcttgtatgactggcttgtctgctacacagttctagatgtacctatgtggcatattactcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccgtggctggcatctggtggagcggacccactcccctcacattccacaggcccatggactcacttttgtaccaaactccccccccccctgcccaataaaaaaaaatgtgggttttttttttttttttttttt

SEQ ID NO: 483510 - DNA, 355 bp, Homo sapiens
gcacgttgggaggctgaggcaagaggattgcttgaactcaggactttgaggctgcagtgagctatgactgcaccactgcatttttttgagacgctgtgtcaaaaaaaaaaaaaaaaggagggagggggggccccaaagtccagaagggcccccgggggggggttgtgggaaaaaaatggggtccctgagcagggggccatggcataacacctgaaacccaagcttttggggggcccgggcggctagattattggggcccaggggtgggaacccaccctgccaaaaaggggaaacccttgttttttttagaagcaaaaaaaggagcggggttttttgggggccccttgtaaccccg

SEQ ID NO: 483511 - DNA, 341 bp, Homo sapiens
attttaagtctcataagaaacatttacaatctattctttctgaagcctgctacctggagtcttcatctgcataataagaaccatggtctctacaaccccttatcttaacccagacactcccttatatggaatttcaggtgtgtattttttatttatttttattttttattttctttgagtacccaggctggattgcagtagtgcgatctcggcttattgcagcctccgcctctgggggtcacatgattctcgtgcctcagtctcctgagtggctgggattacaggcatgcaccaccatgcctggttaattttttgtatttttaatagagatgggatttcac

SEQ ID NO: 483512 - DNA, 121 bp, Homo sapiens
cagaatacactcaaaatgtatcaaaaattaatttacaaaagccaccaagggtcatggaggcggcaggtgtatcgtgtggccgcgtgttgtgtgagcctgcccagaatctcatgcgcgctgt

SEQ ID NO: 483513 - DNA, 247 bp, Homo sapiens
gtcaatcttagctctgtcagacctgcctccctctgtggatgcctttacaggtgatgagagtgatctggattaatgggcgtccagtataagagggaaaaacaaatatcacaggtcaaatcgttatttgtcttcaagtttaacaccgtctactgtactaaaagatgtccaacagaatagttgttcaactatgttaattccttttctttgttggagacagagttctagctcttattgcccaggcggaagt

SEQ ID NO: 483514 - DNA, 168 bp, Homo sapiens
tgtttacggtcctggtgttacgtgaccggtacccacacctctgtatgtagtacgtgcgtcggggggtttattgatttatgtatttatttatttagaaacggtcttgctctgtcacccaggctggagtacagtggcgtgatcacagtgcactgcagcctctacctccca

SEQ ID NO: 483515 - DNA, 350 bp, Homo sapiens
  misc_feature (1)..(1): n is a, c, g, or t
nagtacgtcatcctcccctcaagcctcagtttcctcatctgccaattcgggataataccaatagctcattcataagggcgttgtgaggattaaccctgacaacttcataaatcacttagaaaaggcctgaagatagtaagtgctcagtgaccatccagtattcccatgatcgggtacatgtcactagacctttaagttttctttcaccatgtgaattctgggattaagtctaatattgaaaagaaaatctcaggacacaggggagctagcctcaggcagacccagagctgcggtctatcatgtacagactgtgtagtatctgaggctacagcacagtgcatgacaaagcg

SEQ ID NO: 483516 - DNA, 688 bp, Homo sapiens
  misc_feature (239)..(239): n is a, c, g, or t
  misc_feature (282)..(282): n is a, c, g, or t
  misc_feature (303)..(303): n is a, c, g, or t
  misc_feature (350)..(350): n is a, c, g, or t
  misc_feature (419)..(419): n is a, c, g, or t
  misc_feature (513)..(513): n is a, c, g, or t
  misc_feature (521)..(521): n is a, c, g, or t
  misc_feature (570)..(570): n is a, c, g, or t
  misc_feature (627)..(627): n is a, c, g, or t
  misc_feature (673)..(673): n is a, c, g, or t
cgttggggtggaggtgttcggtccttgcctgcttcatgagctcaattcctcaccactgtgctgtgaatggcacaactcacatggtaatgtagcttcacatccagcctgggaagtacacaggcgttaaggatgctcatttcagagacatcgctgactgctgcggcctctacgtttcaaatgatgaatttcttagttgccttgtcattgggcacacaacaaccacagttcatacagcaaanggctgcagtaacagtcacactggttgtggactctttggcacgnacattgctgcttcttgttatnttggaggtgcagggcaagagagataagtaaaatcttaatttgagggntgactaatgaatacttcaagaccacttacccacatcacattctgcaagacagtcaagagaaaggcaagngcatctatctaaggggctatggctcacacactagcacttgtccacgtgtaacacttccatcgcgtgctattccgtctccacgttacgcacaacnactgcaangtgctgtatcacactcatctttaaattacgcagtgtgtgctatctgtangacagttggcgcacgcagggatactaccagagttaacagttgacacaaataaccacnttaaattaaacactaagttgccacttgcatattgagtagacggtantatacatattcatct

SEQ ID NO: 483517 - DNA, 1127 bp, Homo sapiens
  misc_feature (1105)..(1105): n is a, c, g, or t
ggaacccttccggtgggctaggtacgtgagtcgcgcgaggtgagcgagattgtgctacgggttctgggggaatatggaaggctggcttcgtgcagtagtagtggcaggtttgcgcggctttcgcccccttttccaagagaccaacaaagagtccttcctccaattcccatactcaacacccttttggaactatgtgtggtgcttgggactctgctggctgcatccttgtcgcttctgtgtcctttcttcatgcccggcgatcgcgtcttgtgctggataagcggccctgtcgtgccactctcttattcttctctcttgcgatggtagtttggactggcagtgcgatgtcctacgaccaatcgatgttccacggtcatcactgtgtctagggatgacttcctggtgtgctccatcatctccgcgtcccgggaacgatgttgcatgttgtcctaaatccttgacatcaatgccgtgcggctgtagtttggtgatttgcatgttcgcgttgcgtctgttcgtgtcatcttgccttcgccccttttcgtccatgcaatccctgttaggagcttcttatcacgaagtttgaacagtgttttaaacattgcccaaggggtccagtgggcgaaaaactatcgtgaatggttgcattcgccaatgagatctgtgagtagggtaacagggcgaacgggacaaccgtgggcaatcgctgccattactacggacgcccctagagaccatgaatcccttcatctattgcgacttggggcttccactttgactcggcacattccaagcagtccgcgcaggtgattcactgacgcaatcgccaattgccgggcccgtgcgtacatgaagcgggaaaaggcctattgcaacatccgcgtgcccgggccggtggattgctatcaatcatggggaaacattggggcttccgccaaaggaatccaaaccttcctttggaatggccgaacgagacactgcgggggcccagcatccccgtgcgccagtgggccttgctctgacgggccgtggtggggtttggggaccaccccaaggttgacgaacacccctccatcccaaggtttctcttcttcgcaattctgcntttcttttcggtcccaactccc

SEQ ID NO: 483518 - DNA, 1783 bp, Homo sapiens
  misc_feature (163)..(163): n is a, c, g, or t
  misc_feature (332)..(332): n is a, c, g, or t
gagccgggggtgtcggaggatctgtgtctcggagaacagtggactcttgcagtccccgtgcgggcagggaccggggcaggcacgagctactctgtggacccatgcttatcgagtatctgggcaacatgctttctgcatcattgcccatacttgcgctcgcatnacatatctatctgcgcttacgaaggtagcgagactgggcgtggctcctgtagttcacgagatgccattgtctggtcacaatgcggtcaccaggcgtgtgagtctcacctatcgcatcatatagataccgatgcgtcgtggcatggtaatagcatagggtacgtcgggcncagctctgtacgttcttcgcacaactcctggtggaacgggcgagactgtgcctgattggatctctacagttggggtgcgaacgcataacagttgacatgggaccagctgctgagactgatggacgagcaatctagggataaagggttacgtgtgagaaccctatagtttcgaattgttcaccccgtggacatcgtctcggggggcaatacgtgtgcaagaaagttacggacaagtaactcgaagtggttttgccctaggcggccttgtggcgccctagggaggcgctaccttggtcgtccgaagatttagcatttccttggttccctcaggtcatatgtcacaatttgtctcactctataaattggagggtgcctgtgaagcgccacgtgagggccatttttgagaagcctatttgtgaccatgggaagaggattattgctaccaaagaagtggcaagccatttattcaccgtcccaaatatttctacgttccattgagtttcccacatttacgaattcaggttggtccgggtcattgcggttcaaggggttacgtgggccattggacttatatcaacccggcttatttagacttggcctagctaattgcgagcaccgcgttttccccaggtagccctaggacgtagttgccgtaccccctggtctgggagatcggttgctcgtgccaagggagggtgcataagcgaaagggggccccgttttgggttatcactttgggaagcaacctctttatctggtttcccccgcccttttattggctaccgtggtggtggggccaagagctcgcgaggctcggcttcgtaacgtgggagcccctgggggctagggtcggggtagaccgtgggggcctttgccatgtgttcccatacccaggcaagaggttctggggtgccctctgggtattgtgttcggccctttgttggttcgtccgttgtttggcacctcgcgttacaggggcatagggaagggtcgcccacgcacgcttttgggttgtagaccgtttttttcacctggggcctcacaactcacacgcgggttcaaagcgcgcaaacggggagacacgggcatctggggggcacacaggttatgggtaaaacaagcccagataaacaggggggcggcgcaacggagaaaacataatacaccgagggaggggccacagaaactgacgcgggccaccagcggttttctgataaaaagcggggcccaggacagaggaaaacagaatcaacacgacaatgaacacaatagcatatcggcatacacggcaaaaagcataacaaccatgtgtgtagagaaacaacccagtgagtgcaaaaaacagaagcagacacagaatgatagagcagatcagcacagaaaaatagagacagagcactagctaggcactgaagatacagacaacacagaacagccattagctagtagcc

SEQ ID NO: 483519 - DNA, 411 bp, Homo sapiens
  misc_feature (5)..(5): n is a, c, g, or t
  misc_feature (37)..(38): n is a, c, g, or t
  misc_feature (45)..(46): n is a, c, g, or t
  misc_feature (49)..(49): n is a, c, g, or t
  misc_feature (51)..(53): n is a, c, g, or t
  misc_feature (213)..(213): n is a, c, g, or t
  misc_feature (217)..(218): n is a, c, g, or t
  misc_feature (226)..(226): n is a, c, g, or t
  misc_feature (253)..(253): n is a, c, g, or t
  misc_feature (290)..(290): n is a, c, g, or t
  misc_feature (315)..(315): n is a, c, g, or t
  misc_feature (317)..(317): n is a, c, g, or t
  misc_feature (319)..(319): n is a, c, g, or t
  misc_feature (334)..(334): n is a, c, g, or t
  misc_feature (385)..(385): n is a, c, g, or t
tgggntgcaggaattgggcacgagccggcaggtggcnncctgaannggnannncaggaggcgatactcaaagagctgagcagacacgaaccacgcaatcagcaggcaataagcatggagctcagcagtgacgaatcatgctgctcaactggcaataatcaagcacgtgaccaggcaggaatcacgcagctcagctggcaattgtcaagcagangagnngacagaantcacgcagctcagcaggccctgatcangtgactctgcaggcactgatcacgtggctgatcagtncagatcacgtgactagcatgcactnancncgtgctatcatgcantgatgacgtgactgcgcatgccctgatgacgtggctgatcaggcactgatnacatggctcatcctcgtgccgaattc

SEQ ID NO: 483520 - DNA, 456 bp, Homo sapiens
  misc_feature (5)..(5): n is a, c, g, or t
  misc_feature (37)..(38): n is a, c, g, or t
  misc_feature (45)..(46): n is a, c, g, or t
  misc_feature (49)..(49): n is a, c, g, or t
  misc_feature (51)..(53): n is a, c, g, or t
  misc_feature (213)..(213): n is a, c, g, or t
  misc_feature (217)..(218): n is a, c, g, or t
  misc_feature (226)..(226): n is a, c, g, or t
  misc_feature (279)..(279): n is a, c, g, or t
  misc_feature (298)..(298): n is a, c, g, or t
  misc_feature (335)..(335): n is a, c, g, or t
  misc_feature (360)..(360): n is a, c, g, or t
  misc_feature (362)..(362): n is a, c, g, or t
  misc_feature (364)..(364): n is a, c, g, or t
  misc_feature (379)..(379): n is a, c, g, or t
  misc_feature (430)..(430): n is a, c, g, or t
tgggntgcaggaattgggcacgagccggcaggtggcnncctgaannggnannncaggaggcgatactcaaagagctgagcagacacgaaccacgcaatcagcaggcaataagcatggagctcagcagtgacgaatcatgctgctcaactggcaataatcaagcacgtgaccaggcaggaatcacgcagctcagctggcaattgtcaagcagangagnngacagaantcacgcagctcagatggcaattgtcatgcagatgagccggcaggattcacgcnctcagcaggccctgatcangtgactctgcaggcactgatcacgtggctgatcagtncagatcacgtgactagcatgcactnancncgtgctatcatgcantgatgacgtgactgcgcatgccctgatgacgtggctgatcaggcactgatnacatggctcatcctcgtgccgaattc

SEQ ID NO: 483521 - DNA, 347 bp, Homo sapiens
atgtagtcctatctaactagttattctttctcagtctccttcactgctttccttttctttgactcctaatgttggcattctccaggacccagccctatagccctactctcatctctgtctcagctcttgggttatctttcccaggtttgtggctttaaatattatttatttgctgacaactcccaaaagtatccaactcagacttctctcaagaacccctgccatttttatccacctcttcacttgaacattcattggatatctcaaactgaacatgtccaaaacttatctggtaacctcccctcttaaagctgcttcttctaatagcttcccctattcagttgatt

SEQ ID NO: 483522 - DNA, 123 bp, Homo sapiens
atggcgtctagaggacccggggcataaagggcacaagagagccaaagcatggagtctttacacactgcagcctgggagctctattccaccttacaacaccgaggtgactgagaccaccattgt

SEQ ID NO: 483523 - DNA, 449 bp, Homo sapiens
atttactattgatggattggttgattgactgatggggtctccctctgctgcctactctggagtgcagcaactattcacaggcatgatcatagcacactgcagccttgaactcctgggctcagaccatcctcctgcctcagccgcctgagtagctggtactataggcatgcactaccacacctggcttgtaatttcgctcttgttgcccagcctggagtgcaatggtgcagttttggctcaccacaacctctgcctcccgggttggagcgattctcatgcctcagcctcccgagtagctgggattacaggtatgcaccaccacgcccagctaattttgtatctttagtagagatggggtttctccaccatgcccggcccatgaaatcgatttttaaaaagtaaattacaggccgggcgcagtggctcacgcctgtaatcccaagcacttt

SEQ ID NO: 483524 - DNA, 1364 bp, Homo sapiens
caaaacaccaaatggcggatgacgccggtgcagcggggggtgcctggggggccctggatggccctgggatggggaaccgcggtggcttcctgaggaggatttcggcagtgagcatccgagggaccggggtcgcggacgtggacgtgtggaccgagtggaccgatgtgaccgaggagctcgcaggagtggcaaggccgaggataaggagtggatgcccgtcaccacaagtttgggccgattggtcaaggacatgaagatcaagtccctggaggagatctatctcttctaccctgcccattacgggaatcaggagatcattgattacattcctggtggagacctcatctcaaggatagaaggttttgaagattatgcacagtgcaagaagacagacccgatgccaggcacagacgcaaccaaggttcaaaggcaattatgttgcatatcacgggactacacaattggacacggatcgggtcatagggtgtaaaaagtagctaccacaggacaggtagagcaaccatgaccaatccgtagagggccaatccataccttgggccaaagatcatccaatacggtacccacgatagcaggcagacaggctaccttgaggaggaaaacaaaaatacaggcaaagccacactacaaatatgaccacatttgcacacgggatgcacaggagccatgctttgacgggaatccatgtatggcattgggtaacgacgcttacaataccgctgcaaaccgagtggtgacacctgggcattcgatactacacgaaaccacaatgtagcacttaagggaaaagacattggtaccactggagagggactgagaaatacgaataacattgagaacaaacatccaagaacacggaggggcattgagagcgtggaccaaccccctatgaaaggagaaacgaattagtgacaaagagggccaacacgtactatgaacattgacaccaacaataagcttaataggaaccaataaacacggtaataaccattggaacaagccacacaggaaagccattcatgggaaaaacgggacgacaagttgggtaacatttaccacaccaaaaaggatccatacacccataaatccacagaaagacataacatagagaacacaccaaatcgaataaacaaaaacccagaacaaacaaaagaagtacaacacagagtgacaagcgtgaacacatcaagagaatcacaagactatgttgaataaacagaccaaatagagcagataaacaatacacataacaacaacaataaaaagtgtacatataaacacgatataacacagacaaacataaaaaaataacaaataacaacaataaaacaaaaaaaacacagaag

SEQ ID NO: 483525 - DNA, 182 bp, Homo sapiens
accacgtggcttttcccatctgccacccagtttacttattgttcaatgccaatacacttgtttagcacgctatcagattacgttaacgagtaccctcgtgaaaaacaactttattgactaaagtacagtacttattggtagtcccttttgcgtaaagtcttatggactcttttcctttacag

SEQ ID NO: 483526 - DNA, 702 bp, Homo sapiens
agcattgaataagttaatcaacgatgaactacagaaaaatttgatttccaatttacacacaattctgaaaccattccttttgagaagattgaaaaaagttgttttggctaatattctgccgccaaagagagaatatatcataaattgtccgatgacgtctgcacaggaaaaattctataaggctggattgaatggaaagttgaaaaagactatgttcaaagaattaatcaaagattttttcacattgaacgatgaatatatcggccacgtttctaatcgatccatacgagatttcatcaattataaactatctggtaatgagacttcaaatacggacaataaaatcaatccaaccttgttgcaaatggacaaactatataagaagaacctgcaaatggaaatttcaaataagaaattgcaaaatatgatgatgcaattgagacaaatcattgactcaacttttttgttttatttcccatatttacacccagaagacttgactttggaaactcttttaaagacgtctgggaaattacaaatcttacaaaaattaatccccccattaatatctgaggggcacaaagtgcttatttattctcagtttgttaacatgctcgatttgatcgaagattggtgtgatttaaattcgttcgcgacatttcgaattgatggttcagtaaacaatgaaacaagaaaggatca

SEQ ID NO: 483527 - DNA, 371 bp, Homo sapiens
agtggtgttaccaaggagctgcctagaagggcaccagagtggtgagtggtagatgggtgcctcctcagcctcccataccaccccacagacacgatacaaagatgacagccagagcagtgtttgtgtgctgagagaagtgaagcagtgctttgtaaattaagctggggtgtttaaatctcatcctgaaagtttttgagagacactaaaatgttaagcataataacttgcttgattgatgaattggtaatttgggaagattattctgaaataatttagctcagatggattagaagacaggaccaattagggggctgttacattaattcagattaaagaggttaaaccagggagggctccatgtttcctgggtt

SEQ ID NO: 483528 - DNA, 322 bp, Homo sapiens
tttttgaattttttaaattttgtttttaaaggcaaaaccccccttggttcttttatggtttcggggaaagcattttaatcagacttatttttaatcccggaaaattttttagcggttttggggcggatttttgggattttttataaggatgttttttgaaaaaaagcaaaggccttggtttgtttcccttaaatttgtggactaaaccaggttttgtaaaataaaccgggaaacccgggaaggtttttaactttagggtctttgtttccttttggaaaatgggggggggggggaaaaaatttacccctgttttttgttttta

SEQ ID NO: 483529 - DNA, 160 bp, Homo sapiens
acgacggcagtatagctgtttctgagtgtaaacgacggtcagtatagcggtttcctgattgtaaacaggaccggcgagtcatagcggttgtcctggttgtaacacggcgggcgagtgattagcggttgcctgattgtaacaggcgggcgagtgataacgg

SEQ ID NO: 483530 - DNA, 133 bp, Homo sapiens
  misc_feature (46)..(46): n is a, c, g, or t
tagctggtaccggacacgctccagataagcggcgccaggttctggnttggtgacaacatcgcttgctcacccgccttcaacggcataaaagaagccggatcgttaaacaatccggcggcgatggtaatcgggt

SEQ ID NO: 483531 - DNA, 353 bp, Homo sapiens
gggacgagaatccttacacagtgacatgatctctgacctgaatggaactgggcagagcaacagtaactccaaagtgtcagaaaatagtcacacattcaaaaaactggttttcacatggaccaaaagatgtgccatataaaaatacaaagcctctggtcatcaacagccgtgaccactttagaatgacccagttcatggcatgcggaagcgacatggtgggtcaagaaaccagtttcgggcatagcgctattggtagttactttggctttctctgagcgcatgcagataataagatgtaaacattaacacctcgtgcataccattcaacttccatttagctatagctttactca

SEQ ID NO: 483532 - DNA, 107 bp, Homo sapiens
  misc_feature (21)..(21): n is a, c, g, or t
acaattccgccggaaagcagnaacccgctcaatcgctttttgattcgtgtttatcatccgctgttgctgaaagtactgcactggccgaaaaccacgcatgaagaaaa

SEQ ID NO: 483533 - DNA, 121 bp, Homo sapiens
gaggatccaaaaaccatggcattcatcacgcccagcaggtgtcccagccatgacttaccatagcaaaacacaaccacacactaacctgcatcgcctagcttactgatgatgatgtcctggt

SEQ ID NO: 483534 - DNA, 228 bp, Homo sapiens
tgtagtcaagtaaaggtatctctgtccctcagtttccaaatgcgtcaggtgataaccctatcaggcttttgggagcaggagacgcaagaccacccaaggtgctgagcagggtctgacgcagaactgccgcccatttgatcctcactattgcggccactatagcatacgacgcatttgtgcctgcactcggttcctgctcactcagcggctactgtgcaccagatgctg

SEQ ID NO: 483535 - DNA, 219 bp, Homo sapiens
  misc_feature (13)..(13): n is a, c, g, or t
  misc_feature (96)..(96): n is a, c, g, or t
  misc_feature (119)..(119): n is a, c, g, or t
  misc_feature (166)..(166): n is a, c, g, or t
  misc_feature (188)..(188): n is a, c, g, or t
  misc_feature (196)..(196): n is a, c, g, or t
ttcggcacgaggntcgaggccagcctgctaacaatgttgaaaccccagtctctactaaaaatacaaaaattagctgggtgtggtggcggaccatgntaatcccagctactcggggggcntgaggcgggagaatcacttgaaactgggagggggacgttgcggtgancggagatcacaccacgtgcccntccaaccntgggggaaagagtaaaacgtcgg

SEQ ID NO: 483536 - DNA, 233 bp, Homo sapiens
gctcgcccgtcccaaaaagcttccccaggggggagggtaagggaaaagggcccccccctgccccccagttccagcctgaccccccccccccccttgggcttgaccctttttcccagggggcccccccctttgggggcccccgggtttttttttacccccccccccccccccccccttgggttttattttggtaatggtgggggggaaagaaaaaaaaaagggaatttttgcca

SEQ ID NO: 483537 - DNA, 567 bp, Homo sapiens
cattgttgctgacgcctgtaatcctagcactttgggaggctgaagttggaatatcacttgaggccaggaatgggagaccaccctggccaacatggtgaagccccgtctctactgaaaatacaaaaattagctgggcgtggtggtgtaagtctgtaatcccagttactcggaaggctgagacatgagaatcacttgaacctgggaggcggaggttgcggtgagctgagattgtgccactgcacttggccatatcatttttttttaatgtgaccaaattgaggccgggcattgttgctgacgcctgtaatcccagcactttgggaggccgaagttggaatatcacttgaggccaggaatttgagaccaccctggccaacatggtgaagccccgtctctactgaaaatacaattagctgggcgtggtggtgtaagtctgtaatcccagttactcggaaggctgatacatgagaatcacttgaacctgggaggctgaggttgcggtgagctgagattgtgccactacacttcaacctgaacgacagaaccggactccattttataatgacc

SEQ ID NO: 483538 - DNA, 407 bp, Homo sapiens
  misc_feature (316)..(316): n is a, c, g, or t
gccagacacagtggcatgctcttctattcccagctactcaggaggctgaggctgaaaaatcacttgagcccaggagtttgaggatatcctgggcaacatggtgaaacttggcaaaaacaaaaacaaggccgggcatggtggctcacacgtgtagtcccagcactttgggaggccacggctggcggatcacgaggtcaggagatcgagaccatcctggctaacatggtgaaaccctgtctctactaaaaatacaaaaaattagccaggcgtggtggcgggtgcctgtactcccagctactcgggaggctgaggcaanagaatggcatgaacccaggaggcggagcttgcagtgagctgagatcgcgccactgcactcctgcctgggtgacagagtgagactccatctc

SEQ ID NO: 483539 - DNA, 515 bp, Homo sapiens
  misc_feature (8)..(8): n is a, c, g, or t
  misc_feature (24)..(24): n is a, c, g, or t
  misc_feature (60)..(60): n is a, c, g, or t
  misc_feature (70)..(70): n is a, c, g, or t
  misc_feature (89)..(89): n is a, c, g, or t
  misc_feature (172)..(172): n is a, c, g, or t
  misc_feature (300)..(300): n is a, c, g, or t
  misc_feature (468)..(469): n is a, c, g, or t
aattaaanccctaggttattaacnaattgcaaaaaacctatgggttaaaaaataacctgnaatccccaancccccgggaagggtagaanttggtaattttatcctgcttgtggcaccatacttgtaaatgggagtatccatatacctatttattgaaaatcttatttttgantcattttatcaaattaactcccctctaccccccaaaaacagccgtagtacccacttttgaattagatttgtgatcttaccctagcaccttgaatttgtaagaatattaaaagaatagcccaggtgtgngtgtcacgcctgtaatcccagcactttgggaggccgaggcaggcggatcacgaggtcaggagatccagaccatcctggctaacacggcgaaaccccgtctctactaaaaatacaacaacaacaacaaaaaaaaaaaccgggcataagtgcaggcgcctgtaatcccanntactcgccactgcactccagcctgggcgacagcgagactccatcaa

SEQ ID NO: 483540 - DNA, 120 bp, Homo sapiens
  misc_feature (96)..(96): n is a, c, g, or t
tggcactctaaggatcccaagctccacaagagcagcttgatttattgcagtggaagctaggaaggaataggacactgagggtctccgcaggacacnccattcaccggcatgactgccagt

SEQ ID NO: 483541 - DNA, 305 bp, Homo sapiens
ggtgaggatcccaggagcagagtgctgggattcaggcatgagccacggcaccgggcccagaattaacaatcttaaaggatgcttcctcttagtttttttttttaaacctctatctaatgacaaattggggtggttgggttatgaaataaatctgattaattctcttggagctctgggtccatgagaccttcagggatttaatgggttaccctacagaatcggcaagcaaagcttagtagccggggcttatctccaggtggttaactcacggcggggggctggtgtgcagcacgggtgctcggccg

SEQ ID NO: 483542 - DNA, 180 bp, Homo sapiens
ggatgaacgctgacagaattgcttaacacattgcaagtcaaccttgaattggggttttaacttaggttggtgtggcgggaggggtgagtaacgcgtaaagaacttgcctcacagctaagggacaacattggagaaacgaatgctaatactctaatattatgataatatgggcatcctata

SEQ ID NO: 483543 - DNA, 1236 bp, Homo sapiens
ggttgctattgtcaggtaacgggccgggtgtcagttggacattaccgggccgcgtcggtctatcaaactcctgacgtgctgccaatgtcatgaagacgagtatcacgaagacgtcgagagactacgacgacgatctgaaaatgaaaacacaaagtttgaagtaagatgttaagagacccagctgatgcctcggaagctcacgagtcctccagcgaggggagaggcaggagccccagtgtgaggatggacatcctaaggcccaacaaaggcagacacagagaaatggagcagagggaggcgggcacagacgagagcgatcggatgagccccagatggagcctctatccctccgacagccaagtctctgaagaagtgaagacacgccattctgagaagagccagagagaggatgaggaggaggagagagggagagagagcgtatcacaaaaggggagccgaggaggaagatagcagtgaagagaaacaccttgaagcagccaggagagacacaaaacgcttaccttcactgacaagacagcaggcttcacgctaataaaaacagaggagttagtggccagatcggaaacacatgctggccgggcattctcagggagaaagacacatagccgagagaagagtagccaggagagtggagaggagacagggagccaggagaattcacccccaggagtctaaaaggccaaccccggaagccaggaaagaatctgaggaaggtgaggcagatgcacctctagaggtgacaaacgacgcacgaggccaagaacgaccacggaggaagcagagcccgacagagccctctcaagaaaggaagtcaaccatctggcgacagaggcacccccaggaggacactgaacaggtcaacttagcatggccagataagggcaaaaaggcaccaataagccataaggctaagagaaggaccgggacttatggggaagacaaaaggggactccagagaacaggcccccctagaactgagagagagacgcaaaaaaggtcaagaagggcaacaaaagaggtccaacacccacaagaggaagatttagagcgacacataacacacccacatagtaacaggaaacgaaatagaaaactaaaaggaacaatgaaagaaacacaagagggcgaccaacgactagaataagaatgacctcaaaaccaagaggtaagatacacctagcacaaaccacacagacgggagatatcgcgagagat

SEQ ID NO: 483544 - DNA, 442 bp, Homo sapiens
acatttaatttcaatttataattcttcaaacaccttttttaacattcttattgaatttttaatcatggtaaaatatacataatataaaatgtgccattttaaccatttttaagggtaaaatgtggcattacatacattcgcattgttgcgcaaacattgccactattgatttcaggaacgttttcttctttcccccactgtaactctatatccattaaacattaattgcctgttccctcctccctccagcccctggcaaccaccattctactttctgcctttatgaatttgactactctaggtacatcatataactgaaatcacacagtattttttttttgacacagaatctcgctctgttgcccagaccggagcttgcagtgggccgagatcgcgccactgcactgcagcctgggcgacagagcgagactccgtctcaaaa

SEQ ID NO: 483545 - DNA, 395 bp, Homo sapiens
  misc_feature (10)..(10): n is a, c, g, or t
  misc_feature (17)..(17): n is a, c, g, or t
  misc_feature (36)..(36): n is a, c, g, or t
  misc_feature (149)..(149): n is a, c, g, or t
  misc_feature (180)..(180): n is a, c, g, or t
  misc_feature (220)..(220): n is a, c, g, or t
  misc_feature (299)..(299): n is a, c, g, or t
  misc_feature (363)..(364): n is a, c, g, or t
  misc_feature (377)..(377): n is a, c, g, or t
  misc_feature (386)..(387): n is a, c, g, or t
ccgggaaaanccccctnaatcctgccctctggctgncctccccaactgggcttgttctctgagggaaggttccggaaactcatggacttggggctctgcctgtaggaaggaggctgggccggagggaccagccaccattgtctctgttnagccaaatgtgcaagtagctgcccgcccaanagggggcctctgctacccgtctgcctctgccggctgacanactgcctccccagccttcctgctaggccaccctcctcccttcccatgcttgtaaccagctctggggcttgcacctccanaaagtaaggttgcccttggaggccatgtttgggtccatgcgccaggcctagggctaggccccgnnccaatgggtgcanaataaatannagttcaac

SEQ ID NO: 483546 - DNA, 864 bp, Homo sapiens
ctttttccagagaagagaagctttactggtgttccagccctaagtctcgctctgtcgctcaggctggagtgcaatggcgcgatctcggctcactgcaagctccgcctcctgggttcactccattctcctgcctcagcctccggagtagctgggactacaggcacccgccaccgcgcccagctaattttttttttttttagtaaagacgcggtttcaccgtgttagccaggatggtctcgatctcctgacctcgtgatccgctacgtctcggtttcccaaagtgctgagaattacaggcttgcaggcgtgagccaccgcgcccggccgagttaaagtacttttcctggaacaacagaaacttagcataaatcgttcacactattaagagttgtaattcacgggacatctcccgctcaatatgacttcaaccagttctcaacaacaatgtatcatctcacataagaccctggagagaggaactcggacagccccagaatcgaccggctccgcaacttcgcacatgactactatcagtgacccaggtttgactgtctctctccacagcattgacttcactaactggcatgtgacctggttcggcagcagtagccttgcaccacatgcttgtgcgcccgtgagtcagtaccagacaacggttgggcttcccccagaacctcctgacaacaggtcatccagaccctaaattgccttaagaccttctcctaccactggaccacaatcctcaggcacttgcattgccaaccagggtgtcaccttttacactgtgaccccttagtgtgcgaccaacgacctaacatggcggaaaatagtcccctcccaccacagctctacccatcggagccc

SEQ ID NO: 483547 - DNA, 226 bp, Homo sapiens
aagctttgacgctccaagaaagattataaaaagtaattaagcagaatagtcagaaacattttctaaaggtattttggcacctgtaatcccacaactttgggaggccgagatgggagaatcatttggagccaggagttcgagatcagcctgaccaatatggcaaaaccccatctctactaaaagtacaaaaattagctgggcgcaatgtcacacgcatgtgcggtaa

SEQ ID NO: 483548 - DNA, 161 bp, Homo sapiens
cccacgcgtccgctctcctgtccttgtgttgaagcgccagtaaactaagggtgtccagcccccattccctctctactcttgcaccagccggattggatgttgtgtattgtggtttattttatttttttcctttttttctgaaatttaagtatcccaaatta

SEQ ID NO: 483549 - DNA, 681 bp, Homo sapiens
ggagcgcggagtctggagtctcggaaccgaagccgcacaggggccccgtcccgccgccatgccggcccggccgggcttggggcgcggccgttcggaagtaagtgagcccggggaagggacctgcagggggcgtggagggtggcaccgagatcgtattaacttccccaaacggagtacgttgaagacgcagcatgcagccggaagagcagctcgacaccacgccggcggaacacggggccattgggggaatgcgatgcggtaaacacggcatcgcacagcacaatgggggtccctgggccgtgtcaacgggggcatataacctccctggcacactaaggggtacccaccccacaaaggggcgccgaccaaggttgggcagcagggtcacgagtttacctcaaggaaaacccaacatggcgggcattgcaccaggggaaccgggctggacacaagcaccgcgttggcgcgcttggatcgcagagcgcagtgagcacgcggcgtgtgggccaaaaccacgggagctggacccgtggttgccccctagtggagacccatcagggggagaacgttacactcccccgaccagaagacctaccacaaaaagccccaaagggtcagagaggaactcaccaggggataggagaaactggctgcgcgaacaacgggcagagcgaccgtcca

SEQ ID NO: 483550 - DNA, 481 bp, Homo sapiens
  misc_feature (263)..(263): n is a, c, g, or t
ccctcacggattacctcaaattacaatgggttacatcctgatgaacctgttgtaaatgaaactatcctaagctgaaaatgcatttgatctgcctaacctattgaacttcatagcttagccattattagtctgtatttttcttttcctatattgtgtttgtctggttttggttttagggtaatgcttcatagatgagttagtaagttattcattctgtttttatcttatagaagagataacagaaaattgatataacttcttcnaatgtttggtagaattcaccagtggatctgcctaggcttagtttctctgtttggaaagataattattaagtattgattctgtgaagatctgggatctctttcatttctgatattagtacattatgtcttctttgtttttcatagtctggctagagactcatccattttatgatcctttcaaagactagctttggtcttgagtatccgtgaggggccgt

SEQ ID NO: 483551 - DNA, 109 bp, Homo sapiens
cagcgctagtgcgtgtattctgaccttccagtgagtttatcagcatactcaaaatttttttcctggcatttggagggatgggaggagggggtggggcttacttgttgta

SEQ ID NO: 483552 - DNA, 990 bp, Homo sapiens
agtctgcgcgacagagcgagacttcgcacccgccgcccccccaccaaaaaaaaaaggggcacagtcagagaagagcagagcccggctgggttgggtcccagcccggccggccttcgtgagtgtgctgtgtgacattaggccgtggtgctggccctctcgtgggtctccctttctttcttcctttcctttcttttcttttcttttcttttcttttcttttcttttcctttcctttcctttcctttcctttcctttcctttcctttcctttcctttctttctcttttcttttcttttgtgacgaggattcgtggcgtgtcatccaggcgtggagttgcaggtggcacgaatctcggcttcactgtgcaaccttctgtgccttccgtgggcctcaaggtgatccttccgtggtcttcaagccttcccaaagttagcgtgggaacttcacgagggcgcaacaaccaagcttaacgccccacagaggctataattgttgttgtgtggtattgtgttgtgtggtagagagacagcggggtttttcaccaagtgttgtgggctaggactgtggctcttcaaacttccgtgagaacttcggtggatccttcccgccttcagcctcccaaaagtggctggggataatagggtggtgagccaaccggaacccaagcctgggttctccctttcttcatctgggaaggaaggctgggatgaccttctctacagggctgagtgggacattcgcagatctaccctccacaacggcattcggcctcaagcagcaaggcccacccaggctcaggcacttggagaagcaccctagttccagtggtggctgttggcacctctggctggcaatcagagctcccttgtctaggtcctagtgatggtccggatggccgtgaccatgggcggcttcctggggtctaccggagctcggagttgccggtgttggacagcgggcgggtccggggccggacttggtggcggtcccg

SEQ ID NO: 483553 - DNA, 213 bp, Homo sapiens
ggaaaatagcgaaggtctcttctattctattctcttctgttgtattctattccattctgttctattctattctattctattctattcagttctgttctattctattctattctgttctattctattctgttctgttctgttgtgttctattctattctattctattctgttctattccattctattctattcttttctgcgtcgagtaatttt

SEQ ID NO: 483554 - DNA, 162 bp, Homo sapiens
atattaaatttccatttcataaagaaagttaggtttttagaaaatatgctctcagctggccacagtggctcacacctgtaatcccagcactttgggaggctgtggtgggtggatcacctaaggtcaggagttcaagaccagcctgaccaacatggtgaaacc

SEQ ID NO: 483555 - DNA, 717 bp, Homo sapiens
  misc_feature (133)..(133): n is a, c, g, or t
  misc_feature (184)..(184): n is a, c, g, or t
agcgggacgtggcttggcaacgtccctaccgccgctgcttcccgggaacctggcgccgccggaactgatcgcggctagtcccgacgcgtgtgtgctagtgagccggagccggcgacggcggcagtggcggccnggcctgcaggagcccgacggggtctctgccatgggggagtgacgcgcctgnacccgctgttccgcggcagcggcgagacatgaggagaccccgcgacaggggcagcggcggcggctcgtgagccccgggatggaggagaaatacggcggggacgtgctggccggccccggcggcggcggcggcttgggccggtggacgtacccagcgctcgattaacaaaatatattgtgttactatgtttcactaaatttttgaaggctgtgggacttttcgaatcatatgatctcctaaaagctgttcacattgttgcagttccatttttattttaaaactctggggacggcttttatagtggtttggttcaaaagccattttcttctgggaaaactattaccaaacaccagtggatcaaaatatttaaacatgcagttgctgggtgtattatttcactcttgtggttgatttggcctcactctttgtggaccactaaggactttgctgctatctgagcaccacggatattgtgtcatttcactactcagtgtttgttcaccagtcctggaggaggaccagcaaagacaagg

SEQ ID NO: 483556 - DNA, 223 bp, Homo sapiens
tggaagcgcaaaatagcacgttgggaacctagcgcaggtgccgctttgaagggtgtccatgaaattacacagacccacacagcactgtagcccacgccattctcatcttgcaggtactgcagatatgtagatcgtggccgcacaggtaggcagtgaccccgtatgtggccagcagtgggcgtagctgcttaatcaggcagtggttagagcccagaagctgtga

SEQ ID NO: 483557 - DNA, 380 bp, Homo sapiens
tgatctagaggatctctcactgttgttcatacctgcactgttgttcatacctgcactgttgtacataccctcctgacctcagtctcccagagtaacgtgggattacatgtcatgcaccagcacacccggctaattatgtattatttaagtagagacaggggtttctccaatgttggtcagtgctggtcttagaactccctgacctcatggtgatcttgcctgtctcgagcctcccaaatgtgcttggtgattacagtgcatgacgccacctgcgccggagcttcatttgattttttaacttcaatgtcaccaaaggtcagtgaaactggagttatggtactgacaaacatgtgcaggcgtaccgcagctcagaattctgt

SEQ ID NO: 483558 - DNA, 267 bp, Homo sapiens
tgcgagtatctcctggatctgggccagatgcatgcagatagcgatctttgctctcctccaggcatgtacatccaggaatagcttacatgctgagctgggactgcagctcaatctccaggttctgcatggtgcgccggagctccgaaatctcgctcttgctgctactgaacacagctcgctgtaggtggccacctacgcgatcatctacctggatctgggccagatgcatgcagtagcgacctattggtctacctacaaggctgtact

SEQ ID NO: 483559 - DNA, 286 bp, Homo sapiens
agacaacacacctcaacaggacccagaggagtagagccagattacaaaaacagctgcctttccccaaccctcgtctttttcttgtcagccacccacacaaccgggtgcaggagtctgccaagggccaaactgaccctttgcggccgtagggtgacacccaccgtcacctgtatagttctgggccctggccaggtgcgaaagcagagcctggtggcggctgcacaacagggctgtgccagaccccgtccttccaccacaaacgtgggatccgtgcacgttaacgatt

SEQ ID NO: 483560 - DNA, 1448 bp, Homo sapiens
ccacgcgtcggagctgatgtcgagtgatggaccctttgaacgcagtcgccctacagactgctgattccccccgcatcgcctccctgtggaatgcccagtgccctgcttcgcagctttctccctttgtctcataaccatgtccaccaacgagaatgctaatacaccagctgcccgtcttcacagattcaagaacaagggaaaagacagtacagaaatgcggcgtcgcagaatagaggtcaatgtggagctgatggaacagctacgacggatgaccagatgctgacagaggcgcacaatgtaagctcatttcctgatgatgctacttctccgctgcaggaaaaccgcaacaaccagggcactgtcacatatggtctgttgatgacattgtcaaatgtgcatacacactactgcagaccctgtggcaacacatcacgctccaatgctaccttcaatgctgccagcgaacactacttttaccagcagacacacacagaccccgcatagcacccacataaatcctggtgcctggtcttgatcccgcaacatttgtgtccttcttggtgcagcaacatgcattgtcagtccccaatcccagtccgcactctggcttggcgcacctcagctataccactttgcttcctagcgagaacatcacgaacaccaatccgcacaggcatcgctgccgaagcaatcgctacagcgctgtcacacatccccatacctatcacactccctcctgcattggccaacatcacccaccttgcatcacctatactagctgcaaccacacgactagtcatgaggacttcctactctacacacttagcatagccgctctgcactgtgtccgccagcctggtcaccgtacactaactctgtcgctgtattcaaaagtataaccggagcagcaacaaatctcagaaacacaagcagtgattggtgactcatacgcgcttgtcacaccatacacctctgacatggcctcgcaccttacaatgcaaatccgtagtcagaaataacgcacacgcaatacactctatcacttcagactgcccttaccacaacaatgcgctgagcccgaacacagagcacatcaccgatcactaccacataatcctctcctctcgtacccacaactcttccaccctacattatcactccactcatctatcgcaacatcacaacatacaactacatatattgcaggaccctctactaatagctccaccacaaacactacaatcaactcacaattacattcatatcatatcaccactcacttcgtcactacctaacatcttccaatccactcaaattactacaaccctaactacgtagacttactacaacacataatttttacccgaatctattacttactccaccgtccatccaaacacccaaccacctctaaagtacaaaatcactaataaaccaaatatcaaata

SEQ ID NO: 483561 - DNA, 460 bp, Homo sapiens
ctgctttgcagctgctgagggcaccttctgtggccaacacgcgcctcccggactcgcggctctccgcacgcacctcccggactcgcgtctccgcaggcatcgatgcctggcactcctgggttctctgctcgactgagtgagtgacgcgccgtgcggcgtgtgcgtgtgagtttatggaacgactgggctcggcctcagccacgggatcagccaccgccctctgagacgagcactggcggaagtgatatgcacgacgaacgcctcacggctcaaacacatggcttcactctgaaccaaacagcacgctctgtttgctaaacaaacaccagactcctgcgttccgtgctcggcgtttctccctcctggcgcttccattcgcctgctctcagcagctccttcttcacgctaatcaattttaactcctgggacaggtcttgctctgcaacccaggctggagtgc

SEQ ID NO: 483562 - DNA, 367 bp, Homo sapiens
aacacttgggctcttacaggtgcccgctattagttatttgtggggggattaccgatcactcctaagctaagcagcatctgaaagacccccgcaagggagacgatctatattggtctgaagcgaaagtgagagtgtgttgtgccaaaaaaggaggaaatgggagggaagtcgtcaaaacctacccggttagaatgtatgttaaagaattttaagaaaggttataagagggactatggaatcaagttgaccccccagaggttaagaactctctgtgaaatagaatggccttcttttagtgtaggatggctggcctaaaggactatagacagagaaacaattggccatgtatatcgggtggtgactaggg

SEQ ID NO: 483563 - DNA, 127 bp, Homo sapiens
  misc_feature (35)..(36): n is a, c, g, or t
  misc_feature (40)..(40): n is a, c, g, or t
gaccatagaatgggtaggaagtaagtctgagcctnngtgngagattttggaaccctcaacccattctgtcaatactactgtgtgacacatacaggattaagttctacatttgtgcattctatggttg

SEQ ID NO: 483564 - DNA, 293 bp, Homo sapiens
aacaaggggtctcccgcgcagaggaaaggaggtacgtccggggccacgtccatcatgattccaggagggttcatgccgccccaggcaagtggtttgaggagtccccaggtaggaggaagtgagagagatgggatgcgtatgcaccgcggggagtgtgactggaggtacttcggtaggcgactaaccgggtcttgagtgctagcgagtctgtttgggggagggctcgaggagagcgttcctgggggcgagtccgccccgcgcctcacagaacactcgtgcaatacgcgcgtgtg

SEQ ID NO: 483565 - DNA, 912 bp, Homo sapiens
tgatagcacacggttggcgacaagaccaaagcgcacaccacggggaattcgcgagacgtggtccgattggcgccccaccacggggggggacacacctcgccggtggcccaacctgggaaagtgacaaacggggcaaaacacaacacgtggggcacacgcccagcgggcttggcacgcccggcacaggccctgcccccgcaaacggaatgttctcgccctggataacacaaccacgaaggggcggagcaagcccacagggccatcggcaggacacagggcgtccggccaccattttgcccccctggctccggggtccaacaagatgggtttgcaaccttgcccctccgcgctgaatgatgatctcccccggacgatcggggcggattatctctattagcactgcggcaccaaatgcattcgtgcgcgttacaaaagggcaccaacacttggtcccattcccccaacaggagcaagggggtctaatcccactcccgctggcagcattttgcataatttgttatatgcttgctgcaagaaacgacttctccctgcggacatatgtacgttcacaaaggcgtgtttttcgatggaggacgaccaattcaccgggcgttgacaatttgcccccagaatatttgccgacattcaaagccgtcgcaaattgcacgggcgcattcgtggacgcgaggctaattaacaaccacgacgaccgcatgggctacgctgacggtcaatccagtcggaaatcgatcatgtcacatatagtcttgtcggtggattgtgtctgaggcagcagtgaacctccgccagatatcctcggccagtaactgtattcacgggcccggccccgcgcaaaaattttcaaggggaaattttctcgcagcaagctcatttaaacggcaacaatagtca

SEQ ID NO: 483566 - DNA, 484 bp, Homo sapiens
  misc_feature (437)..(437): n is a, c, g, or t
  misc_feature (445)..(445): n is a, c, g, or t
  misc_feature (470)..(470): n is a, c, g, or t
ttcatgtgtgaggttttagacattcagaacatcaatgagcagacaaaacctctaacagactcccagcgtgtcaagtttaccaaagaaattaggggtaggtattcatgataatgtcatcgtgacttgagtgtaacacagtacgtgtcatctgggcctgagccccacagacctgggttctcttcctagcctacgtcgtcctagcagtgggaattgggataagttctttagctgtgttagtcagtgtacacttagacttgaaaatacacactagaacatattgatacttatacaaacttactgaatgagtgaattagaggtcagttatgtagccagacctggtattgcatgcctggaatctcagcagtcaggagcctgtggcggaacatcacaagatcaaggctaatctgagctatgtagagaccctgactcaataattnataaatanataaaatggttgacatctagaccantggggccaattaac

SEQ ID NO: 483567 - DNA, 381 bp, Homo sapiens
aaacacaagcagccaccaatatacacctactaggatgattaagaataagtgtgaaaggacgtaaaattgtaactgtaatgatggtagaaatggataagttgcagccactgtgaaaaacagtctgcagtggtagaaggttaatatgaaccctgttggccaggaatctacttaggcaccaagaatagaacggatacagatgttgttctatgtttgtagcatcactttcacaggagcaaaggtggaataatccaaccaacagtgacaaatgaatgtataaagcaaagtggtctgctgcatgtacatcatccatctgtaaaaaacgaacatcattttgatagatgctacaacatgggtggacattgagaacattatgcttagtga

SEQ ID NO: 483568 - DNA, 725 bp, Homo sapiens
atatatatacagccttgggtacacaatgtgtggtttctgaggattggactctaggatggatatactattttgatataactatacagtaagcattggtatttactctctctaggtataagttactagtttggaatgtccatcaggacctttaataaatgagttaaaaatttgtcttatgagagccacacctatttaagtacagattttggctttattgcccaaaagcctcctgaagagggtacggagagtcccctctgtgggctggcagttgtgaatgagaatctgtgtagtctcgatgcatatacgttgcggttatttgttaaatgaaccacagtttgagtacttctgacagtggaattttcgacgaacaacagggaaacatttgtaacctttaattcgtttttcccataaaggcccagtggtgggtttaccatgacatgcatagggggagggccaaaatcactgtgtggtgtaacactttgtccaaaattgtggcattggcattattttagtggcccaaaggtcggaaggtgtcctcaaccacaaatttttgccacatttgtgggggtgcgccactacctttttggggtcaaattttacctgggtcagcgttagcgtttgggcacacaattcctgattccaaaacaattgattttataccccttttcccaaacaattggggtgcacaaaaccaaaaagggggaaacattcgcacacggttgcat

SEQ ID NO: 483569 - DNA, 229 bp, Homo sapiens
tgtccagtcgctcttgggcctggtcagtcgtcttggcaaataaaagcagggaggtgggaggagaggaaggcctggacccagtaccaaggagaaacatccaatcaggcctgtcatggccatcttacgctgcgaatcccctttccacgcatgcctatgaagatcgttttccgaggctctcatacacaccgcccgaagagcgacgtgacaggggtaccgaggctcgagattc

SEQ ID NO: 483570 - DNA, 160 bp, Homo sapiens
atgggggttctttgcatcccaaaaatcctatggaactggggcaaactggcagaggcttacctgaatctggagccagctctttcagccgcacttgcctaatcacagaaacagcacagtctccacctcaagtgacaaaaatatcaaatcctactttccacac

SEQ ID NO: 483571 - DNA, 235 bp, Homo sapiens
tatctccctactatgcctaaaacgaataatacatcgctgttcattatatctactctcataaactctcaacaactcactccctctttaccaatattgtgcctattgccatacttaatctttgccgactgcgaatcatcgagtggagccgtatccctactattctcaagtctccaatcaatcatatcgtctagactacgtacataatctaaacctaccccattgcttcagagctcct

SEQ ID NO: 483572 - DNA, 137 bp, Homo sapiens
ctcaaaaaaaaacaaaacctagtatacaaacagatctaatgcttaccatgtcttcagggtaaccaaaagagaaacaaaggctgctcaacgtctgatgggatagagtcaggtaagtcctacggggccggcagtccgtg

SEQ ID NO: 483573 - DNA, 283 bp, Homo sapiens
gagttgtggaaacggcctttagtctcggtgcgagtgtgggtgagtgttaacccccttggcaagtgcctgggcaggggccggccgccctccatttgggccgggtgattgggggccggctgtgtgcccaaggcctccccctgccctcgcctagtttggaagctccggccgacatcacggagcagccttcaagcattccattacgccccatttcgctttgtgcccctcccccccaggggttcagcaggagccctgggctcttcatcaataaaccctgtttcagcca

SEQ ID NO: 483574 - DNA, 453 bp, Homo sapiens
  misc_feature (9)..(9): n is a, c, g, or t
  misc_feature (51)..(51): n is a, c, g, or t
ggtccccgntttttcttttttaggggcgcgctcctccccccccacataaanaaaaaaagggggggggggggccccctttccccgggttccccggggaaaattaccccaagtttgtgtggttttttgggggggggaaaaaaattgcccccaaaaaggggtgtttgtttttgtttcccctggaggggggttttatttccccccggccccccattttttttttttttttgggggccctttggggcccccgggttaaaggtttaataaaaaaggtcggggggggggaaagggggttttttttcccaccctccccccggccccgggtttagaaaaaactaaatttttttttcggggcttcccggaaagggttccctttcctaggacttggggcccaggggaaaaggcccccccccccgggttgggggggaccccccccttaagattccgggtttttta

SEQ ID NO: 483575 - DNA, 114 bp, Homo sapiens
  misc_feature (8)..(8): n is a, c, g, or t
gcatctgncagctgctgcaggctgacagcctccagacctggacagaattcatacactcccggagctgaaaaaaccgaacataagggagtgcacaagagccgggctttggagagg

SEQ ID NO: 483576 - DNA, 288 bp, Homo sapiens
  misc_feature (20)..(20): n is a, c, g, or t
  misc_feature (49)..(49): n is a, c, g, or t
  misc_feature (106)..(106): n is a, c, g, or t
  misc_feature (116)..(116): n is a, c, g, or t
  misc_feature (211)..(211): n is a, c, g, or t
  misc_feature (238)..(238): n is a, c, g, or t
  misc_feature (255)..(255): n is a, c, g, or t
aaggccccgagggcgaaggnaccgaaagcacaggaatcactggggcganattgcatgaaccatcacctgcaggaaacaaggttcacaaaagaagcctacaagaagncatcaaagantacatgaaatcaatcaaaggggaacttggaggacccgaggcccgaaggaggaaacctttatgcagggctgcagacaaatcaagcacatccttgtnattcaaaactaccaggtctttattggngaaacatgaatccaganggcatgggtgctctattggactaccgggaggat

SEQ ID NO: 483577 - DNA, 225 bp, Homo sapiens
acctagcttcctggtggtaccctccagataatgaatcaacatttctccctaaattcttatgcaccttaacctctccagcatcaaatcttctactctataaccccgtctttaaacacctccctctaatctcaatgtccttctgttttgattatttggcacaattacgcttaaaaaaataaatattgccatcatggcatatatatacctatgtaacacacctgcaca

SEQ ID NO: 483578 - DNA, 442 bp, Homo sapiens
tcgatatcaacgtctctgcgagttatacacgagtcgggaactataaagaagcatactatcactaagtgacgggggctgtaagagcaaggaagacattgaacgtatggtccaggaagctgaaaagtacaaagctgaagatgagaagcagagggacgaaggtgtcatccaagaattcacttgacgtccatagtgccttcagcatgacaagcaactgatgaagatcagaaacttcaaggcatagattaacgatgaggacaaacagaagattctggaccaagatgtaatgatcatgatcaactggcttgtataggaatcagacagctgagaaggcagaatgtgaacatcaacagaaagagctggagaaagtttgctaaccccatcatcaccaagctgtaccagagtgcaggaggcatgccaggaggaatgcccgggggtaggaggt

SEQ ID NO: 483579 - DNA, 437 bp, Homo sapiens
aaaaaccagctgggcgtggtgacgagcgcctgcagttacagccactgggaggctgaggcaggaggcggaggttgcagtgagccaagatcgtgccggtgtactccagcctggacgacaagagtgaatgttcgtctcaaaaaaggaaaaagaaaaaaataaatctttaaaaataactagttgctgggtgtggtcgcacgcctataatcccagcactttgggagtccaaggtggaaagatttcttgagctcagaaatttgagaccagcctgggcaacaaagcaagacctcatctctgctaagaataagagaaaattagctaggcatggtagcagatgcctgtagtcccagttagtcaggaggcagaggtgggaggattgattgagcccaggagagctggtctgcagtgagctacgatcatgccactgcactcccgcgtgg

SEQ ID NO: 483580 - DNA, 160 bp, Homo sapiens
gtaacggacaaggagctcatcgcttacagtgcgcctggctgccgaggccgaggcccactggatccagcagattgccgagtgttgacaagtgagagcggccaggttgccggggtcagggcttagtcaggctccttctgcctttcagtgaactcccttctaa

SEQ ID NO: 483581 - DNA, 200 bp, Homo sapiens
agaggataccacgacccggacctacatatgtgtgcgatgcattcacagcacacacacactcttctccactctacaagtctctagaacataccctctcttaagactcccagccaccaacgttcataactcttcctcatggtcaaccctgacctcatccccctcttcttcatcctcagccagcctctctcgccccagggggc

SEQ ID NO: 483582 - DNA, 517 bp, Homo sapiens
tggccatgtgctgtagcattctcaaggcaattggcctgtcactctgtctgctttcattgctccaatcaagtgttcctcctttgtttcacaggtactggaaaactgggcttctcttttgtgagaattccagctcttatggtgtcttgtaatcgtatgtgggtggagacaggaaatggtgtcattatctccatcccattgacagaaagtaagtatctttatagctaactgccatggacacacacatcaggagaattataggcaacatcagttatgtctgaaattcacatctgtgttagctcagaaacatccagtgatgggtcttgtttcctgcacttccctgccactactgtttgtcatttgatcctttgtctcattcagtcacttcaatcgcaaatgaacttgtcaagcctcttattctgacttcacagcaattcactgtatcttccacacattaaaatcacttctgatatcaatcataggaaaacctaacattgtggctcatggatcccaaagctgt

SEQ ID NO: 483583 - DNA, 443 bp, Homo sapiens
aggccaattgactccgtcaccaaagattgtaccagaaaacgcgagtcccgtttgacagacttctttccgtttcagaactgtgtcctacaaaccaaacagatctcccccaattgctaaagccatatgcattttgaaggaaatgtaatccatatgttcctgagtcacttatgcctaagtcattaaaaagttattttttaaatgcgacttcatgtttgaagtcattatagagcatttttagtacactctcattcttcataatgctaaagttctcttgcctcgctttattgctccatttcacactgtatatcatcttaacacatacttgagccgaggcataaccgtaatcattgaactcggacgcccctggtgactcgctagtcacacttgagccagtttctatctttagaagcgtacacttgttcatcctcgctgttcttcctttc

SEQ ID NO: 483584 - DNA, 198 bp, Homo sapiens
aaaccccttttttttttttgggggggtttttaaaaaaggggaaccccccccttttaaaaactttcccccggttttctttaaagggaaaaaaaaaaggattttttcccttttgggtccccccaaccccttttttaaaccggttttgggaaaaaaaaaactttttcccacccccttttcccaaacccaaataaaatatta

SEQ ID NO: 483585 - DNA, 854 bp, Homo sapiens
taaagagattaggaggctcgatatttgggaaagaagagaggatgctagtcgtcgacgactctcttaataaccaccgctacacaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttggagtgaagtttttcctaacattttctactcggaaaattccacttttcaatttacccttcatctggaaattgtacacctagtcttttacacattgcccccttatagaagttctttacatctatttcaaagttcataacactacattattcggttcttccgatgtacttttttttgttcgtttctggttcccttttctcctattcttcgaggtttttaaaaattaacaattttgagctaacgtttatctcccttgtcagcttttcttccctt

SEQ ID NO: 483586 - DNA, 382 bp, Homo sapiens
atcaagtggacactacaaggaaatgttaaaaaaaaaaaaggtacgtggggccaaaggaatataatatatgtcagaaactggggttcccccaacagaattaaggggcataaaaataagataagggtaatggcggtaaaagataactagcagtttaaaccaaggatatatagggttttcccagcatatgtaaaagtagtccatatatgaatacaagaccacaagggatcagggagaatggggaatatactatcacagggttctaatagggaaggggaacacagtataatctcatttagaggaggccccaaataatttaaaacatatatactataaaccctaggagacaccattaaagggttcccaaaaggaggggtcaccggag

SEQ ID NO: 483587 - DNA, 370 bp, Homo sapiens
atctagtgtttgaagcaggatggccttgccgcgtggcctgcgcctgagcgctcaagcccgcaaacagggggaggtcttcaggcagaatcttttccaggaggctgtggaatccctctacagattcttgccacagtcatatacctgaatcagctcttgcaagaggactccctcaatgcggctgacttgacttccatacggacctcactggacatgctcatcccagacccttcacccaaggatgatgagatggaaacagataagcaggagacgaacagaagtccctaagcgtggatttctccctgcgaatgagaaaggccctggccctgcttgccctgcgtaagccacgaagtctggactctcagagtgcttt

SEQ ID NO: 483588 - DNA, 978 bp, Homo sapiens
  misc_feature (739)..(739): n is a, c, g, or t
  misc_feature (742)..(742): n is a, c, g, or t
  misc_feature (753)..(753): n is a, c, g, or t
  misc_feature (756)..(756): n is a, c, g, or t
  misc_feature (765)..(765): n is a, c, g, or t
  misc_feature (768)..(768): n is a, c, g, or t
  misc_feature (771)..(771): n is a, c, g, or t
  misc_feature (773)..(773): n is a, c, g, or t
  misc_feature (775)..(776): n is a, c, g, or t
  misc_feature (783)..(783): n is a, c, g, or t
  misc_feature (791)..(791): n is a, c, g, or t
  misc_feature (806)..(806): n is a, c, g, or t
  misc_feature (808)..(808): n is a, c, g, or t
  misc_feature (815)..(815): n is a, c, g, or t
  misc_feature (817)..(817): n is a, c, g, or t
  misc_feature (819)..(820): n is a, c, g, or t
  misc_feature (826)..(827): n is a, c, g, or t
  misc_feature (829)..(829): n is a, c, g, or t
  misc_feature (831)..(831): n is a, c, g, or t
  misc_feature (834)..(834): n is a, c, g, or t
  misc_feature (838)..(838): n is a, c, g, or t
  misc_feature (842)..(842): n is a, c, g, or t
  misc_feature (845)..(845): n is a, c, g, or t
  misc_feature (850)..(851): n is a, c, g, or t
  misc_feature (854)..(854): n is a, c, g, or t
  misc_feature (856)..(856): n is a, c, g, or t
  misc_feature (867)..(867): n is a, c, g, or t
  misc_feature (873)..(873): n is a, c, g, or t
taaagagattaggaggctcgatatttgggaaagaagagaggatgctagtcgtcgacgactctcttaataaccaccgctacacaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttggagtgaagtttttcctaacattttctactttgaaatatttaatttccaatagaacagtttactttggaaattggtaacataagcttatacaaatttaacttttaaagaattctttttacatctatcccaaagtacaaagacctagattattgaanttntcaccggtacnttngtaataggngtnatngntnnatttccnccttcacnagagttttctaaaananaaacaangngnngtaaanntnanatncccncggngangttannttncnccaagaatggnatatgntctttataatgaacaggttgaaaacaaattcgcgaccctgaccctcgctggaaggcccttttatatacaacctacacacgggcgcaggatacaataatgcactcg

SEQ ID NO: 483589 - DNA, 208 bp, Homo sapiens
gatgaaatacgctatcgcatttattcaaagggcgcgccatatgcttcttagcgtcgcttgtcaaactatcagctcatctttctctaatgaggtactctggcagctccgtatcatgtcattgtggtaatacccgtatcatactgctgttgtcctcgctaccgtccactccatcttcctggtcatagctgttcctgaatatagatagagg

SEQ ID NO: 483590 - DNA, 835 bp, Homo sapiens
taaagagattaggaggctcgatatttgggaaagaagagaggatgctagtcgtcgacgactctcttaataaccaccgctacacaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttggagtgaagtttttcctaacattttctactttgaaatatttaatttccaatagaacagtttactttggaaattggtaacataagcttatacaaatttaacttttaaagaattctttttacatctatcccaaagtacaaagacctagattattgattctttttatttaccttcataaaagggcactggtttatttcacctatccagaaacatctaaaaataatcaagatgtgaacagtttgaaatctatttat

SEQ ID NO: 483591 - DNA, 596 bp, Homo sapiens
  misc_feature (28)..(28): n is a, c, g, or t
  misc_feature (224)..(224): n is a, c, g, or t
  misc_feature (243)..(243): n is a, c, g, or t
  misc_feature (255)..(255): n is a, c, g, or t
  misc_feature (314)..(314): n is a, c, g, or t
  misc_feature (320)..(320): n is a, c, g, or t
  misc_feature (334)..(334): n is a, c, g, or t
  misc_feature (337)..(337): n is a, c, g, or t
  misc_feature (365)..(365): n is a, c, g, or t
  misc_feature (384)..(385): n is a, c, g, or t
  misc_feature (390)..(390): n is a, c, g, or t
  misc_feature (398)..(398): n is a, c, g, or t
  misc_feature (405)..(406): n is a, c, g, or t
  misc_feature (427)..(427): n is a, c, g, or t
  misc_feature (431)..(431): n is a, c, g, or t
  misc_feature (435)..(437): n is a, c, g, or t
  misc_feature (439)..(439): n is a, c, g, or t
  misc_feature (485)..(485): n is a, c, g, or t
  misc_feature (490)..(490): n is a, c, g, or t
  misc_feature (504)..(505): n is a, c, g, or t
  misc_feature (525)..(525): n is a, c, g, or t
  misc_feature (545)..(545): n is a, c, g, or t
ccagatatttattacagaggggcatggngggatacctacttattcttcattatgggaacaattaaaggcatttattagataggaaattaacagatcatctgcttctataactttattagctacattaaataggcagtgagcaataatttaaaaactcaccattatataaaataataaataacaaagtaaaagttaatgttataaaaataaactgatagtaaggnaaatccaaatgggcatgancccattttagangaccaaatgattaatagggttgtcatgttataatagacaattgtctaattatttctgtntttttntttagtgggtagcngangtcgttcagaagagcagaaatatgtagnaaacctctctccctccccnnccctncgccatcnccattcnnccgcacacagctcctctcccncccncccnnncnggggcggcgcgcttagttttcgggtgggggaaatctgccggggganagggngcggtggggtatcnngggcgtaagaggaggagagngagaggatgatctgccacanactgtgggcctccatgtccagttctccctgtcataacacctcctgtgccag

SEQ ID NO: 483592 - DNA, 954 bp, Homo sapiens
taaagagattaggaggctcgatatttgggaaagaagagaggatgctagtcgtcgacgactctcttaataaccaccgctacacaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttggagtgaagtttttcctaacattttctactttgaaatatttaatttccaatagaacagtttactttggaaattggtaacataagcttatacaaatttaacttttaaagaattctttttacatctatcccaaagtacaaagacctagattattgaactctatcttgaaacttccacaaatagtgtatagtatacattccaattatccaagaattatcacataaactaatacgtgtagaaagtttacaactcagagtgcacgaatttcgccttacatttgacccgactttctaactgaatatcagaaatgaatcagtagattctcacatactctccggtcttctcctatattttttactcgttagtattacat

SEQ ID NO: 483593 - DNA, 953 bp, Homo sapiens
taaagagattaggaggctcgatatttgggaaagaagagaggatgctagtcgtcgacgactctcttaataaccaccgctacacaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttggagtgaagtttttcctaacattttctactttgaaatatttaatttccaatagaacagtttactttggaaattggtaacataagcttatacaaatttaacttttaaagaattctttttacatctatcccaaagtacaaagacctagattattgaattcttacatgtaactttccgaaatggggtgggggataaatttcaccctgtcccagagagtttctaaaaaatagaaaaggtgaaggaacagtctaagacccgtggtgagagttaatgcccttaggtgagataattggtctctttaatagtgatgttgagaaagaattttgggccttaaccttgtgaggcgtgtctatgatttgatcgctcttaacg

SEQ ID NO: 483594 - DNA, 981 bp, Homo sapiens
  misc_feature (677)..(677): n is a, c, g, or t
taaagagattaggaggctcgatatttgggaaagaagagaggatgctagtcgtcgacgactctcttaataaccaccgctacacaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctctttttacgacgatccagaagtctctaaggacaatggtgagaaagaagcatacgatagcaccatatgagcacgttcaccctaatactatgcactcccgtctactgcatcgaaagaccgcatgaaaatgaatattttatgatcaaaactcgcggctcggcctctaataaatcgccgatagttgataccgggaagcatatattcatatactgtgcgcgccatagatttacgcgaacaaccgataccgacaaactccgactcggtgtacctcttacaatcaagactgctatcattgaagtgtagcctctttatcataaagggaaaagcattaggaaattaagtttgttacttctaattggtttaactagaagnccaaaggatttactatggacgtgccaatgttctcctcttacccccatctcttacccactaatatgagatggtgcatgtcgtatcttaaatattccctacgttctatcaaattagtgtctcatctcgctatgacgtgtcataatttcaagagtatgaagaggaccacacatccgaggacgactacaatgccgatcatgtattacatcctatcctacgtccgttgctcaattttgcatgtgactgtattcccggaagacagttaagctctcgtcgattaccgtatccatttcggcaatatatatct

SEQ ID NO: 483595 - DNA, 901 bp, Homo sapiens
taaagagattaggaggctcgatatttgggaaagaagagaggatgctagtcgtcgacgactctcttaataaccaccgctacacaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttggagtgaagtttttcctaacattttctactttgaaatatttaatttccaatagaacagtttactttggaaattggtaacataagcttatacaaatttaacttttaaagaattctttttacatctatcccaaagtacaaagacctagattattgaaatcttcaccagaaactttctgacaaggttgtacgaattgatgttccccttgcgccagagttttctgaagaagtagccgggggtgctgcaagtttgaattccgaggtggagcgaatattacccaaagaaagtacgtagtcctctacaaatgagaacgcggaacg

SEQ ID NO: 483596 - DNA, 891 bp, Homo sapiens
taaagagattaggaggctcgatatttgggaaagaagagaggatgctagtcgtcgacgactctcttaataaccaccgctacacaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttggagtgaagtttttcctaacattttctactttgaaatatttaatttccaatagaacagtttactttggaaattggtaacataagcttatacaaatttaacttttaaagaattctttttacatctatcccaaagtacaaagacctagattattgaattttaacatggaacttcgcaattagtagtactggttaaattttactatcctaaaagttttaaaaaaataccacctgatattatttacaaaccagcgtaaatccattccccccacattggattatattactctaagcgtaacgcggacatcgct

SEQ ID NO: 483597 - DNA, 180 bp, Homo sapiens
ggacgcgcatgcggtcccagaagtgcgtgcacatcataacagctgcagagtatatgagcaggtggaacgtccaacagatgccccactcacaagatagggccctccaatcagtcttctgtgctccctttcactcatagtaactggtttgctcttcctattggtcatagataaatgcacacc

SEQ ID NO: 483598 - DNA, 859 bp, Homo sapiens
taaagagattaggaggctcgatatttgggaaagaagagaggatgctagtcgtcgacgactctcttaataaccaccgctacacaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttggagtgaagtttttcctaacattttctactttgaaatatttaatttccaatagaacagtttactttggaaattggtaacataagcttatacaaatttaacttttaaagaattctttttacatctatcccaaagtacaaagacctagattattgaattttccattaaccttcgaaattaggtggactggttcatgttccctttccagaagtgttattaaagagttaacctgaggccgtaagtttataatccagagtaaaaatattaaaccttcgtca

SEQ ID NO: 483599 - DNA, 850 bp, Homo sapiens
taaagagattaggaggctcgatatttgggaaagaagagaggatgctagtcgtcgacgactctcttaataaccaccgctacacaaagaaagtcgtgctgtatccctactgacttctccagctgctggtataaaaacagttgatcctctgcctttgcgggaagattctgaagacaatatccacaaatttgctgaggcaactcttccagtttcaaaaattccaaaatacccaacaaatccccctggacagttgccttctccaccacatgttccatcctactggcatccctctcgacgaattcagggctctcttagagatccagagtttcagcacaatgtgggaaaagcaaggatgaacaatttgcagttacctcaacatgaagcctttaatgatgaagatgaggacagattgtctgagatttctgctcgctctgcagcttctagtctccgggcttttcaaactctggcacgagctaagaaaaggaaggagaatttctggggtaaaacataaacctagctgagttgcctttatctaaggaaacattggcataatttttctttattgcttactgtgttaaaattttttggagtgaagtttttcctaacattttctactttgaaatatttaatttccaatagaacagtttactttggaaattggtaacataagcttatacaaatttaacttttaaagaattctttttacatctatcccaaagtacaaagacctagattattgattcttatcctgcacactgccaaaaggggccctggatcaatactctccctatacaaaacgttgctaacactaaaaataggtagttaaagttgcgaacctatagtgagcttaaat

SEQ ID NO: 483600 - DNA, 877 bp, Homo sapiens
gcgtccacttcttcttcctttccactctcccctatctccccaaaataaatctagtcgctttgtggtacgtgctttccttcgtagttcaacaagtgaaggtttactactgaagattgatccattgctgcctacagaagcccaaaatgaagacagtgaaacagaccacgcctaaactgtggttgcactgcgtctattactttcccctggtctatgatgcattggtatcacacccccaacgcaccatgatttttccagtctgatggttttgggactcgtttctactctcgtacgtcccctctcattatttcttctctctcttccatatcgtctatgagactccccactcacagtcctcgtcttcctttcttctttcatcaccccaacaattaaattcatctcaccaccacacttcctcaagcctcggcaattagtttctcttccccttgcagtgcaaacgtgcacgtccactttcttcccatattccctttactctctgtccgcccctttccatctctcttccccccccttcctacttccctctcctatcccgcatcttctctctccttcttctcattcctccccccatactttttccctacttgctgagccaaattcccccatctatcacaccctacgctcccccctacccggtcgttccttccactccccgccttcatttctttcttccactccacctgtctcattacgaccatccagatacccattcctccctagtaatccccgaaatctggccccctacccccctttatttaactatattctcgctatgccagtccctagcctcttctgcccccctcctactctcgttgctcatgcaaccacctcccactctccaccgtttcgcatccaacacttt

SEQ ID NO: 483601 - DNA, 339 bp, Homo sapiens
  misc_feature (329)..(329): n is a, c, g, or t
aaaaaaaagatactttttttttgttttttgagactgagtcttgcttttgttgcccaggctggagtgcagtggtgcagtctcggcttaccgcaaccttggcctcccaggttcaggcgattgtcctgcctcagcctcccgagtggctgggattgtgggcatgtgccaccatgcccggctaattttgtatttttggtagagatggggtttctccatgttggtcaggctggtctcgactcctgacctcacgttatccgcctgcctcggcctcccaaagaaaaaggatacttttaaagggatctttgagtacgagaatgtgtcgtgtcctaaangtagtgttta

SEQ ID NO: 483602 - DNA, 511 bp, Homo sapiens
  misc_feature (157)..(157): n is a, c, g, or t
  misc_feature (488)..(488): n is a, c, g, or t
caactagtgtgacctttggagaggggcaggcagaagagacgggaaggcagacgttcatattctttcttgtgattgcttgcaaaacagctcaagtggtggttctcaaatctgactgcacattaaaagcatccagggagttttaaaaggtactgatgcntgggctccatcatgagattctgattcagctgatgtgggttagagcctgggcgctgatatttttaaaaccccaacaggtgattctagtgtgcagtcagggtactatataaagatataatgaaccacaatatagaggaagagaaaacatagtccattcactccaaatgccactgtgcacatagagaagctgtttcttaaaaatctaaaatctataactttctgggaatattctcctatcccagatgaagagctctgatagacttcctaagataacttgaaatgagcttaactttaccatttgtaactaaagtctttcattttcgtcgacgcgnccgcgaatttagtagtagtaggc

SEQ ID NO: 483603 - DNA, 348 bp, Homo sapiens
gggcctcttccgccttcacctggcacttctccttcctgctgccttgtgaagaaggtgccttggttccccttcgtcacagagatcagaacagaaacgcgtcagatgtcagcatcaaaataggaatcaatgcataaagattctctcggctcggatcgtgatcatccataagtgaatctcagatctgtaaacgtcttcgagaggtcagtctagactgagagattactgcatctgagcactgtcacgatgtacatgcgataccatatcaatataggtgaaagatcaggaatgctctcaagtgaaaaagagaagcgctcaattgaagaggaatgacggatgcctggtcatagc

SEQ ID NO: 483604 - DNA, 327 bp, Homo sapiens
tgcggattgctttctgtaagccaaacactattctgaatactttacacattttaactcatgtaattttcacaaccatatgaggtagttaagatgacgaggtcaggagatcgagaccatcctggctaacgcagtgaaaccccgtctctattaaaaaatagaaaaaatcggccgggcgttgtggtgggcgcttgtagtcccagctactcaggaggctgaggcaggagaatgacttgaacccgggaggcagagcttgcagtgagccgagatcacgccactgcactccagtctgggtgacagagcgagacctccgtgcaaaaaaaacacaac

SEQ ID NO: 483605 - DNA, 316 bp, Homo sapiens
tttttaattttggtagagacggggttcaccatgttgcacaggctggtctagagctcctgagctcaagtgatccatccgccttgcctcccaaagtgctgggattacaggcgtgagccattgcaccgtgcaaaattattttaacgtataaattttggattttccacatatatatacacacaagcatgtgtaccctgtgcacacaacacacatagtaatttatacagggcttaggaagggcaggaataaaggtgtcctctctactttttacaaagatgggatctcatggtgtagccacggtaaaccaccacaagtaccg

SEQ ID NO: 483606 - DNA, 694 bp, Homo sapiens
atcccaccctcatcgtgtcagaagggtacagatggtgacatcgttgctcagagggccttccagtgcctgaaacaggactgttgctatgactacagggagaaccccatctccagcgtggaacgtgaagagggcacgagacattccacttgactactggagcagatggggtttacccaggatttcaaccatcatcgtgcaatcccattatgaggcccagtaaggaagtgttaataggagtaaatttccgtgtaggaccgagggtgctactcgtggcactgcagtcgctctgtcgcttccagtgttctctggtagtgagagggcagtttcttcagtgcagcatggctgtgtccttagtcctaatattatgggactcttctgcgcatactcacttagtctatctgtgtggagaccatcccctccgagatccagggtcttcgtgtgaagaatttctgatggtgggagctacgcctatgccattcataccccgatcatgcttcatcctgggtctgaatgcagctgtatttaagaccagcagggtgcttccttaaatgcagctgcagtctggatattccaggtccctagtcgctgcggaactggttgggtctgggggtctttggctttccagaccgtgaccgtctccatctcttcggagaagaccgggaggctctgtgtcgcaggcagttagtttctctgg

SEQ ID NO: 483607 - DNA, 94 bp, Homo sapiens
acggccgtgtattactgtgcgagacacagaggacttcctttcgctgcttttgatatctggggccaagggacaatggtcaccgtctcttcaggga

SEQ ID NO: 483608 - DNA, 269 bp, Homo sapiens
atctcgagtatcccagcaatcgctgtataggcatacatagacgtggtgggggctctgcgttctcctctacagatgagaatagcaaggtggctctggatcagcacgatggcggtctccacgagagctctgccagtcctgacccccaggactgcctctgtggcgtaacacagtgaggtggggcagccactagaaactgagcccagcttgcacctctcctgtggcctccaggctgttcaccaccctccttgtcatcttccacatccccgatc

SEQ ID NO: 483609 - DNA, 339 bp, Homo sapiens
ggttcacgcctgtaatccaccgctttgagaggtctaagtgggcaatcacttgaactcaggagggggagaccagcctgaacaacgtggtgaaaccccgtctctacccaaaatacaaaaaaattaggcaggcatggtggcttacacctgtggtcccagctactcgggaggctgaggtggggggatcgcttgggtccaggaggcggagattggagtgagctgaagttgtatcacttcactccagcctgggtgacagagcgagaccccgtctcaaaaaaaaaaggaaaggaatccacttgctaatgtgggtaagagtttacatgaggccctttgttttattta

SEQ ID NO: 483610 - DNA, 814 bp, Homo sapiens
gtaggcagtagtaacacagtggtattagtgtatctaaacataccaaaatggaaaaggtaccagtaaaaatatgctataaaagataaaaaaattgtacacctgtataaggagcttgccatgaagggagcttgcaggactggaagttgctctgggtgagtcagtgagtgagtggtgagtgaatgtgaaggcctaggatattcctgtacactactgtagcgtttataaactctgtacacttaggctacactaaatttataaaataatatttttctttcttctgtaataaattaaccttagcttactgtaacttttttactttataaagttttaaagtttttaataacttttgacatttctaatactaagcttaaaacaaacattgtacagctgtacaaaaatattttctttctttatatccttattctatacagtttttttctatttttacaatttaatttttgttgtagtgttgtataaacttttttgttaacaaactaagatgccaaacacatactttagcctaggcctgcacagggctcaagatcatcaatataaactgtcttccacctccatgtcttatcccactgggaaggtcttcaggggcaacgtgggcatgtgtggcaactgtccatctatgataacaataccttcttctggtaacctcctgtagaattggtctgaagctgtcttacagtaaccttattttttaagaaggaggcctggttaaatctgagaaacagttagtaatcactagcatgctagacattccgggccattaattcatgggacacaggtgctgtttcagcgagaagag

SEQ ID NO: 483611 - DNA, 682 bp, Homo sapiens
cacagtggctcacacctataatcccagaactttgggaggctgaggtggatggatcacttgaggtcaggagttcaagaccagcctggtcaatatggcaaaacccagtctctactaaaaatagaaaaatgaggcggctgtggcggcatgcacctgtagtcccagctactggggaggctgaggcaggagaatcgattgaacccaggaggtggaggttgcagtgagccaagatcatgccactgcactccagcctggccaaaaagcaagactctgtctcaaaaaaaaaaaaaaaccaaaaccaaaaacaaaatttccaattttcattaaagggggctaattaaaaaagatctattattaacattgggaggcgaacaagatatattgggataagggcttgggttaaattttttgggtgggaatttcaagtagagccggggtttggcagatgttggcccacccttgaaactctgaggccaacaagaagtccacccaaccaggggcctccccaaagggggccggggaactggccagggggtgagtcagtggaccttgtcgttgaattacaagaaggggtcacgcctgtggccaaaggctgagagggccaggcgcacgctgggcaactggccgctaaactcggggcagagaatgtcgccaaaccaaaaacggaggcaagcgggaatcatac

SEQ ID NO: 483612 - DNA, 292 bp, Homo sapiens
  misc_feature (216)..(216): n is a, c, g, or t
tcagtcgaccacttctcttcatctgtaactcacctgtagacctgggttgtgcctccactttgtgcagtgtctgtactagcgggatttcacagggtgaccacaggacaagcacagatgtttccgaaattctaagtaagggtccacctcagctcccactgatccagtcgtgcgccagaggttcagaatgctctcccacgggacttggttggtggagtntcctcccataacctgtgttaccaagttatcctgattcgagctctagagatgcccccagcatagttccgtaacaata

SEQ ID NO: 483613 - DNA, 460 bp, Homo sapiens
  misc_feature (73)..(73): n is a, c, g, or t
  misc_feature (77)..(77): n is a, c, g, or t
  misc_feature (79)..(79): n is a, c, g, or t
  misc_feature (88)..(88): n is a, c, g, or t
  misc_feature (107)..(107): n is a, c, g, or t
  misc_feature (109)..(109): n is a, c, g, or t
  misc_feature (111)..(111): n is a, c, g, or t
  misc_feature (115)..(116): n is a, c, g, or t
  misc_feature (121)..(121): n is a, c, g, or t
  misc_feature (124)..(124): n is a, c, g, or t
  misc_feature (150)..(150): n is a, c, g, or t
  misc_feature (153)..(153): n is a, c, g, or t
  misc_feature (163)..(163): n is a, c, g, or t
  misc_feature (167)..(167): n is a, c, g, or t
  misc_feature (169)..(169): n is a, c, g, or t
  misc_feature (195)..(195): n is a, c, g, or t
  misc_feature (202)..(202): n is a, c, g, or t
  misc_feature (204)..(204): n is a, c, g, or t
  misc_feature (248)..(248): n is a, c, g, or t
  misc_feature (268)..(268): n is a, c, g, or t
  misc_feature (313)..(313): n is a, c, g, or t
  misc_feature (319)..(319): n is a, c, g, or t
  misc_feature (325)..(325): n is a, c, g, or t
  misc_feature (341)..(342): n is a, c, g, or t
  misc_feature (349)..(349): n is a, c, g, or t
  misc_feature (360)..(360): n is a, c, g, or t
  misc_feature (362)..(362): n is a, c, g, or t
  misc_feature (382)..(382): n is a, c, g, or t
  misc_feature (384)..(384): n is a, c, g, or t
  misc_feature (404)..(404): n is a, c, g, or t
  misc_feature (407)..(407): n is a, c, g, or t
  misc_feature (413)..(413): n is a, c, g, or t
  misc_feature (419)..(419): n is a, c, g, or t
  misc_feature (425)..(426): n is a, c, g, or t
  misc_feature (433)..(433): n is a, c, g, or t
  misc_feature (443)..(443): n is a, c, g, or t
cgggtgaggtacagctacgagaatccgagcaaatgaccaagaccaagaagcgccctcagcgtgcaagatccantgtntntgctatgtntgaccagtcacagattcangngntcanngaggnctncaacatgatagatcagaacagagatngtntcatcgacanggangntttgcatgatatgcttgcttcattgnggaagantncaactgatgagtatctagatgccatgatgaatgaggctccaggncccatcaatttcaccatgtncctcaccatgtaaggtgagacgttaaatggcacaggatcctgaanatgtcntcaganatgcctttgcttgctnngatgaanaagcaactggnancatacaggaagattacttgngngagctgctgacaaccatggnggntcggtntacagntgaggnngtggatnagctgtcacncagaaagcgcctaatac

SEQ ID NO: 483614 - DNA, 220 bp, Homo sapiens
atactgagccggcccgttttactaagattacaatagccctatcgccactgtcttaccgcaaggtgacacctatagcccttatccccatagtagttattatcgaaatcatcagactagtcattcaaaccaatagccctggccgtacgcctaaccggtaacataactgcaggccacctactcatgcagctaattggaagcgccgtcgactacgcacgggtac

SEQ ID NO: 483615 - DNA, 212 bp, Homo sapiens
gctctggatcccgtctctgtaatgttgtccatgtcttgaacctgtgtgaaatttgtttcccataaaaaagcgatcaaggtctctccgaataagattatgacacaaagccggagagttgatatacccctgagggaggacagtaaaggtatattgctgcctttgccagctgaaggcaaattgcttctggtgggccttatggacacgaatgttca

SEQ ID NO: 483616 - DNA, 81 bp, Homo sapiens
gccgaggacacggctatatattactgtgcgagatatgatgggattggttcgtccggtggctttgactactggggccaggga

SEQ ID NO: 483617 - DNA, 1048 bp, Homo sapiens
  misc_feature (20)..(20): n is a, c, g, or t
  misc_feature (33)..(34): n is a, c, g, or t
  misc_feature (83)..(83): n is a, c, g, or t
  misc_feature (90)..(90): n is a, c, g, or t
  misc_feature (134)..(135): n is a, c, g, or t
  misc_feature (152)..(153): n is a, c, g, or t
  misc_feature (163)..(164): n is a, c, g, or t
  misc_feature (168)..(168): n is a, c, g, or t
  misc_feature (173)..(174): n is a, c, g, or t
  misc_feature (182)..(182): n is a, c, g, or t
  misc_feature (184)..(184): n is a, c, g, or t
  misc_feature (194)..(194): n is a, c, g, or t
  misc_feature (196)..(196): n is a, c, g, or t
  misc_feature (234)..(235): n is a, c, g, or t
  misc_feature (240)..(240): n is a, c, g, or t
  misc_feature (259)..(259): n is a, c, g, or t
  misc_feature (331)..(332): n is a, c, g, or t
  misc_feature (351)..(351): n is a, c, g, or t
gctttctcaggagacaccanatcgagacaggcnnagggcagttgccggccaaactttccagcctgttcgttaagtgtctgcanaacccantccagcgacatcaggctggtggctgagaagatgatctggtgggnnaaataaggacccactgnnctcccctggnncccncaggnncatcaagncncatcctgaangnctcttcttgacaacaccaaggataagaacaccgtggtnnagggnctacagcgaccaggcaatngtcaacctcctcaagatgcggcagggtgaagaggtgtttcagtccctctccaagatcctggatgtggccagnnggaggtgctgaacgaggtnaaccgaaggatccctgaacgaagctggccagccaggccgacatccacggagcaggtggacgacagccatcctgacatgagaggcctgggccagcagcagcatggcctgctccacatcttatgctcaatgtatgccattctggagcaatacattggttccactggggagcttggaagcagggcgttcccagaaagtatctccaatatcaatagaccacagccaaagccttgaaatcgaaacccacacacaagctgagaatagcctccttccatcgtctcaccgtttcctgtggaagaagagacaaggaacaaggcacacggccattggcggcctccagagccacagacatgggcgcagacccaaggaaggctgctacggtccagtcacagacaagagatagagtctggaaacataatactaagccaggggcacagaccggggggctccccctcctccatgagccagaacacctggctcgacgagactggtgcaaccaaaacgttttccctacttatcaccgaggtggccaccagagcgtgtgattcctcccacacgagatggagcactagccaggtcattgcaacactagcaagctctcaacggcatatacccctgtacagatgacagtaactcacgatatgaagtcaaacataggacgcataatattaaaaatagtaatcacagtataaatcgagat

SEQ ID NO: 483618 - DNA, 138 bp, Homo sapiens
gatagcttgtcggacatacttctggatgggcactgtgcggaaacttgaggatgagatcagtgagcagcatgcacttgaaaggcatggccatgtctccatcacttgagtgcaaggtccatcgaccaaagccctgtactg

SEQ ID NO: 483619 - DNA, 213 bp, Homo sapiens
gtagctgggactacaggcatgtgccaccatgcatggctgattttttgtatttttagtagagacggggtttcaccgtgttggccaggatggtctcgatcttctcaccttgtgatccacccgccttggcctcccaaggtgccgggattgcaggcgtgagccactgtgcccagccagcttttaaagttttaaaaaggatttgttcagacatggaat

SEQ ID NO: 483620 - DNA, 155 bp, Homo sapiens
tggagttcgccggaggaaaaggttggggaacagcttaatggttgttgttgatttggttaaacaattagtagagggactatgctcactattaggctgtgggctgttgtgttgattcaaaccttatgtgttttttggaacagtcatgtcatgtggta

SEQ ID NO: 483621 - DNA, 84 bp, Homo sapiens
atcggttcctaggagcggacaagtgtatgtacccctttattgctcaaagaaagcaagccccttcataaacattctctttactca

SEQ ID NO: 483622 - DNA, 451 bp, Homo sapiens
  misc_feature (351)..(351): n is a, c, g, or t
ggccaaacgcctgtgtgccgaatcgcttgcttctgatcccgctccgtgtaacctaagtgtgctgcaggcaaagcccaggccacggctgcgtcactactgatgttcacgatgccacacagtcacacacctaattcattctcaagtcggagcaacacataccaaccttgaccttatcctcaagctccagggcagcctggccgagcagcccctgctccctcctggagacccttgtcacctcccgagctcctcttggagacccctgtcacctcctgaccaactttcccgagggggcaccttacaccaacaccggggtgttttaccaaaaaaaaaaaaaaaaaccctccacccttncaaccaccccaacctgaatgtgtgttcatatttttttgttagttttatccaaaatgtttaagatcccaacaaactttattttctaaacctgcaaaaaaaa

SEQ ID NO: 483623 - DNA, 184 bp, Homo sapiens
ctgcatcttgtatgcgaggaaagtgaggctcggtaagttcagtcagatccacgagattccaagagcgctgctcggtggtccttaggcttttctcctgtggtaaaatatcactcttcagacctaagttgtttctttgacagccctaagcccttgggaggttgggggccagagaggggtggttgta

SEQ ID NO: 483624 - DNA, 925 bp, Homo sapiens
gcggttttccacttcctaatggacgagcgcgcgagactggagtgagagtgtccgaggagtgtgggcgttgtggactctttgctgagggaccccgtgcgggcttggtccctgtgtggtgatgtgctgtgcctgagtgctgtgctgtgcttgtgctgtgcgtgcctgtgtgtgtgctgactatggctgtgaagtgagcatgtgactctatcggagtgtggagcgtgagcccctgtgtggctccgggatggatgcccctgcttgcccatctcccctggtggagctgcgccctctgctagtgtgccctgactgtgctgtgcagtgcgtgcgggatctgggccctagcgaagccaagtccctgggtggccagtgcgagcttgggtgcaagtgtcaacgccaccggacgcaagcatgtgacggccgatggctgtgacagatagacaaggttcacccctccgatctccctgccccccccagttacgactagcgttcttgaaccaatcgaggccccttcaaggggaaccccataatttagttgggccaagctcgaggaccaagtgaccttcgttgtggccgttctcacctcgggccctctccgtccccttaataatgtggggccccccatacggccagcacggacaccccattcttaacaacgcgggccagtcttcttgaaccacacaaatgacgcccccattcaagtgtgccgcaccaaaggagtccgaccgatgatccccggcgaacaaccacgttgggggaaagcaaaggtcccaacgttaattatttacggaaacaatatttgatgccactgtgtagcccttaacaaggggtggtggtccccttggttcgggacaagcgacagacgcgagcgcgatacacctagccgaacaagttacggacgcgaggtcgtggcttgtaacaggcgttg

SEQ ID NO: 483625 - DNA, 514 bp, Homo sapiens
  misc_feature (228)..(228): n is a, c, g, or t
  misc_feature (245)..(245): n is a, c, g, or t
  misc_feature (272)..(272): n is a, c, g, or t
  misc_feature (275)..(275): n is a, c, g, or t
tcgccggtgcgagtgtgcgttcgccgcttcggtggcgatgcgcgcgaggtgcggtcggttgtgcggtcgccgtgggcggtctggtggcggcgctcgggggggcggtggggggtgcgttgacctattctcgcggtgggcgagctgtggcatgcgggctcgccggtagagtttgggaagctcagcggtgaaggcgtgtggctttctgtggaggggtggtgtgggtggccnagtccgggggggccccnttcataaggggggccagtaggtgggcnccnccccacccttcttcgggccttgggggaaatattttgggtgggggggcccccctttttttggggggggccaccaccccccccccacatttttgttggggggttcccccgggcccaaagggcctctgtccccgggtccccagggggggggccctccccccagaggggccccccccaggggggcggggggggtcccccctggggggggttccggaccaacatgccctttccctgtttgggga

SEQ ID NO: 483626 - DNA, 1090 bp, Homo sapiens
  misc_feature (459)..(459): n is a, c, g, or t
  misc_feature (471)..(471): n is a, c, g, or t
agcggtatttggtttctattattctaattttataccgaccactcccccctgaagttgactctacacttccctgtggattttcgtggattaattaggaaaaccagagtagtaatccacgatctgagccaaggtaccctggcccaattgggtccattctactctcctgcgtaacaaacaggctctctctctgtgcactttattgtgtgtgtctattgtcaaagttgtagagagtacacgtggcgttggcgctatattcctcgtgacctaaacattaagaccaaagaagacacaaattctctgctgggcagagcctcgttaaatttgttgattggtttccccctttttaccctcaattggttttcagtaagtacgctgggtgttgactctgggtggtggctctttagtgtcgctcgtttgcgcacaactcgctctttgtggcgcactagatagctatcgtanacctcattttgnttctaaagtgcgtgtaggaaccatttttccgtgcaacgcagtgcgtgcaagatgacacacactttatgtttacgtctcccacatacaccgtgggtgttagtcccactcagtatttagtgggcactaaacaaaaacctttctctctattcatggggttgccctccttgtaaaccagctcttttagttttacacacacattgcacatatgttgtgcacaacacaagagtttccctatttgaaaacctcatctcgtatcactatcctccgttttcccatttccccctgtcccctcgtcccagaaagaaatgtctcgggatatatccctaccagaaaaagccccttaagcatctttaacaccacctctgctgggctttttaccacaaatttgcctgtgaaaaacccaacctttttgtaaggtttattccccagagaaaatgttgacattagggacctctgggcgccttgttctcccttcaaccaagcacattttccccgttcccaaaaggagcttggaccatttaaaccccaatatatttcttcgggggccaacatttggttgaaatcccttggggcccccccttttccccccatttccttcaaaacaccaattccaatccct

SEQ ID NO: 483627 - DNA, 743 bp, Homo sapiens
  misc_feature (448)..(448): n is a, c, g, or t
  misc_feature (491)..(491): n is a, c, g, or t
  misc_feature (512)..(512): n is a, c, g, or t
  misc_feature (550)..(551): n is a, c, g, or t
  misc_feature (636)..(636): n is a, c, g, or t
  misc_feature (654)..(654): n is a, c, g, or t
ggcttccggcatctggctcagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaaggggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattntgatattgtctctggaactcgctacaaaggaaatggaggtgtntatggctgggattgaacaganaaatactcagcgggggccaagtttttaactcagatctnnctgagaccaggagcatctgatttaacaggaagtttcagattataccgaaaagaagttctagagaatttactagaacaatgtgttntaaaggtacgtcttccanatggagatgatggttcgggcagactgaattatactatatgggaggggccaacataatatgtggagcgcgggtatggggcaagtgggggg

SEQ ID NO: 483628 - DNA, 769 bp, Homo sapiens
  misc_feature (448)..(448): n is a, c, g, or t
  misc_feature (491)..(491): n is a, c, g, or t
  misc_feature (576)..(577): n is a, c, g, or t
  misc_feature (662)..(662): n is a, c, g, or t
  misc_feature (680)..(680): n is a, c, g, or t
ggcttccggcatctggctcagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaaggggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattntgatattgtctctggaactcgctacaaaggaaatggaggtgtntatggctgggattgaaaaggagagactactccgatctgatcgttgattgtgcagccgtggcggccaagtttttaactcagatctnnctgagaccaggagcatctgatttaacaggaagtttcagattataccgaaaagaagttctagagaatttactagaacaatgtgttntaaaggtacgtcttccanatggagatgatggttcgggcagactgaattatactatatgggaggggccaacataatatgtggagcgcgggtatggggcaagtgggggg

SEQ ID NO: 483629 - DNA, 717 bp, Homo sapiens
  misc_feature (422)..(422): n is a, c, g, or t
  misc_feature (465)..(465): n is a, c, g, or t
  misc_feature (486)..(486): n is a, c, g, or t
  misc_feature (524)..(525): n is a, c, g, or t
  misc_feature (610)..(610): n is a, c, g, or t
  misc_feature (628)..(628): n is a, c, g, or t
ggcttccggcatctggctcagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaaggggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatgaagcaaaaggagggtaattntgatattgtctctggaactcgctacaaaggaaatggaggtgtntatggctgggattgaacaganaaatactcagcgggggccaagtttttaactcagatctnnctgagaccaggagcatctgatttaacaggaagtttcagattataccgaaaagaagttctagagaatttactagaacaatgtgttntaaaggtacgtcttccanatggagatgatggttcgggcagactgaattatactatatgggaggggccaacataatatgtggagcgcgggtatggggcaagtgggggg

SEQ ID NO: 483630 - DNA, 199 bp, Homo sapiens
  misc_feature (146)..(146): n is a, c, g, or t
gtcttatcttgaggatcccccctaatgtggaactgcttcgtcgcgtcagcggcggctgggtaggtgactttatttttcaagatgcctttcctctgctctgggggctggctgctagcaatgcctgtgctgcgccccctgctctcctnggtccggtggggtactcgtccacgtgtgacgtgcccgtgctccctcgccggag

SEQ ID NO: 483631 - DNA, 164 bp, Homo sapiens
ggctcggtaccgtatctctacattatgtctggggctagattcaaaacccacgtaatgaaaaagtcagcttttacaagcctaatttgtagttatatttcttttatatcaagttaacgttagaaaatggctatcaactatttaagtacaggacggatctatcatat

SEQ ID NO: 483632 - DNA, 1041 bp, Homo sapiens
gtggataaaacagttcacgtccggacccgcgagaaggaacatgtgtatccattaggttcccgggatctggatctagaagagtctctgaggtcaatgtagtatcatgtgcagggaggatctgacggggatgagttccaggaagaaccgctgatgtgacctgggtgcatgaattgatgcatctgtaaggcccttacaacggtgcctagagccgttgctggagcaatgagtcgctacaagacagtagacattactcacgggtactcatgtgctgtacgaattaccgacgcgttgtttcatctcaacaagattgctttcgggaagcaatactcgcttgatgaaccgatggttcaatggttcagggatgaacacccgaaaggttcgataagaataagttggcactaaagcgtttacgccacatgcgtccgtatcactggcaggagtacggacgtgcactagatatatgccggtactagttacactgaagggttgcacaaagagaacgtgcgaaaagagtcagacagctctccctcgacttgtcgtcctcaacattgggcactccaattgttggtcccttgttgtccatgaaatgagccatctggaatcaaatcggtgccaactgggtatctagttcggtgaacacacaaccataggcactaatcacaactcggcgagaactaactgccaacacacacatcggggctgacaacggctggacattgaagcaagcacagaccaaaggataacacacaaccccatagtgaagaccagaaaagggaccacgaacgcccacacgggaggcaatcactgaaccaaagccctactgccgcgaatacatcgagaacaagcggcacaacaccgaggacaccagcagaatacacagggcgcccagggcacgagacccaactaggctacaagacgagacaggagacgaccctacgaccacaataagaagggacacacgacagaacgaagacagacagagaagccgcgaaacaagatgcgccagcagcaacgaaaagacaccaaaaacggaccaacaac

SEQ ID NO: 483633 - DNA, 146 bp, Homo sapiens
gtggaaaaagggggggatagcgccccccccccccccccctttttccctttggggggggtggggggttttgggcccccccccgggtttttgtttgggccgaggctttcctgggccccccgggggaaaatttttttttgggtttttta

SEQ ID NO: 483634 - DNA, 160 bp, Homo sapiens
gtagaaaggagttattgaataggagaaggcactggaaatgttccctgtcttgatctggatggtgttacatggatgtgtacatatgtaaaaatgtatcaagctgtacatttagatttgtgcactatactgtatgaaagttatacctcaatttaaaaacaca

SEQ ID NO: 483635 - DNA, 230 bp, Homo sapiens
ctctgggttgaccaggctgaggccggcaggtctaagaaccaatggaagcacgcaagggcggtgaagagcgcttccaggccaggaaaggaggagatcatcaagatttaatccaggggatgaagagaccaagaaattaaaacttcccatttggtctggtcttacgggcctctggtgataacattagattcagccatttaaaattaaaacaagccttatctgcgggggtaccg

SEQ ID NO: 483636 - DNA, 134 bp, Homo sapiens
aacagcacagtacaaaattatcttccataacacatatatattacttgggtgaccccccctatttacaggatctataaggctagggggaatgagattattacaaagctcaaattcagcggggcatgtggggagcg

SEQ ID NO: 483637 - DNA, 576 bp, Homo sapiens
cccccgtagcagcgcccgcgccctccgggccttctccgccgggatctcgagcgaaagacgcccgccgttcgtccaggcctcgcctccctgcccaccgggcaggagccgcgccgccacgccgactcccgttgcgcacggtctgtccgctgcgacaccagcttgttggcgtcttcgtcgccgcgctcgccccgggctactcctgcgcgccgccaatgagctcccgtatcgtcatgggcgctcgccttagtcgtcagcgccttctccagcgtggacccaggctggctgctctccaactgccccgggtgcgctgccactgtcgcccgtgggggcgcccatggtgccgcgccgggagtcgggctgggtccgggaacaggcctgctggcatgcgtggtacaccggtccttgctgccaaagcaagcttctaacgagggacgggaagacaccacaagcaggccatgagacgcacagccaaagggggctggaactgcaactttcgggcgaccaggtcacaaccgcgtctgatagggggatctgcagagctccagtcagagggggcagacccctgcgggctcatac

SEQ ID NO: 483638 - DNA, 190 bp, Homo sapiens
tgcatcaacgcggtgggagctctccatattgtcgactgcaggcggcgcgaattcactagtgattccccaccaagcctgtttgttggtcactgttgtctgagggcatggctgagaaggacgtgggccaggtataatgggagctgtccctgagacttcctaggggcccatgaagagctccgactaggcgagg

SEQ ID NO: 483639 - DNA, 128 bp, Homo sapiens
gaagatggagacccacatctcatgcctgttcccggagctgctggccatgatcttttgctacctggacgaccggaacaatggtcaaacggcgtttttgtgcaccgcctggcgggactccgcctaccaca

SEQ ID NO: 483640 - DNA, 282 bp, Homo sapiens
catgacaagtgaaatctgctaccatcgcggtgtggacctctcagtcctgtctgccctcaggaagtcctcctttgcttcaaagagaccctgttagccccatcaacactccagaaaggccacactgcctcaaaaaagattgaccaacaacgccaaccctcaggaaatattccacggcagtgacaaggcaaacactgcccgatcacggagagtacaactccctcaggagaaagaaaacaacaagcaagatgaagaagctgagaaaccactcccagtcaaaccaac

SEQ ID NO: 483641 - DNA, 246 bp, Homo sapiens
  misc_feature (21)..(21): n is a, c, g, or t
  misc_feature (66)..(67): n is a, c, g, or t
  misc_feature (75)..(75): n is a, c, g, or t
  misc_feature (86)..(86): n is a, c, g, or t
  misc_feature (92)..(92): n is a, c, g, or t
  misc_feature (115)..(115): n is a, c, g, or t
gcaccatgcgcgcagagccantctccactccaaagttagacaaaatgccaggaatgttcttctctnnctaacccnaagggacttgnaaaggnacccctcattcacttctagacgncaaaatgcaaaaaagggggggccaacgcgcttttttgcattggaattttgaaaggcatacccttaggagtcttggttcccacattctggaaatctggaatgaaactctccccaggtaccagggcgtatctg

SEQ ID NO: 483642 - DNA, 893 bp, Homo sapiens
ttagggtttgcaataacttctatattttaatagaaataaattcctaaactcccttccctctctcccatttcaggaatttaaaattaagtagaacaaaaaacccagcgcacctgttagagtcgtcactctctattgtcatggggatcaacttttcattaaacttgaagcagtcgtggctttggcagctgttttggcttcagacacctgttcacagaaacaagcatgatgggaaaactatttccctgaccttgagctgtatccatctcttctaacactgtgaactttcttacttctcctctctctctaactctaatctcctaacacactaattctaacacccgtctttcatcatatgactctctaacacgatcgctgctacgcattgggcgcttgggcgagcggcatgaacgggcgagctgaatctaagcgataactgaaactaatcagctgactgacaaccacttttcccactcatcctttagttctgaagcattcgcttgtacccctttaacgatatccgatctttttctcttttaacccctaactctttcactctgaaagattcttactctgtactaaaaagtttcacacggtcacataaacttagaggaaaaatgcagctattctggtccaacaacaaaggaacaacataatcaagattttaagggctctccactctcctctctatcgtaactccgtcgtcaaaaatggaacaacacaacctcacaaacgcacacactccactgtgaagaacattctcggcctataatcattagttacagcaaggcattggtcagccaaaagctgtgtgtgcagaagtccatttcccacatctctcctcaagtatcctcctaataccaatcatgaatcccctacactcactgcccggtccc

SEQ ID NO: 483643 - DNA, 114 bp, Homo sapiens
tcctgttggtcgtatctagaggtatcccctgtgtagcgctcgggttaacaggcgtgagcccccgacgcctggcttcttaacttgttctaagcagcatgcgactacgagatcaat

SEQ ID NO: 483644 - DNA, 227 bp, Homo sapiens
ggtaccgacgtgtggaatagtggaagaggcacaagtactctcctacacttaggagcagaatctataaacttgcataaatcatttacagtagatcaacatctagcatcctcaaactgtccagcaactgttggtgtggtatccacctaccatcccactcttcataactctctatactgaactcttctgctcctcgaccccatgccactattatactaggctgtctcaca

SEQ ID NO: 483645 - DNA, 139 bp, Homo sapiens
ttcctcttctctcctacttgtaacgttggagtctgtgtgtaatcttgaatgtatgagacagcttacaccttgaacttatgaattactcagcagctgctacttgtagctatgctagggataaatacttcgatacttggct

SEQ ID NO: 483646 - DNA, 1686 bp, Homo sapiens
ttgttctgctgtgtcgcttcgtgcggtcggcgggtctgttcgcgtcgcttgtttgttgttcgctgtgtcttgctcttgtcttgtcctcttgctatcggttcgtctttcattgcgttcgtgcccgtatgggctgtacttgctcagctggtgctgcgtcgcgttgcttgcgtcgctctcgtctgtttacgtagcttgctgtctgcacgcgtcgtctgccatttgttgtcttgttcttagtcgcgcctgcgcgtgcgtccacgtactgttgttgtgatgttgtcgttctgtccgccccctctccgtcctgcttcgtgtttgtttgtttagtgctccttctctctacctcggtttttttgttgttgtgtgtgcgttactctcgacgtccgttcgtttgtgtttatctgatttgttttcgctgtactctgtggtatgcgtcccgctcctccccacgctagtggtcgtgcgccttctctctctgttttttattcccggtagcactggcgttgcgtgtgtttttttgtgggtcttcgctctgcgtccctcgccccgtcttgtggtttttgtgcttgtcgtctgcctcggctcggtcgtgctgctttgttcagcggtctgtggctttgtgctgtcttgctgacgtcgtgcctgcgtgctggtggtctgtgtgtgtgtgtgtggtgttgttcgtgtcgcttctgctccctccctgcggttgttggtggtgcgtgttcctgcgtggtctgtttcctcttcgtctcttgtctgctttgtgtcttggcactgcagcgctccgccgtcggttgtctctgctctctcagctcggctgctctggtgtgggggtatccttctctctctgccctgcgtggcggctcctcctcagcgcgcggtgcttttgtgtttcgtccgtgcggcgcgttgggctgggggcgtggccccccgcctctcttcgcgcgcgcgtgagtatgggcgctcgtcgccccctcgcgcgcgcctcgcgcgcgctctgtgtggtgtgtggtgagtgtgggggctcgctcccccactcgcgattgttgtgttgtgtgtgttgtgtgtggtcgggtgtgctgcggcgctctgcgtcgtatcgaggtagagtgtgagtgtgatgttctctctcttcctcctctctcgtcgctgtgtgtgtttgttttcttctgctcgcgcctcgcgctcctcacgcgcgcgcgcgcgcgcgtgtgtgtgtcgcgctcccgcgcgcgcgcgcgttagactcgccccgcgcgcgcgccgcgcctcgcgcgcgcgccggtgtgtgtgtgtgcgcgccgcctcctcgcgcgcgtggtgtgtgtggcctctcgcgcgccccccagttcaccacgccgcctccccctcctcccgtctgtgtgtgtgtgctcgctggcgcactcctcttctgctctctcccacccccccctctcctgctcgtgcgtctggtggtgcctccaccctcgcgcgcgctcgctcaccctcgcctcctcgctcgctctctcctctctctctcccgcgcgagatttgccctccgcgcctctgctcgctgcctgcgcgtggtgtggtgctgccacagatgatgtgtttctgttgtgtgtggtgtattatagatagagagggtgtgtggttcttcgtagaggagtggtgtggattaatattaaataataaaataatata

SEQ ID NO: 483647 - DNA, 234 bp, Homo sapiens
caacttgatcactgcacaccaggtagcatagccatatctttaagctggtcttctattgtcaccaaacctggagccttgactgccacaacctgaagaccaacctttagcctattcaagacgagtgtacttagaggcttcgtccatacaagcatctatcaggcggattatagaccaataggcttacggtgagcattggcaatttcaagaagcccttcccctccccccatctccctc

SEQ ID NO: 483648 - DNA, 885 bp, Homo sapiens
tctagccaagaaagcaaaggtacgcggagggcagagacgcaagaaaccaacgacatggtatgggacaaacagcgatggaccaagtgtggtcatgcaaaaaagcgcaagacacccgcttgctcacaggcggtaattgccctccaacaaggggggcacccccgggggaaaaaatggctgggtggcacaaacgggcattgttagagcctttcgcgtttctgcggccgtaaacaggggggaaagcccgccgccgggaaggtccgtcccggccgtggtagcagtccggacgaactgtcgctgccccccgtcctttagacaaggcggggcccccccccaaacggggcagagacccctgtgtccccgcaaaagccgtggcaaacagcccaacagcattacttcgcgtaacagagccgaaggggccaaaaatcgcccagaaaacccattggcccgcaggaatgataggctccctcacaggggcccaccccgcagggcgacaacccgatccaccaagggggcccccctgggcaacagcccccaggagaagctgcggggtgcatggcagcacgctgagacttgcaactccacaaccaggtcgccctcggcaatctgtttcctcccaacaagcgtctgggcagtgaaatttattccgggtagccacacacttcattggagcttagtaagtaattccaggatccacacttctcgcacggcacccagaggttataaaaaggtgataattctcccccacgtgtgtctcatattttctgaagcgttgaatgcccccgccggggccggcaaggaaaccaggtcccgccccgctaagtgtgaacatcatccgcgcgacagcacaaaatttaaaatttaaaaacaccacccaaaaacaaaaca

SEQ ID NO: 483649 - DNA, 527 bp, Homo sapiens
ccgtccttcatcatacctaccctgatttgactaataaaggctggtctattatcagactgtatagaggtgggaaggctaaactgaggaattatgtctgacagaagggaagaaatgactgcggtggccttctcagaccctgtaggtaaggcctttacttattcagtgaaagtgtctatttgaactaagaggtattttagtttcctgactcgggcatgttgagtaaagctaatttgccagtcctgggtgggggcaaatcctcgagcttgatgtgtagggaagggagggggcctgaataatccctgaggagtagtagaatagcaggtggaacactgagaagttatttccttgaggatagatttccaggatggaaaggaaatgagaggttctgagaggcgggctagtggcttgtactatagcatagcctgcctttgctggtgtgtggcgattaggcctggtggaactgccgtcaataaatcaagcgtgatcagggtgaggtaggtatgatgaaggacggggtaccgagctcg

SEQ ID NO: 483650 - DNA, 934 bp, Homo sapiens
cattttttaaatctgacaaactaaaaagtttaacgtcttctaaaagattgtcatcaacaccataatatgtaatctccaggagctaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaaaggagaaccgtgtcccggtttgatccagattcttttaaaagggcaaaactcagggtgcaatttggttctcccagtgggggttttttcaaagattttcctattccagatgtcactttaaagagaaatattagcttaaactctttggactttctggctattggtgacacttcccattggctgggcactggtggcgggcacactccgaaatttttacctactggtctggtaagcctcccaggcggggcatggcagggtcccttaggcaatgtctgtgtttggcctttatgcagagcgggtgctccaagtgctgtgatggagcccgtgctagaggacctgtaatggattcagaagttgtacgcttatacaaggacaccggtcctgctggttaattttaaccagttgttggcttgaagtaccgttgaggcctggactgctggcccgtccttagcgatggactggtccggaatccggaatatggtccacagccgcttactcaggggcctctcccccgcggaggcgactcatttgaagaccccaattctggttcaaagggtctatccccacttggcctccaaaatttcgggtccactcaaaagttcctgcccttctatcttaaaactttccacaaacacacaacacaaaatcttgtcggcctgccccaaaattcacca

SEQ ID NO: 483651 - DNA, 626 bp, Homo sapiens
taggagatggcgttatcctcagctgttagtgagtctagcggccgtttgcccgccccttgtcggggaaagggttgtttcttattgcccccgacggtgtgtatcaccaaactgaggttgcggcgagcatagtgtgctgtgcagcttcactagtgggacgcggacatctctatactagtagtgtacgcgatggggcgcgctcataaccacgggtgggagcgttttgtgataaaagagtatcatcgcggtcagagaactctctgctagtagtgagatgtagaacacctcggtatgacgcggtaacaaaaagaactgccttgaatcctcaatgcatcggcggcagcaaccatagtgtatctttgaaaagggcgtgatgcgcggaccggcacttgtcttgtcttcgtatacgcgacgacaccaagagagggtacaggatgttgctattagacgtaggaaaaactcctctgcggaggtaccctcgcaaatattgcatagtttgggtcaagactccacgccaatagtttgtgtgagtttggtgagtgtcttattagaatgtcttttgcaatttggcagcgatgagaagtgtgttgcaacactcgcccgaagatgtgcaatagcgaaggggtgga

SEQ ID NO: 483652 - DNA, 328 bp, Homo sapiens
tacgagacttctaaaaactagcagacgaaaacagtgaatcacaactataagggaagccccatcagactaacagcagaaatcttataggccaagagagaatcgagatagatatattcaacaatactgaaagaatgaaactactgaccaagaatactacacctaacaaagctgtctttttagaatgaaggatcaataaattctttcccagatgagaaaaaaatcaagggaatttatcaacactagatagccctacaagaaatgcttaagggagttctcaatctgaaagtgaaagggcaatatgtaccgccatggagtaaatggcagggga

SEQ ID NO: 483653 - DNA, 903 bp, Homo sapiens
gaccctcatgtacatcaatattatactaacgtctaccatctcacttctaggaatactacgctatatcgctcaggagcctcatatcctccctactatgcctagaaggcaataagtacaatcgcctgttcatcatagctgagctctcataaccctcaatgcccattcccctcttagccgaatattgtgcctattgccatagctagtctattgcgcgctctgcaagaagcagcaggtgggactagtcctactagtctcaatctccataatatatggctagagtacgttagtataaacgtaagagctactgccaatgctaaaatctaatcggtgcccaacaattatattagcgtaccactgactatgactttaccgattaaaagcagatacatttgaatcaacagcaagcacccacagactaattcattagcgatcatccctctacgtattttttagcctaaagcaacaatcaacctattatagtgtgttccccacctttttcctccgtggcccttaaggaccccctctcctaatagtatctaactgatttataccccgtcaacaatcatggtctgccaaggccgcttatggcagtgaatccactatcatcgaccaaaaaggtctacctgtgctatactagtgtccctagagatctcctttatttatagcatttcgcagcgcagaaggtcttccttcaccccgagggatgggaccatgctgaaggggcctgaaacggcggacatactttctgattctagacctagtagggtcctttccctgactcatggactgacgttaacgcggaccccctaggcggtgaaggtctactattatcccatggccaagaaattaatccgggcccagttcaggagacaccagggggggaaaacctgggaggcctgcctg

SEQ ID NO: 483654 - DNA, 376 bp, Homo sapiens
agcgctaagatacatatgatcttttgaccgaaggcggcccgactggcattgtataaacaaactcatcactagacatgggactacacaacacgtactacgtggtagctcacttgcacgatgtcctatcaataggagctgtatttggcatcatatgaggcttcattcactggtttcccctattgtcaggctacaccctagaccaaacctacgccaaaattcatttcactatcatattcatcggggtgagatctaactttgttcccacaacactttctcggcctatccggaatgccccgacgttactcggactaccccgatgcatacaccacatgaaacattctatcatctggaggctcattcatttctctaacagcag

SEQ ID NO: 483655 - DNA, 124 bp, Homo sapiens
ttcggcatcattctgtcagtcactaagattgaaatcttagaaggagtctatttctgtgctggtggtttccgtccccaaggtctggctacacttcacaattcctcgggacagggaagacgttgtt

SEQ ID NO: 483656 - DNA, 841 bp, Homo sapiens
acacgccgaccagctgcagagaggaactaccctctctgctgacagctggacacttatcaggagacctgcctgcagagaggagctaccctctctgctgagagctgaagagaagatgggccaaccagctgcagagaagagaggagctaccttctctaccgaacacggaacactccttgggacgacctgcccagcagagaggagctaccctccctgctgagagctgaacactcatcgggacaccctggctatgcagaggagctgcacactccaggtctactgtgagctgttctattgttcagtaaagctcctcttcgtcttgctcacgctccacttgtctgtgtacctcattcctcctggacacaggacgataatctgagacctgccaaatggcggggctaaaagagctgtaatacagacagggctgaaacacgccacttgctcgccattttgtgagtgacaaggacgagagaagtgagaaggagagaaggagaggagctgcagctctttgggaaacctagacctgggagctccccaagccagggctgtgactacccctttggggctctgaggttcctggagtctccaagcttctgggcaccactgtgttccctggtgccagccgtggaagctgcttgtggtgcagctggcccagcagcagcctcgcagagagccgacgccctgtgccagcacctgcagctgccgcccacggcagcagtcagtgtatctgactgtgcacagtggctggaccccaaattgtcacaaacccctcaatgctcaactgactgcagtctcctcgagggtgggatccagtgggtaacatgagcgagacagctgcaggtgg

SEQ ID NO: 483657 - DNA, 1301 bp, Homo sapiens
attcctgaagctgactgcattcgggaacggagatgtcatcggtccgctgggtcctatagactgtgcgtcagcagcatactctctctttctggcctggatgctatccagcgttacgtccaaagattcaggtgtactctacagttctatccagactagacgcaatggagagtccaatttccatgaattgctatgtgtctgggttgtccatccccatcactgacctattggaagttatgaacgtctacgtgacatgacatcgggagaggagtaatttcgcaacatcacgtgtggagcgagtttcaaggacattatggatcgtattgccagcgtaaccgggaactgggatctgttcctccattcctcctattgtcactataacgactgggagatttccatcccctcacttgtaaaaacaaggaatgcagtagttgcacttgggccggggttgacaaccattggtgaacctattctgttcaccgagcgccaacacgaattaggtataaagctgtgggactctgaagtaccactgatatacgtccagcaattcaatggaacgggttttgacaatgaatcgtcgcgacaatatcttggattgtcggtgctattgcataagttacccagggaatttctgccatatgctggtggcctatgtttgttaactaattgtggattactgccgttatgaattaacaacttttaccatcctttttatgcctaatcacacaaattgctcagggggcttgactcaacttgaacatttgctctaagccaatgtgaccaggttgaatcttttctcttgactcaatttcctcactttatggacgttgctggttcctcccaactgctcttgacctggttaattccttgatgcaaggtgttttggcatccccaccatgggcttaggacattctctaagggcatgtgggcttgggacaagctttaagtaaaggtgggccgtgatggcaagaatgaaattttcttctttaattccaaaaaattcaaagcatcttttggtcccaacgaattttgacaaccttcttttcaacgttcttctttgggcacttccaaaaaggcttttgttcacaagcaatacgtttaaaagccgttggcacttaaggctttaaacctttcgcaagtttttaaccataccatcctggcgttaagcaagcattttgggcgcggaacaaacattttcgcaaacagtataccaactctggcacccggggagtttattcgggcaccatcttggttactaacttcgcacgtgcagacgccatatcgggtccgtatatagagatccc

SEQ ID NO: 483658 - DNA, 159 bp, Homo sapiens
tgatgtcaacagaaatagttaagagtggagatccttgagctgtcctgatcttacagaagaagcatctagtctttcaccattcagtatgttagctgtgggtttttcatccatgtcctatgggttgaagaagtttttctccatagcttgtttcatgtgctt

SEQ ID NO: 483659 - DNA, 129 bp, Homo sapiens
  misc_feature (10)..(11): n is a, c, g, or t
  misc_feature (67)..(67): n is a, c, g, or t
  misc_feature (81)..(81): n is a, c, g, or t
ggaaagctgnntgctgtcatgacagctcggaaggacatagtagctagactgcagactcaggcctcancaactgttgccatncccaaagaacaccatcgctttgttattggctgatgggagaagactcca

SEQ ID NO: 483660 - DNA, 936 bp, Homo sapiens
gaccaaatgcggatacgccggtgcagcggtggtgtggcccgggtgccctggtggccctgggactgggaaccgcggtggcttccgcggaggttctcggcagtggcatccggtggccggggtcgcggccgtgtgactgtgtggccgtgggccgaggccgcaggagctctgctggagtgcaaggcacgaggataaggagtggattgcccgtcaccaagttggagccgcttggtcaaggacatgaagatcaagtccctggaagggagatcttagtcgtcgtttctcgccatgtacgtacttaaagggaactcaggacgatcagttgactatgtgttccattggaggggccatcatctcaaggactgaggtatacagaacgattattgcccagttgcaaggaacgccgggagccacgtggcccgagcacaagacgacacccaagagatttccaaggggacaattttgggttggcgattattccgggagggaacttagcaaagtggggcccacggatcagagtcttggagaatggttcaaaggttggcattcaccaagagggaaggaggttggacgaaaatcaggacgcaattcccaggatagggggagccaattgaatttcccttgggggccacaggctttcttccgaattcagattaacaccaggtggcggagcaagaatgagcgttaacattgtaggtgagaaacgcaaatgcattcggtggaagaaaaagcagaccagccaagcgaacatttgagttacaccacaactttgacagaggggggatgaccagaaggggcacacagagattagcagagagagcattcattggatggacattaggatacaaaggcagcattcaagtcagccacagttagcgaaacaacaacaggggcgcacaacatatgagagagattcagggataaataagcagaaaagag

SEQ ID NO: 483661 - DNA, 1122 bp, Homo sapiens
agcgaggcttgaggacagagtgcaggagctcactgcagccttgatctcctgggcttgagcgatcttcctgcttcagcctctcacatagtttagactacaggtgtgccaccatggctggttaatttttaaatttttagtaggtgggatctccctcatcttgcccaggttggccttgaactccagccttcaagctatcctcccacctcagcgctcccaaaatgctgggattacaggtgtgaaccacctcaccaggcctatgtatgcactcttaaaccctggaatcagattagacccacgaccctcccacaatcataccttgttctccattgatgttaatggtgcttgaagcagaatgtgaagagaatagggagagggggtcctgggccacgggcacaccacagggcgagacagggacgagggggcgcaagacacacgggaaacacaggaagagaatgatgtgccatccgaggtacaaacacaaaaacaacgagggcacaagaagcacacccggagaagaacgcggggaaataaccaggggtgccccaaccggacaacaacacgaggaatacacaccacaacgggaccagacagataaggcaacattaaacaagaaaagcccgagtataacaacagcagtagctggagacaccaggacagggatacaacggaaagagcacgtagaaaacgtagggggaaaacacaaaaccaaccacatacgagcaacgacacacacaagacggacgccgtggcgcacagaaccaccagagcgaacgacacaacacacagcaagcgcaccacgaggacacaggaagcggcaaacaaagaggagagagcctcgaacatgccaacatagacgacacaacgccaaaacaaaacggcccaaacgacgccccacgagacgcacccaccgcgccaaagagacacatgggaagcccctcggcagctgagcagacgcgggaacgagacaacaccgcgcaaccagtcggggaacagtgggcaaaagcgcaagcggcgaggatagcagcagagacactgcacccctagcacgaaaaggaggcgcccacgacgcatcacacaagcgagcggacagcgccgaaggccgagtcgacgcgacccagccaa

SEQ ID NO: 483662 - DNA, 449 bp, Homo sapiens
tagtatcccttattttcactgtgcgtgagcaatggtcatgtgtcagctgcaaagttacagagaaacgagcagcacattaggaaatgtatgaacatcaccttgcatagactcgcttttataaggcatcaatggttcaggtctattaaatgtcttgcgtggggtaaacctctaggtgcttttaaaagaaacctggaaatgtatttaaacatttgcacatggagcagatgggactaaaaaaggaaactacgttcttcagattacattgcctccaagtctgggcagcaatttaaaacaaaggcacgggttagaaggagatttaatatcaatatggggatcttttgtacagacacacacacatctgtgttgacaggaccaaaaggaatccggatatcagaacgtccaaataaaagagaaaaaagtcttcatgagatgaaggcctgcctggagaa

SEQ ID NO: 483663 - DNA, 1136 bp, Homo sapiens
  misc_feature (191)..(191): n is a, c, g, or t
  misc_feature (401)..(401): n is a, c, g, or t
ggctctgcggtgggtgccgtggggatggcggtagccggagctgtacccggatctcgtggaggagcggcggacggcgggtcgaggtcgtcgagctcgtgatccaccgcccgcggcagccgagtcactatcctcgccactccgtcgcgccttgcggctcgaaggccctctgtgcctcggcaacgtgaatggantggcagggtcatgggggtgctctgagggtctgggcgcacaagcggtcgctccgtccctccgtgcaggcgtctcttgttccgctgatcaacttgtggccgcggttgcgtgaatcgggcagctcgagttcatcacgcgcgtagctccatccgttgtaagtcatgcatcaagtcccagtgtgcggtcgattgagtccagaatgcacacacccnatgccctttggtgctcctgattgtgcttgggcgagggtccggtcccgtcgtatcatgccgtcagtcttcttctcgcataacgccacatgagattcccattcagttgcgacagtttcggtccttggttaacatgaattcagggggacgttgtcttctccggtagcggacacttggaaggaatccccctccgtggcgttggaagggttcgcaatagcagcaccctcatcgtaacttagttggaacttcggagggtgattacgcacattgaaagagcagatgggttttatatgcgcgcattccctatgaattggaagcactttggacgacaaggtcgattttcgcggaaggcacaaggccattcaaatactgtacaggacctttcccgcttgaaaggaaaccacgtttgttgacaacgtcgaagaagaacttccctttaccaggaacaagttgactgtaaattgcaggctgttgatgattcccacggccgtttgtgtgggggcccgaattgcgccttgagattggtttccagtacctagcacattggcggccagtgcttttggccgtccccccgtgttatgccgggggaaccgtccgggagcgtcgctaaggttgcccaggtgggcgctgttgccttgaaagctttcctgtttggcgcccagggatttgggcgcacatgacgggaaagcgcgccttgtggtggggagttccttctggttgggactttttcgcccttat

SEQ ID NO: 483664 - DNA, 248 bp, Homo sapiens
gggtgaggttcagctggagattgagatctctctggggttcatcttggagtttctcccactgtaataaggattaacgaaatccagttccaacaggagcacactctataatggttacccttgatgtgctagtgaattgaagagaagcccaaagcagctttgggagtgctagtagtgttccgtttcatatttctaaatgctgattaccgaggtgtattcaatttgcaaaaagttgttcaagctgtacctca

SEQ ID NO: 483665 - DNA, 904 bp, Homo sapiens
gcgctgaggcacgcgagaagaggccggaccggagagcaacaagcggagtcgccagcgaaagaagtcgactccctagagaagccgcgtagagtaaggccccgcacagttcgccccgtacctctgcccctggtttaaatatgcagacctgcttctgaaagtgtggtacgatcgaagggagtatgtgtaacactggaatattgggtggaagacagtagggatgttatgtacattgtggatacatcaaatattaaattcagtgtgtctcgggaaggaaggtgattaatttgaagcatttgaaatgaaatgggatctattacaatgtatggatccaaatgaatccctaaggataaataatgaacagggaaaaagagtcgatggatatgtggtttacaaagaaggagaattcttggccagtgcaatgagccaagtgttaacaaagggaaaggggcaaacgtaaactggggttaaggtggtgagacctcagtaattgtggaaagagttgggaaacgattgattgcagattgaagacatggtctaatttgggatccgttcttcttgaggtggatgaagcaacatatggtttgatgagcgacggagattcaactttacccacaacactggtagattgggacgcagatggttgattcacctgaccacgtggttgactgacgaactttgctgactcgggactagggaatagttgtctcccggggactgggacgcacgaatatctcctgcagaatccatatgcgagaatccgagtggtacttgaaggaaatatggatacggcactgcacctttcaactgtgggtaacacgccagtacggggttgccagtgttgcgtttatcacgagaaaactgttaattcgcgcaacgtgcccgacatacggacaaacacacttta

SEQ ID NO: 483666 - DNA, 458 bp, Homo sapiens
  misc_feature (48)..(48): n is a, c, g, or t
ccgcacgagttcggagttatttgggagaactggctcacatgattacanaggcaaatccacgatatgaggtctgcaagccgggaaagagagctcgtagtggctcagtccgagtctgaaagcctcaaaaccagggaagccaacagtgcagccattagtctgtggcaaaagcccaagagcccctggcaagccactggtacaagtccaagagtccaaaggccttagaacctggagtcttatgtggacgggcaggaggagtgggaggaagcatccaggatgggagaaggaaggaagccaggagactcagcaagcttatcccaccttcttctgcctgctttgttctagctgcactggcaaccaactggatggtgcccacccacgttgagggtgggtcttcctctcctagtcccccagctcaaatgtcagtttcctctggcaacaccctcctcccaaacaccccc

SEQ ID NO: 483667 - DNA, 137 bp, Homo sapiens
gatgctggtggacaggtgcatagcaactgactcgtcgtgaaccagaccaagagcgggaatgtgtggtgcgtgcggccctggtggcaccgtgaggggccgaggccgagtgccacctgcccacccatgtcacctcatgg

SEQ ID NO: 483668 - DNA, 255 bp, Homo sapiens
  misc_feature (100)..(100): n is a, c, g, or t
  misc_feature (131)..(131): n is a, c, g, or t
cttaaatgcaggaggagtagagtagtcaatttcatgtgtcaactgcactggactacagggagcccagatacttggtcaaacatggttctgggtgtatgtnacggtgtttctggatgagattcccatttgantccatagactgaataaaccataatgccctccccagtgtggatgagcttcattcaattagttgaaggtctgaatagaacaaaagggctatccttcccgtaagtaagagagaattctttctgccca

SEQ ID NO: 483669 - DNA, 595 bp, Homo sapiens
gcgttcagatttcagccttccaggcatcttgcccacctccccaccctcggtattaagggtcgtgactgtgactaaccctcgggcacaggccgtgctgtagagaggccagtggtcacaatgagcccacgacaggaggaggagccctggcttgagggaaggggaaggcccaggcctgtgccgggccccagggctggcagccaccagctcctcttccaggcatgggggacaccctgacgggatccggaagtctccatttacccaaaaatgcaagagccatgatcagtcatggcgacactgcaggcggtactgagtgaccatgtccagtccggctccgtccctcccacacgggggacgagcttctccgaggaggcctggccaaggtggaacaaataccctgatgtcgaaaaatgcctaaaaatcccacagacggaattttcaaaaagaggagaaacctcccgcgggagggaggcagcgagactccgaacacggtagcaagcactctggacagactcatgtatgaaaaagtcatcatggtttcaggaaacagccccacaggctgggctgctggagaatgatccttttccaaaaccgaaag

SEQ ID NO: 483670 - DNA, 472 bp, Homo sapiens
cttgggccaacatggtgaaacccgtctccactaaaaacacaaaaattatctgggcttggtggcgggcacctgcaatcccaggtacttgggaggctaaggcacgagaattgcctgaacccgggaagcggaggtagcagtgagccgagattgcaccatttgcactgaagcctgggcaacatagcgagacaccaatcaaaaaaaaatagtttctaaaaaacaaatccttcaagtgtcataatcattttaaagacattttccatcatttaagcccctctttatttaaggataaaagtatacaggttttggtcttaagttgacttgggaattctcttaatattgtgaaaatccaagctagggctttgagaatgtgctaaaaaaagggtttgacattattttcccccaccaaatacttcgttatttcatttaacatgtgatattacagggccgggccccgtggctcaacctgtaatct

SEQ ID NO: 483671 - DNA, 255 bp, Homo sapiens
gggatcctcctggcaatgttgtggtggtgctgattctggtccctctgaaggaccgcttgctcgaccctttactgctgcggtgcaagctgcttcactctgatctgcacaagatggcgctggggatgtacataaggatttacctccggggattgtggcaagagtcctggagatggagcgcttacaatacattcaccaaaacgagaccgtgtcccagcaaattggggaggtccctgtacaaagcggcaccactgtcca

SEQ ID NO: 483672 - DNA, 306 bp, Homo sapiens
gaaagggatgaatataaaattatttatggtaagccaggcacagtggctcacgcctgtactcccaatgctttgggaggctgagaaaggccactcacttgaagtcaggagttcgagaccagcctggccaacatggtgaaaccttgtctctattaaaaatacaaaaattagccaggtgtgatggtatgcacctgtagtctcagctactcaggatgctgaggcaggagaattaattgcctggacccaggaggtagaggttgcagtgagctgagctcatgtcactgcacttcagtctgggcaatagccgtt

SEQ ID NO: 483673 - DNA, 245 bp, Homo sapiens
  misc_feature (213)..(213): n is a, c, g, or t
  misc_feature (245)..(245): n is a, c, g, or t
ggggcaggcctctttgagactccagctcttcaaatggcagcggtaggagttggtagcccattaggcccaggtgccgctccctcaaggcccgcgagcccagcagcaccctgccgtctcggagaaaatgccagccgttctctcagcatcagcaccacccttttgggcaagggtcttgggttgtggagttaaagtttgcctggtcctggttggcangaccgtggtggggtaaggcaggaaaggggtcn

SEQ ID NO: 483674 - DNA, 726 bp, Homo sapiens
cgcggtggctcatgcctataatcccagcaccgtgggaggctgaggcaggcggctcacttgaggtcaggagtttgagaccagcctggccaacatggtgaaacccatctctacaaaaaatacaaaaattagctgggcatggtgatatgcgcctgtaatcccagctgcttgggaggctgaggcagaagaatcgcttgaactcgggaggcggaggtcgcagtgagctgagattgtgccactgaactccagcctggggggacaaaggcgaaagactgtctcaaacaaacagaaaaaaagaggaagtgataatcttgggaaagttattttcttttctgaggctaagtttttcatctataaataagatctacagcctagggaattcctaacgggtgaatttcatttatttcattttcatcattcttttgacgacagagccttgccagtgtcaccccaggctgcagtgcatgtgtgtgcgatctccagtttgattggcgaccctccgccctcctgaggttcagcgcggatccctcatgcctcagtcttgtaagtagactggggatcacaggctttgaaccaacttgtgtccatcacaattcacggggtgaaattctttaagaacaaataacttctatcaggcctggtaagcgttagtggctgatcacgtataagcatcagatagtattaacctatattgttcgccttggcccaagcaggtatcggtagacatgg

SEQ ID NO: 483675 - DNA, 1104 bp, Homo sapiens
gacatctcgtgactgggcaggtaccctcataggttcgcaggtggaggatgctggatagacaaggttggcctactaagtgctgaatcagtagcatgcgccgctgtcgtagtgatgactggagactgagctctggtggctgagacagttgctaccacagcaggagggatggcattggaggtggtcacaggtggccgagactggattggttggtgaatgatgtgctgtactgctggctgagcagtagcagcatttggcagctgtgaggtcggcctcaggactgtggttactttagaactggacatcaacagcagcagcagctgcacctcgaggtaaatgagaagctccaatgtgaagagggggcccaggagcattgctgcggatgatagacatttgcacatttgtagtcatgatgtgatgcaggttactgggatggccctgttgtccactgattgttgccacaggaatggctgaagcttgagggatgctactctccatggtaacggtaacctgccctggaaccttggggggaagtgacagggtagaaggtggagcaggagcaatgggacggctaggcatggtgggcttcgggggcggcttcataagtccctccgaaaatgaaagtggcactgctggcgtcaggtgtgctggcggggctgtcactgcaacaggtgtggctgatgcgacagcatggtgtgtcgacaacatctgcacctgtggatagggccttaccacaacaggctcttgcttctcctcccgggactggagggagctgctggaactcatgtgctccctggcactgacttcagaatctcgaccagattcatcattgactgtagcagctgggtttatcaatccagcagaaccactgtttgcaatctgagaaggggcctggctcagcccggtagaaggggctcctaaccgaggaaactgttgagaactcatttccacctgggtgctgcgcccagtggccgccgcgccgccttgagctcgctcccgcgcgctctccgtctgtggggccgacgtccccaggctccggacccgcagccaccgccggggagctagcactctgccccccacccctcactccagcgccgctgctccgct

SEQ ID NO: 483676 - DNA, 1118 bp, Homo sapiens
gacatctcgtgactgggcaggtaccctcataggttcgcaggtggaggatgctggatagacaaggttggcctactaagtgctgaatcagtagcatgcgccgctgtcgtagtgatgactggagactgagctctggtggctgagacagttgctaccacagcaggagggatggcattggaggtggtcacaggtggccgagactggattggttggtgaatgatgtgctgtactgctggctgagcagtagcagcatttggcagctgtgaggtcggcctcaggactgtggttactttagaactggacatcaacagcagcagcagctgcacctcgaggtaaatgagaagctccaatgtgaagagggggcccaggagcattgctgcggatgatagacatttgcacatttgtagtcatgatgtgatgcaggttactgggatggccctgttgtccactgattgttgccacaggaatggctgaagcttgagggatgctactctccatggtaacggtaacctgccctggaaccttggggggaagtgacagggtagaaggtggagcaggagcaatgggacggctaggcatggtgggcttcgggggcggcttcataagtccctccgaaaatgaaagtggcactgctggcgtcaggtgtgctggcggggctgtcactgcaacaggtgtggctgatgcgacagcatggtgtgtcgacaacatctgcacctgtggatagggccttaccacaacaggctcttgcttctcctcccgggactggagggagctgctggaactcatgtgctccctggcactgacttcagaatctcgaccagattcatcattgactgtagcagctgggtttatcaatccagcagaaccactgtttgcaatctgagaaggggcctggctcagcccggtagaaggggctcctaaccgaggaaactgttgagaactcatttccacctgtagccgccgcccgccgcccgcaccgcccgcttctatctcgccggcctgggggtgccgcggagggcccatctcggcggcggcgatgtgctcggcgggcgcggggagggatcgcggcggcggcgcccggggcccgctgctgtccagccccgctggccccactcaccccc

SEQ ID NO: 483677 - DNA, 317 bp, Homo sapiens
ccgggtcgacgggggacatttgggatagcattgaaaatgtaaatgaggaaaatacctaattaaaaaaaaacaaggcattttaaaaacatgtaattacacatacgaaaatatttacctgcataagagattgatcaaggccataaccaataccgtttaaccctctcttggttgaaaagctaatccatggacatgccaataaagatggtgtgataaaacacacttcacactgtgggtgctcagaaagccatctgtccttgtagagttaaataactgtattccccacatgcatatgcctcaggtaaatgcttggtcgacgc

SEQ ID NO: 483678 - DNA, 127 bp, Homo sapiens
agattctgaggatcccctccaaggatgaggaagtgtactgaggggcacgggggacagaaatgagtacactccctgcttcaaagggctttggatttaatagacatgatggccaaagaaatgacaattt

SEQ ID NO: 483679 - DNA, 327 bp, Homo sapiens
gagccggcccccaccgcagactcgatctgcgcggcgccccccgactgcttggcgaatccgtagaccatcgacaggccgaggcccgtgcccttgccctcctccttggtggtgaagaacgggtccatcacccgggcgagcacggcgggcgggatgccggtgccggtgtccttgatggcgatgctgacgtagcggccgtcgcgcagcggcccgatctcgcgaccgcgcgaggcgacctcgctgttctcggtggagatccggacggtgccgccctccggcatcgcgtcgcgggcgttgatcaggacgttcaggatcgcgacctcggcctgg

SEQ ID NO: 483680 - DNA, 93 bp, Homo sapiens
ggacgcccgtgaccatgtggaggctgctggtcgcgcatgccgctcctgggtgcccttgtcagattcctgggcactcctccccgccagtgctgg

SEQ ID NO: 483681 - DNA, 1232 bp, Homo sapiens
gacatctcgtgactgggcaggtaccctcataggttcgcaggtggaggatgctggatagacaaggttggcctactaagtgctgaatcagtagcatgcgccgctgtcgtagtgatgactggagactgagctctggtggctgagacagttgctaccacagcaggagggatggcattggaggtggtcacaggtggccgagactggattggttggtgaatgatgtgctgtactgctggctgagcagtagcagcatttggcagctgtgaggtcggcctcaggactgtggttactttagaactggacatcaacagcagcagcagctgcacctcgaggtaaatgagaagctccaatgtgaagagggggcccaggagcattgctgcggatgatagacatttgcacatttgtagtcatgatgtgatgcaggttactgggatggccctgttgtccactgattgttgccacaggaatggctgaagcttgagggatgctactctccatggtaacggtaacctgccctggaaccttggggggaagtgacagggtagaaggtggagcaggagcaatgggacggctaggcatggtgggcttcgggggcggcttcataagtccctccgaaaatgaaagtggcactgctggcgtcaggtgtgctggcggggctgtcactgcaacaggtgtggctgatgcgacagcatggtgtgtcgacaacatctgcacctgtggatagggccttaccacaacaggctcttgcttctcctcccgggactggagggagctgctggaactcatgtgctccctggcactgacttcagaatctcgaccagattcatcattgactagtaaagacattaagagtgagacagtatgtcacagtctcccagtgtaagatagcagcacagacaagagtggtacctgaagttaaatctcaggattgacaaagtggccatttccttgtgatgttttcttaacaaggtcaatatgggcactggattctcctgatggacatcagacaaaagagccacaactgtggaatatagaatttattctggatattgtagccttatgaacaaactacctgaaaatcatctaaaatgagctgaaatagttaaaagtacaatacaggatgtaagacaatttcatttaaaacatcctcttagaaagttataaaagcctgacattaaaaagatattttatgctggccaacatggcaaaaccctatctctactaaaaatacaaaa

SEQ ID NO: 483682 - DNA, 244 bp, Homo sapiens
ttgctacgattgatgtatcattctccaactcatccttggatggctgatccagcatcacaaggtccttcatggaagtgcaaggtatgggaccacaccccatcgccggagccagacctcgttgccttcttggagtgtggctccagaggagactgcagcttcacctcctgcacgagcagctcccgactctgagaataattatcctcctcggagaaaatctggcagaggctggaaaagactttgaggc

SEQ ID NO: 483683 - DNA, 385 bp, Homo sapiens
  misc_feature (9)..(9): n is a, c, g, or t
  misc_feature (75)..(75): n is a, c, g, or t
  misc_feature (153)..(153): n is a, c, g, or t
  misc_feature (162)..(162): n is a, c, g, or t
gagaaatgntctctcatacatactctcgtctggtaaaatataagcaagaaatattcatttctgaagtgctttccntcactgtaaaggtctgatctcctcccatatgcctatgtacctttactgttaggaagctttgcctatgtagttatagangatagctantaaatactaaagatatgtcattctccccaaggagacacaggtggcaatgattccttgcctcatgttgatgagtctgtagaattcagaacccatttggacacagctaatatccctgctcttggggtagaaataaggacaccaagtcattggtagggaggtacaggcccttcccctgctgctgcagagagagaatgactcaagaaaattgggctaaaatttgtct

SEQ ID NO: 483684 - DNA, 215 bp, Homo sapiens
gagtagaatgcttgaccccaggagttcaagaccagcctgggcaacatagtgagacccccccatctctagaaaagatttaaaataaagtaaaacaaaacaaaacaaaataaaataaagtaagaggacagcaaaaaaattcctaaataaaactgggaaagaacatcaggaaaataacatgagaagaaaagcaatgaaagagtgactattaaatcact

SEQ ID NO: 483685 - DNA, 384 bp, Homo sapiens
gacatgattcgaaccgagcttgtacctgtgggtatgcacaataaggataggtcccaggctggggagagccccaacgttgagaacaagtaagtgaacaagttagttgtatgaacaattgttgagagactagctagatcacaaacaacctgcggtgcacaatgtatctcattacacactgtagcacccttcagtcagtgaccgctataaatactttccgtccagacccttggcctctattgcatggttagccccattctctagctgagactgcccacttgtcaagcatattttcacaattttctcttaataagatctgccacttctttacctacaatctatcttggttaaactggctttaccaccctgcataaactgagccctagg

SEQ ID NO: 483686 - DNA, 848 bp, Homo sapiens
gtctcgataatggatgcagtgattgcgattgtgtgttcacacagagtaaaagcactcaggcctagacttttggagacccagattctctaataaggtataggagttggatctttagttttagggcagctattcacaaatactgccaaggcaatttctcccactgcatattgtttaattgtactgtatttccaaatccctaagcttttaaatgaacagaaaactgtacagtccaaaatgaattactatcacagttaggttgggcacagtgcatcaggatgtaatcccagcactttgggaggctgaggcaggaagatcacttgaggtcaggagttcgagaccaccctggcaaacatggtgaaaccccacctctacaaaaaataccaaaacttagctgagagtagtggcacatgcctgtaatcccagttgttcaggaggctgaggcaggaaaatcacttgaacctgggagatacgacattgccgtgagctgaagatcaaaccatgcactccatgccttagacaacagaagcaaagaattttgcccttctacatcacaaactacactgtatacataagcaagttcctatatttccgcatcaaactcttttatcgggcaccctgaccataaaatatttaacagcgccttgactcacggtatctccgatgaatgatagacaacatagaatgaaatatggtaaaaatcatcgtaatatcttgggagagaccacaccttctagtttccgggtgtaccatcgattagtaacacagagaacaaatactccaatataagaacctattcaactctacggcaagtatgcaagggtacacaggtacctaaaaatcttcgtacg

SEQ ID NO: 483687 - DNA, 956 bp, Homo sapiens
  misc_feature (123)..(123): n is a, c, g, or t
ggctgaacaatcatggatttttctgatcaattgtgctttaaggaaattattgacagttttgcacaggttccttgaaaacgttatttataatgaaatcaactaaaactatttttgctataagtnctataaggtgcataaaacccttaaattcatctagtagctgttcccccgaacaggtttattttagtaaaaaaaaaaaaaacaaaaaacaaaaacaaaagatttttatcaaatgttatgatgcaaaaaaagaaaaagaaaaaaaaaaaagaaaagaaaacttcaattttctgggtttgcacaaagaccatgaagacttatccaagtgcatgaccggattttgggggtttggtccatttggtgtttaccttggtgtttttttttcccagctgtttgaaaggggcttcctgaagtttaaatagtccgatttccccctggggtgttctgtgcttgcagcggcgagtgtggctgtatatccaggtgtgtcgccgcagggtctctttcttaagcttctgtctttcttccacgcgtaggtggtgaagtgtcttatccttttctatgaattccccaatttgcccttaacctcttttggatggctgtacctgtttccggtacaagttcggttcaccttatggtgtcacattgctctgcccaaattgagctgctctattatgcctggtaaccagacggccatggctttaaatggttcaatacagtgcgacattggcctcttacaactttgactgggtctcacgtttcccatacggtgtggggaccgcagggaaacgtcgttgcacctcttctgggaccgtaggaggtggtggggcgccctccctgtttatgtgacatcgttgcaagctccgtttgaaaaagggcgtcttgcccagccccttgccaggtatatgtttcgtctgtcttgtcctaatagaattataagattcagtttccattctttg

SEQ ID NO: 483688 - DNA, 1224 bp, Homo sapiens
gatcacctataatatgcaacttccagaccctgttctacctctatctggctgtcgatgcgtgcggactgtccacattgcgacatggtcatccagtcgtgtgtgtggtacatactggacctgttggtgcccgcgacatcatgcaggtgtggtctccatcctgtgacgataccatgagctgcctcatacaagcatgcttgcatccttgactcttatcatgcagtttagcactacctacataagtggttataaggaggcatcctggtacatcaacgttggatcgagaggacgcgaatataatacacactgatcgaaatcgcggcagagtgtgggatatccgcatagaagaacagtctctctttgagctagttgcatcccacttgcatagcatctgcgagtttcactcagcacaacacgggatccctcctaaagttgcgcgaacactgcgcaaaaaagggcgtagctttggacatgagattggaaacaccactgttgggcaaaggtatccacgcttaccttaggaagcacgcaccaacacgaatggagagacttacttattgagaggacccaaggatacgcggttccgtatttcgcacaggaactaacggcgttgccaccgcaggaacgtgaacgtggaaaaggaaccttactttgatacaccggggaacccatggttacgccattagcaattcgcaaaacaaattttgttaaataccatggtaaaggacacagggggcggatctaaagacaaagacttagtgaccaaacctgtgcaccggcctcgggtacaatttgttagcgagttaacacggttaacccactacgcatattggcacttgggacacatagtttacggagacccaaacatatacttggcacacgatacgaaggcgaagcacaagaagcgtggtcgccataatagacaaagctttaccccttgggggaaccaaacatgagggaaaccgattggccacagagtatggtatggttccattggcccaatatgcgccaaagaggttggcccaacgaacaaacagacaattaggaagggatccgaaagcatattccccagttataactagacagataataaactccagcgacagtttcgtataccacataggccccatgtaagtcacccccccgttttgtcacccagtagtactgccaaatagctagttgattggtaaaacatacactatacgctatacgggacgagcgtaaaca

SEQ ID NO: 483689 - DNA, 373 bp, Homo sapiens
  misc_feature (326)..(326): n is a, c, g, or t
taagagacagggtcttcttccatcgcccgggcaggagtgcagtggtgccatcatggcttgtggtagccttgagctcttgggctcaagcagtcctttcacctcagcctcccgagtagctgggactacagacgtgcaccaccatacctggttaactttttaatttaaatttttgtagagatggggtctcgttctgttgtccgggctggtctagaattcctgggcctcaagcaatcttcccgccttggcctctcaaagcagtaggaatacaagcatggggccaccgtgcttgaatggatttagattcatagaggggcaaaaagatcatnagggaagtttgttttctctgattttgaagtttgcttgttacatttgc

SEQ ID NO: 483690 - DNA, 958 bp, Homo sapiens
ctttaagtactgcagaatctcatcatgggctctgttgaagatggtgatgcatgccagtatcgggaggcaacttggaagtgatgggtctgatggctaggaaaggtggatggtgaaaccatgatgcattatggagcagttttgctttggctgatgtgaggtgcacatgaagacccggagtaaagtgcatcacggctgcgtgcatgatgaactacgatggctgcatacgatagaagaatgcgataacatggttggccgccttgaaacatgcacatcggcgtggtatcatagccaccctggctacggctgcatggcttctctggcgatggactgttagtgactcacagtgctctatcagcagttcgctggaaccatttgtgagcagtggctgattgatccatacaagatacaattatccgtcagggaacagtgaatcttggcgcgttccaggagcatacccagaagggccgtacaaagcctccgtgatgaaaggaccttctgagtatcagagtattccacgttaagtaaagataggaagattttgggtgtacactggaaagcaatattatgccttagaagtctgcatatttgaaatcctctttggatcgcaagattgcttgagctggtgtggaataaatactgggtgaatacgtcgagttcttgtagctggcttactaatgcggactataccagtggtcgggtgtttgattcgtcatgagacgttagagcagtcagaagctcagctgggacgagggagttacatgttgggttgaggaaagcttgacgatgaatccgaatgacagaattggcatcatgctacaagagacgagctggtcaagatgttgcatagaaggtatccaagggagttgatgtttccaggttattgaggataaatggtaaagcatatgacatctctttaaaatgtggttgaaagtattaacttgaagagagctgagaaatt

SEQ ID NO: 483691 - DNA, 260 bp, Homo sapiens
tacaatgcatgaaatattttaattaatctaaacatttatagagtatacaaaaaaatgggggtaggtccatgcaaatattccattttataaaaaagctggcatctgtggatttaggtatactcagggggtactggaaccaatctttttgcaatatagcaggcagcaactttatttgaaagaaatggaaacttttttttttttttgaaatggagtttcgctctaccacccaagctggagggcagtaggtcgacccggccgca

SEQ ID NO: 483692 - DNA, 116 bp, Homo sapiens
atcgatctagaggatccctgggagaatggagtagacgtcccttggtacaatgctcctctcccccttcttttcccaccaattcctatttccctaccaaccatagggagcctccagaa

SEQ ID NO: 483693 - DNA, 243 bp, Homo sapiens
ctatagtcactccaggtctatagagagggttcttctactattaggacttatcgcttcgaagcgaaggcttctcaaatcatgaaacttattaatattactgctgatagagaaatgaatgagcctacagatgatcggatgtctcatgtggtgtctgccgtcggggtggtccgagtacaccgtcggggcattccggatacggcccgcgaaacgtgtcgtgggaagaactttttagcttaccgccga

SEQ ID NO: 483694 - DNA, 146 bp, Homo sapiens
taatgaagctgaacgatatacacagcaattccaaccacagaagacctactgtcaccacatatagaggagcaatacctggaggagccaagtcagacaatcgaaaatcctgaataagcaaaaagtaagtaaataaattgccatctgga

SEQ ID NO: 483695 - DNA, 177 bp, Homo sapiens
catggactgtggagtcacctcattgtgcccgatgccactcgtactataatcgagcgtacgttcaatcccttctcgggaatgtgcgtctattcccccagtagagagtaggaccagcctgctgaggctgtgggaacctgtggctgccttggacgctgcagccacatccgtactggcccg

SEQ ID NO: 483696 - DNA, 214 bp, Homo sapiens
tgatacaagaattcaaaagtacctgcactacgataggccatcttttttgtcgctttcaacgcgacatctaacatctcagagcgtgtggctgcatccaggtactgactggggcttcttcaataacttttttgatgacgaactttgattagggcaggtcacgttcacccaagacaattagcatctgcctaacccatcacctaataacctggtactt

SEQ ID NO: 483697 - DNA, 118 bp, Homo sapiens
gccgcccaagatgccgaaaggaaagaaagccaaagggaaagaaggtgcgctccgggccccagtctgtcgtgaagaagcaggaggttaagaaaagtggtgaatcccctgttttagaaaa

SEQ ID NO: 483698 - DNA, 327 bp, Homo sapiens
cttcgtaccacaagtctagtctatctgctcatgagatccactttattagcctccacaagtgagaccatgtgatacttgtctatcagtagcttggtttatttcatttaacataatgacttccagttccatccatgttgctgcacatgacaggatttcattctttccttttttttttgttgtagtgggtatgtctgtagtcccagcattttgggaggccgaggcaggcggatcacacggtcatgagttcgagaccagctgggccaccatggtgaaactctgtctctacaaaaaaaatacaaaaattagaaggcgtgtggggcgataaca

SEQ ID NO: 483699 - DNA, 294 bp, Homo sapiens
  misc_feature (30)..(30): n is a, c, g, or t
  misc_feature (125)..(125): n is a, c, g, or t
  misc_feature (251)..(251): n is a, c, g, or t
  misc_feature (277)..(277): n is a, c, g, or t
  misc_feature (290)..(290): n is a, c, g, or t
ctttctctcctgttctatgttgactttatnctcagacttcattctcagactggttctaatggcaacaaagatagcctctgacagttccggatcaacttacttcttagtacttgaaacctctgaanaacagagggaccatctttccaatagttctagcaaatgctgggaagagatttgattggtccatcttggttcatgtgaccattggctgatcccagacagatacagaaccctgattagctagtctttgngttacaggcctgtactttgatgcgtnggagggtgggagncacc

SEQ ID NO: 483700 - DNA, 875 bp, Homo sapiens
gattcccctttgtcttctctatttctgtgttggtaactcattgtttgtattatattcagaacttgcattatgggtaattaaagtcctttggaacgtgctttaagtttttgaggcttttctttacccttctagtgtattggagtagaaatgcttatactgcagcatggtgttaaggaaagtgcgcacactgttttttgtttatggtattccacggaaattaagtgcacacactttgaacttcctaactgcctacttcctcagtttacttttgcattttacttatcattgggccatatatatgtgtgtgtgtgtgtgtgtgtgtgtgtgtgtgtgtctatattttatatttatatttatatatttttgagagtcagagtctcgctctgtcatccaggctggagtgcagtggtgcgatctcgactcagtgtatcctctctcttccaggttcaagcgattctcctgtactcagactcccgggtggctggagactgcaggcgtgcgccaacacatctggctaattttatatattttagtagagacgaggtttcaccgtgttggccgagctggtcttgagctcctgggctcgagatctgctgccctggctcccagagtgacgggattacgggctgtgagccactgcaaccgggccctatgtgagctttaatttagaatatttctcactaaatcactttctaacacccctcagtgtggctggcaagaacactttagacatcagatattacgcattattaaaccctaatataacatatatctaaaaatctgtacaagctgtcaaaacccatccgaattcctttcaaatattcataaactctctcatttataaaaactccctcctcaagatatataactactaa

SEQ ID NO: 483701 - DNA, 1015 bp, Homo sapiens
gttgacaccatttcgtttggtctcgcggtgaccagctaggttctagtgacctggtgcatatctagttcgatagagtagatatttgtctgtgcggagatggtaggtattcatcatcactgagaaactaggcgcactggtggcgaagctgaacgttcatgtgactagctccatgatgattaagccggggggctattacagacagtttatttgagcaggatgtcccgaaggggaaccccaatgattctaaaaattagactccagtctgtgggacagccaggagtgccaaatagcattaattacattcatttgtgttggccaacgaaaagttaaaagaaaaaaacataaagatacagagtataaaaaaacacccgacataatgtataccacaaaaacaaaaaggcagtacctagagcaaggaaagaaaccaggcacgagaaagcacgcccctggaaaaaaccaatggccctgcaaccgaggcaaaaaacagccaaaatgatggtgcaccatgcttgacacaacacgacagaggcacacgtgacaccctgaggacacacgcacgtggcccgcacagcaacttgcaacatcatagaaagggcacacgaccgaaaagtcaatcaactcaaataaagtctgggtcagaggatgagatgacacgacagccagatgagagcaccaggaatcctgcagaattgggacagataaaaggttcatgttacgccacacgaagaggttccgagcagggcctaaactacgatggcaactattttaaattccccgagaaggcattgtctggcccgttgtacacatcagttgcagaccttgacttttaaatcagtctgcccaatccggtctaacattttgagccaacagcttatgtcgtccaaaacgtaacattatggccttcattccacaggacaaaaacaccttgacgtgcgccatctgtgcttgcatgacgttgggcctatcactcgctctagattacaccacatcaccgcgtctcgcaaatgctcagcaa

SEQ ID NO: 483702 - DNA, 544 bp, Homo sapiens
gggggggtcgaggatcccaatctgcaccacagctgtatttttttttaaaggcactcaatggtagggcattttaaactcttcgggataacagagtatctttggagaaataaaaatcgaatggaccattggcaatatggggtttccctaataggtacggtctaagtaaaggtttaaatccaaacaattcttcggtccacgggaaaaatactattaaaaatacatctttctaaaaagaaattaagaaacactagggaacacctaaggtaacagaaagtagtccacgttggtaaataaccggtattttaaaatagtccttggttttaaaattttaaaaccgtgcagataaggtcattgggatgaaattataattgaaacatcaggtcactctgggtttcacagggtggcacacgttaaggtaataatgcacacaaggtttaataagggcctaattcataacaggggctgggaaagttctaacctcagtcagaatgacccttggaggtgttaatacgggtgtaaggtggtattggtcaccctcgtttac

SEQ ID NO: 483703 - DNA, 290 bp, Homo sapiens
ggcggactctagctccatagccccgatcttctatgcctccatagtttccttttctggaatgtcatatagttgaagtcatgcagtatgtagcctgttcagatggcttctttcacttagtaatatgcactttagtttcctccatgccttttcttgacttgatagttcatttctttttagtgctaaatcatattccatcatctgggtataccatggtttatccattcacctattcaagggtatcttggttgcttccaagtcctgtgctcttttaagatttcagtttttgaccc

SEQ ID NO: 483704 - DNA, 198 bp, Homo sapiens
gggaagaggctgacatgcagaccgagcggcctactcaaaagcagccttccatctccataactaagatgtggttccctgccgggagatactttcaaggagatgcttcctcggactacaagatcaacggtctgggcttcaagacacctaaggaggcgattgagggcacccacactgacaagatatgcccctcacagtaaa

SEQ ID NO: 483705 - DNA, 237 bp, Homo sapiens
agcttagaggatccccacggcaggttctaagggaagcgggaaggtgggggctgtggacacagtggtggcgggcgctgctctcatggcttcttttctcccttgtgtgctggtgggctagtagctgaggccggcggcctctcccccgggagcaggcagatgactttggcaaggggtggtgtggcgggtgctggggttactccgtctgggcgtcgtaattggctccccccgctaaactcg

SEQ ID NO: 483706 - DNA, 436 bp, Homo sapiens
ttggggctcattcaggcgtggtgaccttggcaaggtatcaggtgaagaaggcaggcacatggtatggctggtagataaataggatcaaggacaggaatataggatataaaccttttggctaggtctaaaccatccttaactatgccaggagtctctcactatcttaaggaggtagggtcatcatttaaatttttgaatggtagtatgcatcttgcaggggggtcttcaatataggtcaggggggatcatgtaaggtgggaaaaacgggtaaagacactttagtggggggtctacttttacaatttatacttttcttctcctttcctccttctacaaagattatgtccagcagtatgcatcttccggactggcagattctagccggctataaaattaggacaccagacaccgcacatatggctagaatggcggggta

SEQ ID NO: 483707 - DNA, 153 bp, Homo sapiens
tggcgcggcaatacagctatacatcactggcctgtcgttaacacttaatcatgctataccactcacctggccgtcgtttacacaaacagctatacatgcactggcctgtcgtttacagataactagctataccatgctactggctggcgttgg

SEQ ID NO: 483708 - DNA, 767 bp, Homo sapiens
gaccgcgagaccgcgtccgccccggagcacagagcctcgcctttgccgatccgccgcccgtccacacccgccgccagcttcaccatggatgatgatatcgccgcgctcgtcgtcgacaacggcttccggcatgtgcaaggccggttcgcgggcgagatgccccccgcggccgtcttcccctccatcggtggggcgccccaggccaccaggccgtgatggtgggcatgggtcagaagggattcctatgtgggcgacgaggcccaagaagcaagagaggggcatcctcaccctgaaagtacccccattcgagcacgggaatcgtccaccaaatgtgggacgacactggagaaaaattctggcaccacacctttctacaatgagctgcgttgtggtcccggggggagcacccccgtgttggtgacggaggcccccccttgaaccccagggccaaccgcggagaagatgccccaagatcattgttgggaggacctttcaaacgacctcgagcagtgtacggtggcttaatccaagggctggtggttatcccttgtagggcctctcgtgccgtaccaactgggcattcgtgatgggccttccggtggacggtgttccccccacattggtgccaatcttagaaggggttaatggctttcccccatggcagttctgccgtctgggcactgggttgggccggcgacttgatggtctacctcagtgaggtcctcaccgagcggggtacgggttccacaacacggcgcgggcgaatg

SEQ ID NO: 483709 - DNA, 259 bp, Homo sapiens
aacaggagtcaactcccagcagagacagagatatgggacctttcagaaagagagcttacaactagctgtttacgaggaacactcacaacttcaaggtaacacagcaggaggaactcacgaatattatcagcatacatttagacaaagcgaattgacagtaagttaacgagaatcagagcagcaaattctcgcagctgctagaatgcacattgagcgtactgaagcaatgcgtcagagctctgttagatagcagcacact

SEQ ID NO: 483710 - DNA, 1345 bp, Homo sapiens
  misc_feature (835)..(835): n is a, c, g, or t
cttaggggagagagaaagatatatatcttttgtttactaatagggggggggggctattcatgcgcgttatgtgtggttgtctgccgcaccgaacaagatagtatgtttgcccaccaaccatgattaataaataattatgggggggtctagaaggagaatttttggaaggaggcgaagaatattattttctagttttattgcgtcgccggataatgagggcctcgcccacaaaaaaaggaggttgtggtagtagaggaggggggaggagctgcttataataatattataggtggttataaccgcccctccaccacatgatttgtgcggcctgtgtgagaggaagaggcgagaagatctggttgagagaagatgagagcggtgggtataatgacgtattgcgccccacagagagatgttgtgctgatatgatgtatgacatataaagaggggcgctttatattatatttttgtcggggtgaaaacacacaacatgtttgttcgtcatagaatatatgtggtgtatgagacctctgcacacagcagcggagatagtgtggtcacactctgctgtttgggacgacacactactatagtagtggtgtgtaaaaaaaagtgggtgaagtagaaagaacgcctcacacagtgtgctctctactacacatatagagagtacatagagagagtggagtagtcctgtaaatagtgtgtcgtcacgacgcacactaggatgatagatactctatacacacactactcttctctctgtgagaaatattgtttctctccacagacgcacgtctccacagagagagaatatacactactcactagtgtnttagacccacagcagagtcccaccagcgagaggagaataaataatagagaaatataaagtatgtgtgtgttgtgagaagagatatctctcttgtgagagtgtgtgagagtgggtgacgacacatatctctcgctcttataatactgctgtcgcacacaccctgtgtggggtctacaccacgggtgtgtatatatagtggtgtgtgtgagagacacatgtgtccgacatatatatgtgtgtgcgtataagaatatacatggcacacatttgagatggcttgttttctgtttttgttgtgtgacacacgcgtataggtatgtgttgtgtaaagtggggtttgtggagaaataaaatatcctgtatattaaaaatatatggccaatttcccacaaaatcccttttatatgggaaaccacattttttttaaaagaggagaaggaacacccaaatccacacacagagagggactgggggctgggcctttatttaaaaaaaatttgaaaaaacgga

SEQ ID NO: 483711 - DNA, 722 bp, Homo sapiens
  misc_feature (13)..(13): n is a, c, g, or t
  misc_feature (88)..(88): n is a, c, g, or t
  misc_feature (205)..(205): n is a, c, g, or t
  misc_feature (231)..(231): n is a, c, g, or t
  misc_feature (285)..(285): n is a, c, g, or t
  misc_feature (411)..(411): n is a, c, g, or t
  misc_feature (516)..(516): n is a, c, g, or t
  misc_feature (705)..(705): n is a, c, g, or t
aagctcaccgtcntacgaatggctgttgagaggagcaataggaataaacattgtaaaagttgttgcgaccattataattgttgtcacnacgataatactgggtataagtggcgccatacccgttggggaaatagcagctggactaacagggcacggaataatggacgccaaagacgtcgctgacattggtactgtagctgtactngagggtggtaaggaggatgaactacnatattggatacgaatagctggtgctggaatgggaggggacgctggaatagacgnattgacgagacctgaccagataataaaaggctgggtcaaggagaaagactgataaaacaggccgagcgggatacgagggaaattatagcaagggtcgttgctggtggaaggttaaaggccacggtngatacgggtactgaaacggaataggccgcgataacgtaacacgacgggtgagggatgaaaggtacgtacatgcattactgtaactatagggctaatgactgttanactcattgtcggtggatgaacatgacatgatgtggcggataaggaacaacggcggtaatgacagtgacgaatgggaacgggaaagacgaccgactcggagtggtacggacgagactatggtggactcccccgggctggcgggtggggtgtgaaaccgccaactaatattatgcgcatggacaagaccgnctaaaccgtataacatg

SEQ ID NO: 483712 - DNA, 316 bp, Homo sapiens
acatttaagagtggactggctgtgtctaagaggctacaatcaaatgcaagagcacaggaatgacttaaagttggaacttacattttaaagggaggcagagcataaacatttggaaaattcacagcctggccatgtggtagagaaggaaagccccctctttttgttgttttttgttttaaagacagggtcttgctctgttacccaggctggatcttggctcactgcagccttaaccttctggactcatgtgttcttcctaccttagcctcccaagtagctgggaccacgggcatatgccaccacacctggctaactt

SEQ ID NO: 483713 - DNA, 302 bp, Homo sapiens
gggggggaaattttttccccccccttttttttttaactggaaactttggggggaggggtttccagggggggccccggttctttttccgttaattaagggagccctgaataaaaacccccttttttgggggaaaaaatttttccgggacgccaatggcccccccccccgggtttttttttttgggggggccccctgttttcccccccccctgggtttggggttctgttttcccctcccccccaaaaacccctgttgttttttcttgggaaggggagggttttttattttattttttccggtta

SEQ ID NO: 483714 - DNA, 373 bp, Homo sapiens
  misc_feature (16)..(16): n is a, c, g, or t
  misc_feature (34)..(34): n is a, c, g, or t
  misc_feature (86)..(86): n is a, c, g, or t
gggaagccagaaggtngggaagaatggctttcanccccaggaagttggagacccagccttggggcaaccatagtgagacccccatnctctacaaaaaatcggaatattagctgggccatggcggccgtatgccctgtagtcccagcttaacgggaggctagggcagggagaatcatttgagcccagaaagtcgaggctgcagtgagctgtgattataccactgcactggatgacagagtgagactctgtctcaaaaaaaaaaaaagaaaaaggaaagcagaccctctccatggctttgggtttttgtttgtttgttttgtgtgtctgtttgttttagacagagtctcgctctgtcacccaggctggagtgcag

SEQ ID NO: 483715 - DNA, 100 bp, Homo sapiens
catttctgttaaggccatctatggatcacatctacctctgaaagtacaactaggaatacaacacacctagcaagtctctgtactgatagcgctagctcat

SEQ ID NO: 483716 - DNA, 310 bp, Homo sapiens
aggtcttttcccctcaaatcaaggctttcattcgaatgtctgcaccagagcttccccttcagaggtcgttgcattgctaagtcccatagcccctcccacttcttatcctacttggcctgtttcacgctgccatcccctatacttgtccccttctcctgtgacttcactttcttcagtggctccaggctgctgcattcgtctcttttccttctacatgggtcgtagaaggaaactaccaagtgggactgttgctgagccctgaagctcagtctttgagaccctctcctctccagctgcgtttcacttccga

SEQ ID NO: 483717 - DNA, 263 bp, Homo sapiens
ggcagcgctgcgatcctcagtcaagacaattggggctgaggtttgttccccgagcacagtttccctttgcagaatgcagctcctagaagggcgttttgtgccgtttcggagctaggccctaggtgggtccctccgtagctggctatgggtgggttgctagggccagtgcacccagggcttcttcaggccaaatcagccttctccacgaaggagaagacgcttagatttggttcaagctgcggagaccaccaggcaagcagcag

SEQ ID NO: 483718 - DNA, 995 bp, Homo sapiens
ctgtgagtggtcagtggacccccgtagccccgtgcgggcacccccgtggccatggctcagtggagcagctgctagaaggagggcgatgagtctgttcaaatgtggagactacggtggtgcgccctggcggctacactcaggccctgggtctggacgcgacgccccagtgaccaggccgttctgcaccggaaccgggccgcctgccatctcaagctggaagattacgacgaagcagaaaccagaggcatcaaaagctacctcaacttttctgaggctgaaagcaacgaggcccacattcgttccccccaacctttcttcttgggccttttcctcgagatcttttcccctacgtgcgtccttggcgcttggaggaccggtgggcctccactgggggtgcgtgacacagggccggtcccttgggttttggggcgtccacgagcccattttgacaacgggcgtgggtgggggcgtgtgtaaagccacttcctataccgggggcggagaagcacagaggccctatagaaaaaagagctggggggccgagcgcttgtgaaccccaacggcgttgtggcccttttgagaaccttgtggcgaagaagattgtttgttgtgagacgctttgggagacgccccaagagaacccacaaaggttttttcaccccgggagacggcgcccttttgggcgcgggaaaccacattgtcgcggtggtggtggcgccccacggggagaatttccccacgggggccagacagacgggcggtgccggaaagttaccgtctgggttctccctccgtgaaccgcgggagaattgtcccccacacagggttgtgtgcacccacccgacaatggtttttccacagaagattatccgtgtggttgtgtggagaacccccccaggaaaagtacagagcaccgcgtggcgcacaccttgtggtggtgaaaacaacagcaagggccagaagaagcgcggcgtgttcttctacagggaaaaacc

SEQ ID NO: 483719 - DNA, 372 bp, Homo sapiens
agcagagtaatacttcgatggcagtaaacggtggacacaagcgaaatggtcaacggacgctacagaacaatggacgagctctaaagagtccagccccatcctctgcccgacctctgaacgtaaagccaagactgcccttgcagcccagagagccgtcaccttaccaggcagaacccacgagacaccttcggtccagatggaaggctttctcaatcggaaacacgagtgggaggcccacaataagagagcctcaagcatgttctggcacaatgtttattgcgtcataaataaccaagaaatgggtttctacagagatgcacagactgctgatactggaattacgtaccacagcgaggtccgtgtggtttgggt

SEQ ID NO: 483720 - DNA, 352 bp, Homo sapiens
  misc_feature (53)..(53): n is a, c, g, or t
ctcggccccattttctgcttctgaaaggctgaggcagaattactcaaacaggnagacagacagaggttgcagtgagccgagatgcaccactgcactccagcctgggcgacagagtgagactctgtcttaaaaaaaaaaaaaaaaaaaaaaatttaaaacaaaatttttcttctgatttaaagtctggtaattaaaattttggtttccctccctttcagtatgatcagttggcttcaatttatttctagggatatgcagattctttcagaaaagctttggacttactatgtcacccagggatgagcttctgggggatgttttatttctggtttcaaggaacgcgggaacgggg

SEQ ID NO: 483721 - DNA, 384 bp, Homo sapiens
tcatatacgactgagttggtaccggaacattcgtagtctgagccctaggatttgaagactgcagtctccagtgaggccaccacgcctgtcagcgtgcagcacatgcgccctgccatagatgaagaggcgcaagagagttctgcccgttcctcgctctgccgatcgtggtgcaggtcatggagatgggatttcccatgaaggaacatcgaatttgccctgaagtctctcactggtgcttccgggaatgcgtccggcttgcctggtgtggaatccttggccggaaggctgctggaccactccgacatacaggtcacggagctctcagatgcagacacggtgtccgacgagtattctgacgaggaggtggtggaggacacgaatgtt

SEQ ID NO: 483722 - DNA, 791 bp, Homo sapiens
  misc_feature (125)..(125): n is a, c, g, or t
  misc_feature (138)..(138): n is a, c, g, or t
  misc_feature (151)..(151): n is a, c, g, or t
  misc_feature (154)..(154): n is a, c, g, or t
  misc_feature (330)..(330): n is a, c, g, or t
  misc_feature (340)..(340): n is a, c, g, or t
  misc_feature (369)..(373): n is a, c, g, or t
  misc_feature (375)..(376): n is a, c, g, or t
  misc_feature (378)..(378): n is a, c, g, or t
  misc_feature (380)..(380): n is a, c, g, or t
  misc_feature (384)..(384): n is a, c, g, or t
  misc_feature (391)..(391): n is a, c, g, or t
  misc_feature (394)..(394): n is a, c, g, or t
  misc_feature (401)..(401): n is a, c, g, or t
  misc_feature (407)..(407): n is a, c, g, or t
  misc_feature (412)..(412): n is a, c, g, or t
  misc_feature (415)..(415): n is a, c, g, or t
  misc_feature (425)..(425): n is a, c, g, or t
  misc_feature (437)..(437): n is a, c, g, or t
  misc_feature (442)..(442): n is a, c, g, or t
  misc_feature (455)..(455): n is a, c, g, or t
  misc_feature (472)..(475): n is a, c, g, or t
  misc_feature (488)..(488): n is a, c, g, or t
  misc_feature (504)..(504): n is a, c, g, or t
  misc_feature (555)..(555): n is a, c, g, or t
  misc_feature (578)..(579): n is a, c, g, or t
  misc_feature (588)..(588): n is a, c, g, or t
  misc_feature (591)..(591): n is a, c, g, or t
  misc_feature (603)..(603): n is a, c, g, or t
  misc_feature (606)..(606): n is a, c, g, or t
  misc_feature (634)..(634): n is a, c, g, or t
  misc_feature (654)..(654): n is a, c, g, or t
  misc_feature (783)..(783): n is a, c, g, or t
ccttttttttttttcttggtaaatagtagaatttcatacaaatataaagtttggcaccttcaaagctatcactccaataagacacttattcaattaaacaaataatcttaaactattttaacaangtacaaatatatncacaacataatcngcngattaagacttcaacaaagtttataatacctacaacagaatttacagatgcctacaatagtttgtagattggtttaatttacagttacatagattgctttaagaaataccattaatacaaatgcataatttacaatatccccattatagcaagaaaaaaatagattcagaaaatanaatgtctttnaggcatttattagtgccaagtgtgtgagnnnnngnncncnttanggcatgngantaatgcncttttngtggnganagatctattngctcaagggccnctgangagctttcaatcnagctatcctttctgtgnnnnaaatggaacagcngcgatctctgggtatnccttaaactatgatgattccgcttatattaactgggccttaagtagatganttcttacaaacaaaaataaaatnntagaaaggngtnaataccactggnccnaattgtgttcacttgcgtgcatacgtcnaagagatttccccacgaagncaatattaaaaactaacaattatttctaacttatacataagccaaagtgctcactcttaccatagaagcaaaactttctcctgaaaacaatctacagaaataatatgtaaacatatagagctttgaganagactaag

SEQ ID NO: 483723 - DNA, 84 bp, Homo sapiens
aattcaagcatctaacgatgtacggggacatgaagaaaactgtgtttcatttaaagatgttaattaaatgattgaaacttaaaa

SEQ ID NO: 483724 - DNA, 203 bp, Homo sapiens
catctagaggatctacacgtacgccttcacgtacgctctatgataacattcttcttcatttacaagaatactatttttcatttatcattgatatacacagctatgctttaaaaaagataatcgccatttccctacattacttttaccacataatgaggtctagtaatctgtcactctataaaaagccagtgtcgggcgggcac

SEQ ID NO: 483725 - DNA, 349 bp, Homo sapiens
gctgccagtcataggcccgtgccctgtaggaaggcagaatgtaactgttctgtttgtttgacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcacccctgggctgtagcccggagccaaaatattttcccgcctccccctttcatagctgaggttttttctgaactatgtaaatgactctactaaaagtttagggaaaaaaaacaggaggagtatgacacacacagca

SEQ ID NO: 483726 - DNA, 427 bp, Homo sapiens
  misc_feature (1)..(1): n is a, c, g, or t
  misc_feature (167)..(167): n is a, c, g, or t
ntctagaggatcccaccgtaatatgtaccatactctttacacacatttgtgtgtatattggagattctttactaaaaaagcagaagttaaaaagaaagtgtggtggcacatgtagccccagctactcgggagacttgagatgggaggatcgcttgagcccaggagtntgaggctgcagtgagccatgaccctgcctgtgactagcactacactaagcctgggcgacacgcgaagaaaccaccgctttaaaaaacgaaaaggaagaaaagaacttgtggaattccagttatctataatgcttccagctcctcagcctcttaactctcgccaaaccctcagcctttgcttttcaaaatactgcatttgctatctactgtctcacagaaatgcagaccttttgcctgaatttcacacttgctgttctccc

SEQ ID NO: 483727 - DNA, 105 bp, Homo sapiens
attgcttgggcagtgtgatgttcgctattgcgctaggaggtgttgctgcgacgttcagtggaagtcttgccgaactgcctagcgagcgtctcaatccggtcgtgg

SEQ ID NO: 483728 - DNA, 605 bp, Homo sapiens
  misc_feature (182)..(182): n is a, c, g, or t
cgaggggcaggagatattccggctcgccggtgaggaggctgaccacggtgcggcgctcgaacagcccgcgggtgttgccctcgcggacgaaggcggtgaggtcagcgccgaagagcacgttgaagatgccgtccggccggctctgggcgagcgcgccgacggtggcgccggcatcgacgcgnccgagggccgggaactgctcggcgaccacctcgaatcccggcaccgccgcgcccatcaggcgcttgaaggcggcgaccgccgactggccgtactcgtagttgggcgccacgacggcccagcgcttcacgcccttccccttggcggcatcgaccagcatcttggtctgcatgtaggtgccggggcggacgcggaacgtgtaggggttgccgctgcccatggtgagcgcgtctgtgagcggctcggtggcgagatagagcaccttcttctggttggcgaagtcggcgagcgcgaggcccacattcgacaggaaggcgccggcgatgaaggagacgttctcgcgggtgacgagctcctcggcgacgcgcaccgcgtcaccgggggtcgagccgtcgtcgcggaagacgatttcgagcgggcggccg

SEQ ID NO: 483729 - DNA, 593 bp, Homo sapiens
agggcctccctggcttgggagaccgctctctgcaagggagggggagagaggcacagggagagagaaggtgacacggatggaagagtgggaaggagctggcctggctcaaccctaggctgtccctgcaggcagggtgtccgggggctggccagtcagagaaagggggccatggactggtgtggcaaatagggagacacggagacagaccctgcagtcctactacaggctggagtggggtcctaagaagaagggtcccacctcaacccctgtcagtgtccactgtggggtgggggctgacccctggctttgagtggcattctcctgggaaggccagtcttagtcccttccccaacactgtgcacactggcccttcccactgtgtatttattggacggatctaaggtattctccccagacagagcccgagctcctgcttcctgtggaggcgtatggccctgagctgtgctctatatattatatctgcgaataaatcacatattatattatatttaggggccggagagcgacaacacgagttcaagggagggggatcgcttgagtccaagagtttgagaccagcctgtaccttgggg

SEQ ID NO: 483730 - DNA, 256 bp, Homo sapiens
ccccccccccccccccttttggcccccccgggggggggggggacccccttttttttgggttttccccccccccctttttggggttttctttctcagaaccccccggttttttgtttataatttggcgcggggggtgaaacccccccccccccgggccccttttttttttttttttttttgggtttttttttgaaaaaaaaaaccgggggggcccccccttcccttggggcccaaaaaggggtttttttttttttta

SEQ ID NO: 483731 - DNA, 626 bp, Homo sapiens
cgatgctatgtaagacatagtaaatcttgaccattggtaatcatagcctgatcgtatgcataatcaatagtataaaggaaatattggacttgatgcgaaattaaaaggctctgtgattaagttaccgaagggattttggtggaggggagcactgtgtatatgctggaatatgaagtctgagaccttccggtgctgggaacacacaagagtggtagaaagttgacaacgcagacatggcatgtctctgagtgcttagtgatcattgcttgagacaatcaggctcggtcacgtggacaataaacagtattatcagagagaaaatgtagaaataataagtatcataaaacaggattagtcgccccgcgccggtgggcctgaaaagagatttaagaaccagaggcttggggaacagcgagctccaaagcagtatcaaggagtgggccaagacacagggtgctcaagaactcctgcacctcctgagcagcgaggaatggcccgaagaaagaaaccgcgcgggcgcatacgcgcggggcctggaaaaaggtgcaagacagggacgtgagggaaggagtgctaattgacaggggagaccagcagagtcaggaaacattacgccggccccgggt

SEQ ID NO: 483732 - DNA, 161 bp, Homo sapiens
cagagcgtagggaggtaggggttcttccagctgcaccggctgctgccaggtgagttggcctggctttgtgcggaacagactatccgtcagtgggtgtgattgatggcaacttccaggccatgtcctgcttgattgttggagtgcattgcccttgagtgtga

SEQ ID NO: 483733 - DNA, 1246 bp, Homo sapiens
gtgtttgtctacttcctcctgcttccccggcgcgcctggcgatcgacgtacatcatgatgaggaaatcagtgcacttgcatggccagggtcgagctgcggcaaccaaagtcggcagccaagtttatggtgagtgtgatcagacgagtgagcacgagcattctgactccctagcgggtcatctaccacggggacagcgatcctgtcagctggaacgcatcaacgtgtactacaatgaggacaacgggcaggcaagtacgtgccccggcctgtgctcgtggatctggagcccggcagcatggactccgtgcgctcggggcccttcgggacagatcttccggccggaacaacttcgttctatcggtcagagtgagttggctgggaaacaacctgtggaccaatggggcactagcacagaacggcgcggagctggtggactcggtgctggatgtcgtgaggaacagggaggcttcatgagtctgctgactgaccttggctgggctctgccagactgaacccactacccatggggtgcggggggacgtgtcgatctgtggatgcgtgtacccctactccctgaggcctatcactggagatcggaggtacggcaagaagaagggattcgtggactcaacatacacagggtataggccttcaaccctaaggtgtgtaaccacaaagggatggatgttaccaacttaaggacaaagaatccgatcgagagttcctaacagggacgataaacagcagggcaggaccagaacaggctaaccgctcaaacgaattaaccgagaatagcatcgaacagacgatggggcctaccagaaaatccgtcagcaaggagacgacgacccacctaagggcaaccacgaaggcccaatgcggggacgtgcaaccaagcacagggagtcacaggcaagaagacgggggcattccaaggacagacaaaagaccaacctgacaagaaaggcgggggaacccaaggcccatgagtcacggcataggcttgtacaagccaggagtgtgacccacaacggacgggaacagtagaaacggagggacaacacaacgagaagaccagacagattaaggacaaaaatctggcagagaacccagagacagataaacacagtagtcacgccaacaggcaaaatgatcgacaaccaaccaagcaagaccgagtgatccttccactacagaagtagaagacaaaaaggaatcgcgacggtgcagagacaagacaaacaa

SEQ ID NO: 483734 - DNA, 166 bp, Homo sapiens
gggcttgaccaccagggagttctccaggcctagggcaggagagaggcctggcaccctggcgtgggtgcccgccaaacgccctgcgaccgctcagaagcacaaatgctgtccatggccgtgagtgtcctgccaggtgaatgacatagcgtagaagcgtaaggccagg

SEQ ID NO: 483735 - DNA, 841 bp, Homo sapiens
ggaagctccggaggcattcggtgagcgctccctggagtcccatgcgctccctttggtgtcggtgttgacttggctgcgcaggctctgtcggggggagctttacccactaggtccttcaagtggtgatccaggcctcctatgcccggccgggctccagaggtacgtggtggcaggagtgggctggacgactgtccccatggcatcgcacttccagcggtgtgttagagccgtgtgggtgagtctactggacgtcctagtagcacgtgaggtctaggtcctgattcatcctctggattagagaagtattcggccaagatactcaaaggaacaaggaagagtctgttaagtgggactcagtaaacaagttggcggcacggaacgggtggttgagatatccaggtcccctaaaactaggaagctaacccttcgttgctatatcttactgacaaagaaactctctctgttggacctggtggagcagcgcgcgatgcggtgggtcaacacctgtaactccctgcgatcgtttgggagggtcacaggtgagaggatcgtatgaggccagggagtgccaagactagcctgggcaacactagggagaccttgtgtctactgtcaaagacattcgctgggcatgtgggcttggacctgtgtgtcctggctacttggggcgctgatgcagaggatctcgagcccaggagttggaaggctgcattggggctcgatcgccccactgtactccagctggtgtgggtgcgcgagaccctgtgaccaggctggggtgccgaggctcttggggtgtcgttagggctggacctgcgggggcttggaacggcctagtcgc

SEQ ID NO: 483736 - DNA, 148 bp, Homo sapiens
ttacgcatactcactattattttctgtataaacaccctatgttgtagccacaggtggagcctgagtccgctgcacggagactcgggtgtgggtctggacgagggggtcagtgaactcctgatagggagaacttggtgaattacagtct

SEQ ID NO: 483737 - DNA, 783 bp, Homo sapiens
  misc_feature (520)..(520): n is a, c, g, or t
cgggctgagccagacagcaggctccaggctccaccgccccagtgatttccaggctctctggctgaggctgcctgcctggaggggacatcagggaagaggcttccggaggaggggatgggagaaagtaggggatgtggcttgagctgcattcacaggccttggctggaccagggatggcccccatctcccatgagggcccactgaccctacaactccaaccttctccatacttcaacaaataatgagttatggcaatgagggaagagagaccctctcatattattttatactcattacctgttttaataaaaaacaacaatgaattaaaaccaaatacaggcatgcaacctgacactaggcccaaaaccagacctacacctgcctagcctaaacccattatttaaaaatcaattcataacttataaacctatattattcatatattccacacattgtatacaataacatttcttaaactcgctaccatattctattgctctctaactcccaatacatacanccgctatcacttaccacctacttactcaaatcaactactatcctgtcatgttaaatcttcatattattatcccttacaaagtacataaattatcactttgcgaactacactttaatgcatcacttaccaatactcccacctaataaactcttgcttctacaaataacaaacacataacttcatgagggacccactacccaattcccctatactccttatacattcacttacctctttgcatctacttacctacgttcccactt

SEQ ID NO: 483738 - DNA, 283 bp, Homo sapiens
ggagaggaaggatgtgagctgttgctggcgtgttaaagccctggaacagatagtcgggagacggggttcatgtcccagatggtactagcttggggaaaattttgacaaatcagttgctctctctgggtctctgcttcctcatctggaaactaaaaagattgagctacaactgaaagagtcgagtgtttctcaaaatgagggtcgtttatttctgctatgctttctgaaagctaaaggaagcccccaaaatacaaaattagccagccgtggtggtgtgcgcctg

SEQ ID NO: 483739 - DNA, 459 bp, Homo sapiens
tcggatggatgtctctgtcagagaaaaatgcataaaggcttaaattgaggcattaacagaagcagattaacctcagaaatgctgtctggctggcagatttcaagtaaaaaaaaaaaacaaaggtgggttggggggacctttttctttctagttgtcttaaaggaaaattaattttactttttttttggttctggccgaaatttttatgagatatctcccacttgtctaccattttgacccggtaaaagctcatagctgtaagatctgaatagaggaggggagaagcccctgggtcttactatgaaaggaatccgctgattgagggctgcctccctcatggtgtgcgtgtggtaactctacctgacgcatctggtgatatcagaggtaaatatgcaaagaatccaggcggtactaaatgtgaagcattacacccagaagagtcccggtgccctctgtccc

SEQ ID NO: 483740 - DNA, 570 bp, Homo sapiens
cgctctgcatacataccgcaggcctggaatgaaccacaccatggcacggatgcaggtgccgtagatctgtgtgagggaggcggggcccggataatccacgtacacgacaggcacgtggcgcaggaccctgtgtgagaggggcttacttccagggtctgtggagggattacaagccccaacaaactggcttctctccagctacacccatgttagatctgaggtacggtaaaagcctccgagctccaccatctgtctgatgaaggatatgaccctctgggtcccatatatatccatatctggcaagttgatttcatcacagaacaacaccagccactttccaagttgaacaggagccaacaccaccccattaggtgtgcgcctgtactcgcagtagtgatcaaaagtcttcagaagcagctctggagtagtagcactggaaaagttgagacccaccacctccatgtcaggcaacgcccgaagggcgctgacgagtgtcatggtcttgccagaccaacgagggccacacaagaccaggggcttgtgtacggccagccaagtatacaagagggc

SEQ ID NO: 483741 - DNA, 130 bp, Homo sapiens
ttgtcctctactctggggcatgagcgcctgccctgctcataggagggaagcccatcatcacaccagcagtctggcatcaccctgccacagattctcctcgaagcccggcccaggtcccaggcctcagggg

SEQ ID NO: 483742 - DNA, 1131 bp, Homo sapiens
gctcgcctcagcgctgcggggaacgcgcgcgccgccgtccgcggtcgcccgtaggtgcctgcacgcgtcggggtcgcggcctttggccgaccggggcaagaagactgaggagccgccccgcgacttcgatccggcgctgctggagttcctggtgtgcccgctctccaagaagccgctcagatatgaagcatcaacaaacgaattgattaactgaacagttgggcaatagcttatccaatcattgatgggatccctaatatgataccacaggcagctaggcatgacacgtcacacagtaagaagcacgaagaagtggagcagcgctagttcatcacttcaacacacacaattacccaaaacgcaacagccaacttttcttaataccatataccttttaaaacacagtggcaggtaataagtgcgcacacagaacgaaggtcgctgctctcttcctaccgttgcactgttcttattccactggttctctttagcagcgactgttctactacacgcctctgtggaccgaccacttcccacagggcctgcactagcacagccagcctttggcttttacagcctgactcttgcctatttcaccatacccagtgtctgtatatccttccaccctttggaacctgagactgcgcgtactttcaaccgcttccagaggcactaatcgcacagcccacctagaagtccacacactgctcgcctaatctccaccggcaacgccccgagcacatcgacatctccaaaacgcacacggccatggccaccaccacatcagcgcgcgccaccacagccatcgccacggccacaaacagggcaacacaacgcggggcgagaacaacacatctcaacccatatcagtctacccaacctcggtcaccctcgggtcatgcagcacaactgctactatcaagcagagactacaccctacatacctaccgacagcacacacgagcaggccactctccgtaccaccaccatcacgaccacccaccaactcactctctcccctatcagacctcgctcaacgatcgatcatgttctacccccgtccacaatagcctgcaccaacaacactcacatatcacgatcagtcctactcacacacatcacatgtcccgg

SEQ ID NO: 483743 - DNA, 811 bp, Homo sapiens
  misc_feature (1)..(1): n is a, c, g, or t
  misc_feature (89)..(89): n is a, c, g, or t
  misc_feature (105)..(105): n is a, c, g, or t
  misc_feature (139)..(139): n is a, c, g, or t
  misc_feature (147)..(147): n is a, c, g, or t
  misc_feature (177)..(177): n is a, c, g, or t
  misc_feature (193)..(193): n is a, c, g, or t
  misc_feature (212)..(212): n is a, c, g, or t
  misc_feature (233)..(233): n is a, c, g, or t
  misc_feature (336)..(336): n is a, c, g, or t
  misc_feature (414)..(414): n is a, c, g, or t
  misc_feature (425)..(425): n is a, c, g, or t
  misc_feature (560)..(560): n is a, c, g, or t
  misc_feature (565)..(565): n is a, c, g, or t
  misc_feature (640)..(640): n is a, c, g, or t
  misc_feature (647)..(647): n is a, c, g, or t
  misc_feature (655)..(655): n is a, c, g, or t
  misc_feature (657)..(657): n is a, c, g, or t
  misc_feature (718)..(718): n is a, c, g, or t
  misc_feature (724)..(724): n is a, c, g, or t
  misc_feature (740)..(740): n is a, c, g, or t
  misc_feature (747)..(747): n is a, c, g, or t
  misc_feature (810)..(810): n is a, c, g, or t
ngtctggttaacttgaactagataaagctgcaaaaattggtttggagaacatggcagggccatggagaagggctaatagaagcaggtcncttgcccagaccctcngggagcccttttggtggatagcggtacacctgangcaggagntggcaggggccaagtccaggcatggcagcngcagggctgcaactgnaagcggaggctggtgaggnagcgctcggccctaacctgancctgcaggtctcaggccctggggtcgatatactctgccccatgaagacaggtgaacttgtgtctgtcttggtgcccagagcacgaagaggaagggctgctgcncgtgcaaagaccagcagggtgcgtggccacaggagatggcggaggctgcagccgcctccaccccagtctctgtgagtnccagcactgtntggtgctgcatcgcagaaacctgtaagatctgggtcctctgttagcccacacaggttaaggtcatgaagaaaaatcgaagaattccaatttctccatgactgagagcatatcctggctggtcgtcactatgatgnggggnagtgttaggagagtgggctggaacttggacatctccagtttctccatgatgtgccttgaaaacagaagggctgantagcctntttccatntnttcaagacgatgtttcaggttctggggtacaggatcaccaaactcagattgtgggagagcngcagcngccccaccttggcttncaaagtntggtcaatgaaatgggccacagggtacttcttgctattcatcaggggcacttttataactgant

SEQ ID NO: 483744 - DNA, 137 bp, Homo sapiens
tagctagttaacttcgactatgctaaggttatcactgctgtttccgtggggtgtggctaggctaagcgttgagctgcattgtgcgtgcttgactgcttgtccctttttgatcgtggtgatttagaggggtaccgagc

SEQ ID NO: 483745 - DNA, 134 bp, Homo sapiens
  misc_feature (40)..(40): n is a, c, g, or t
  misc_feature (63)..(63): n is a, c, g, or t
  misc_feature (76)..(76): n is a, c, g, or t
  misc_feature (83)..(83): n is a, c, g, or t
  misc_feature (89)..(89): n is a, c, g, or t
  misc_feature (93)..(93): n is a, c, g, or t
  misc_feature (105)..(105): n is a, c, g, or t
  misc_feature (108)..(108): n is a, c, g, or t
  misc_feature (112)..(112): n is a, c, g, or t
  misc_feature (115)..(115): n is a, c, g, or t
  misc_feature (120)..(120): n is a, c, g, or t
  misc_feature (123)..(123): n is a, c, g, or t
aatgctgtaccacgatcacaggtcggacataaaaaacaancaaaacaacaaaacccccaatgntcctagcaatttnagaagantaactnaagnattaagaatccnganctancanaagantanaaggttgcttg

SEQ ID NO: 483746 - DNA, 891 bp, Homo sapiens
  misc_feature (1)..(1): n is a, c, g, or t
  misc_feature (69)..(69): n is a, c, g, or t
  misc_feature (87)..(87): n is a, c, g, or t
  misc_feature (149)..(149): n is a, c, g, or t
  misc_feature (186)..(188): n is a, c, g, or t
  misc_feature (288)..(288): n is a, c, g, or t
  misc_feature (312)..(312): n is a, c, g, or t
  misc_feature (365)..(365): n is a, c, g, or t
  misc_feature (390)..(390): n is a, c, g, or t
  misc_feature (392)..(392): n is a, c, g, or t
  misc_feature (410)..(410): n is a, c, g, or t
  misc_feature (421)..(421): n is a, c, g, or t
  misc_feature (447)..(447): n is a, c, g, or t
  misc_feature (453)..(453): n is a, c, g, or t
  misc_feature (471)..(471): n is a, c, g, or t
  misc_feature (486)..(486): n is a, c, g, or t
  misc_feature (491)..(491): n is a, c, g, or t
  misc_feature (500)..(500): n is a, c, g, or t
  misc_feature (541)..(541): n is a, c, g, or t
  misc_feature (551)..(551): n is a, c, g, or t
  misc_feature (574)..(574): n is a, c, g, or t
  misc_feature (584)..(584): n is a, c, g, or t
  misc_feature (591)..(591): n is a, c, g, or t
  misc_feature (593)..(593): n is a, c, g, or t
  misc_feature (606)..(606): n is a, c, g, or t
  misc_feature (632)..(632): n is a, c, g, or t
  misc_feature (636)..(636): n is a, c, g, or t
  misc_feature (678)..(678): n is a, c, g, or t
  misc_feature (688)..(688): n is a, c, g, or t
  misc_feature (690)..(690): n is a, c, g, or t
  misc_feature (708)..(708): n is a, c, g, or t
  misc_feature (716)..(716): n is a, c, g, or t
  misc_feature (747)..(747): n is a, c, g, or t
  misc_feature (756)..(756): n is a, c, g, or t
  misc_feature (758)..(758): n is a, c, g, or t
  misc_feature (779)..(779): n is a, c, g, or t
  misc_feature (791)..(791): n is a, c, g, or t
  misc_feature (799)..(799): n is a, c, g, or t
  misc_feature (802)..(802): n is a, c, g, or t
  misc_feature (818)..(818): n is a, c, g, or t
  misc_feature (820)..(820): n is a, c, g, or t
  misc_feature (844)..(844): n is a, c, g, or t
nagcgcccaaagccccgaaaaaaaaagcggcagcgacaaaagggacggcgaggtaatcctaggctcatnctatatcgccgacggccntctcaaggcaaacaaaaacacgagaaccgcccccacgcccgcgacagcggccacgacccccnccaaaaagccgcagagcgcggcaaacccggcaaaggnnnccccaaagaacaacaagcaggaaaaaaaggaggcggcgaggaggggggccagccgggggaggcgaccaaccgagccgaagaaaagcgaaacggccagcgncccgagaccggccaaggcaaccgngcaggaaacggagcagaacccggcgaaggcaaaaaccaaggccaccacaacgnctccaccccggcggcggagccgcgnanaacaccaaagagacaatntcgggaaaccnccccaatgaatattgaggagcccgcnttcgtngccaagcctagcgccgangctcggaggaatacngtaanatcggcgtngcccgctaaggccaaaccccgcagttcatcgtccgccgcancccccatggnagccgctgaggccccagcggcgngggaggagangccggananaaaagctactcangcccccaagaacagcccccccatccntgcngctaaaggggccagaaaaagcaattgcgcaaaaacaaggagnaagccgccgncnccacaccggccagaaacnacggagancacaaaagacaaaaaggctggggccccccgngcagagccncngccgcgccctggaaggcgcancaggaacgaganaaggtacncangcctggcaagccgccngngggcccaagcgttaagcgcgcccnatgctcccgaggcgccaatgggaagggaacaggttcacaagcgcaac

SEQ ID NO: 483747 - DNA, 244 bp, Homo sapiens
ataacaatatggcagtgaacacctttgatgtatgtttggcacttattattagagatggagtccgcctgtcgcagctggagtgcagtgggaacttggccatgtaactcactctgggtcaagcgattccttcctcagcctctgagtagctgggattacaagtgtgcgctaccacaccagctaatttttatttttttttgagacggattctcgctttgtcaccaggctggagtgcagtggcttgatg

SEQ ID NO: 483748 - DNA, 851 bp, Homo sapiens
agcggggcctcccgcggttctgtgcggacgctggcccgctcctgttgcctcgctgctgtctgcccggctcctgtgcttgtccttagcgcccgcaactgacgaggcactgcgccagctggaggccgagctgggctgccgagcggtcttggcctgctgcgtggtgctgtggtgccctgctcggacctgtgtgctgccggagggcctggcttgacatacatgctgctcgtgctgccctgctgcgtagctccccctggcccaaggggctttgcagctgacttgcttgcttatcaacaacgcggtcctctcttgcgcggaatgtgtccaaaggcttcgtggacctagagtagactccactcaaatgttgaacaacgtacttgtgtcacattgaacctattgacctaccaagtagcatcttgccttgaacttcccatgcctgtccttgaaaagagccttttccccagagaacctaggtccattgagccatcaatcgatgacacccctgtgggttaaacaattcctcggtcaccctctttgttgccccctggcaaaaacacctatatcaaaaactgtgtcttaggcttgcatgcttaggataacctttgcttgacaaagtggactaacaagtgtcatctgcctcggtctagcaatcatttagccttatagtaataccccaaggtggtcccccttgatgacagactttggaacatgcgaaaaaccactcaacatcatggttagaccgtggcgctttcgccttgacacacctcatttggacaccacccaagggattcacttaccttgagagaacacaacaagccacattgacaagtaaaaagatacgctgaccccctcgg

SEQ ID NO: 483749 - DNA, 149 bp, Homo sapiens
gtcgatctaaggatctcggaatacccagcgtaggtgactaggacaatcccagccagttagttattcactgtgctcctgtttcctcagctgaaaaaggaagttggttatgccaactttcttgggcttatatggcttttaattgaaattta

SEQ ID NO: 483750 - DNA, 103 bp, Homo sapiens
aggaagctctagctagaaaaaggtactagtattgcatgaagaacagcaactattaacactaggttgctacccacatatgttagccaaaagttaaccaattcat

SEQ ID NO: 483751 - DNA, 140 bp, Homo sapiens
taattttttaatttttctgtagagacaggtcttgctgtgtgcccaggcaaatctcaaatcactggactcaagtgattctcgtgcctcaggctcccgagtagctgggattacaggcgcccactaccacgccaacgttgggc

SEQ ID NO: 483752 - DNA, 85 bp, Homo sapiens
  misc_feature (49)..(49): n is a, c, g, or t
tccacgggggcccagcacccacttttctaatcatgaatgaacaataaancccacgctctttgtcgggctccaaaaaggtaaaaaa

SEQ ID NO: 483753 - DNA, 181 bp, Homo sapiens
gggggggggggggggggggggttggttccccttaaaaattttttccccagacggggtggcccccaaataaacggggaggccttttggggggggttggccaaattttttttgggttttccccccgccccgggggggggccctggcccaaaaagggggccccttaaatttttttggggatgga

SEQ ID NO: 483754 - DNA, 269 bp, Homo sapiens
  misc_feature (9)..(9): n is a, c, g, or t
catcgcccngaacgaggaccggagctcctggaccgcggcggacaccgcggctcaaatcacccagcgcaagggggaggcggaaccgaaggcgtatcagcttagagcctacctgtagggcctgtgcgtggagtggctccgtatacacctggagatcgggaaggagactctgcagcgcgcggaccccccaaagacacacgtgacctaccaccccgtttctgaccatgaggtcaccctgaggtgctgggtcctgggtttctaccctgcggaga

SEQ ID NO: 483755 - DNA, 101 bp, Homo sapiens
  misc_feature (5)..(5): n is a, c, g, or t
aaatnggctggggtggtgttaaggaaggtgatacaaattctttttctataacagttccagaaaaagcctcaggtgttactgataagggcaaaagtttcttt

SEQ ID NO: 483756 - DNA, 269 bp, Homo sapiens
atggtagaagcatctaacatagagaataagcattcagggatacttagctcaaatatataaaacaatattatgataaaggacacaaactagttgtagtgagcctccacagaggacaaaaaatgtaatcatgaatgttccaatagatatcaaaaacaagctgtcatacggatgattacaattgtcgctaccaggccagcaaacaaagtgtgcaagaattacgacatactgtattaaatcatataatagtcatcgctacatgttacgagata

SEQ ID NO: 483757 - DNA, 108 bp, Homo sapiens
cacgaggtgtttgtttacttaactatcataccatttgccaaaaacaaatttctctctttttctgtaaaatttatacctccttctctcccccttttaagtcatttcaat

SEQ ID NO: 483758 - DNA, 684 bp, Homo sapiens
  misc_feature (61)..(61): n is a, c, g, or t
  misc_feature (96)..(96): n is a, c, g, or t
  misc_feature (215)..(215): n is a, c, g, or t
acggttcctttcctatcaaaaaaaagcttaacacctttcatggtcaggccctcaaaaacantttcccctaattggcttcctagtcctgtatgcccntttccataacactcccaccaaacttactaatactaacatctcagacgctcaggaaatagaaaccgtttgaactatcctgcccgccatcatcttagtcctcatcgccctcccatccctangcatcctttacataaccagacgaggtcaacgatccctcccttaccatcaaatcaattggccaccaatggtactgaacctacgagtacaccgattacgggggaataattttcaactcctacatacttcccccattattcctagaaccaggcgacctgcgactccttgacgttgacaatcgagtagtactcccgattgaagcccccattggtataataattacatcacaagacgttttgcactcatgagctgtccccccattaggcttaaaaacagatgcaattcccgggggtttaaaccaaacccctttccccgctacacgaccgggggtatactacggtcaatgctttgaaatttgtggagcaaaccccagtttcatgcccatggtcctagaattaattcccctaaaaatttttgaaatagggccggtatttaccctatagccccccctttaccccctttagagccaaa

SEQ ID NO: 483759 - DNA, 177 bp, Homo sapiens
tcgtgccaggtgctgcatctggtggagcgaccactcccctcacattccacaggccatggactcacttttgtaacacactcctaccaacactgtaccaataaaaaaaaatgtgggtttttttttttttttttttttttttttttttttttttttttttttttttttttttggggggtc

SEQ ID NO: 483760 - DNA, 731 bp, Homo sapiens
  misc_feature (143)..(143): n is a, c, g, or t
  misc_feature (262)..(262): n is a, c, g, or t
gtttttttttggtttgcagcgcaagtaggtcgacaagacgcgacttcccctatcatagcagagcatcatccacctgtcatgatcacgccccctcatgcaatgcatctcttccatctatctgcgttcctagtcctgtatgcccntttccataacactcccaccaaacttactaatactaacatctcagacgctcaggaaatagaaaccgtttgaactatcctgcccgccatcatcttagtcctcatcgccctcccatccctangcatcctttacataaccagacgaggtcaacgatccctcccttaccatcaaatcaattggccaccaatggtactgaacctacgagtacaccgattacgggggaataattttcaactcctacatacttcccccattattcctagaaccaggcgacctgcgactccttgacgttgacaatcgagtagtactcccgattgaagcccccattggtataataattacatcacaagacgttttgcactcatgagctgtccccccattaggcttaaaaacagatgcaattcccgggggtttaaaccaaacccctttccccgctacacgaccgggggtatactacggtcaatgctttgaaatttgtggagcaaaccccagtttcatgcccatggtcctagaattaattcccctaaaaatttttgaaatagggccggtatttaccctatagccccccctttaccccctttagagccaaa

SEQ ID NO: 483761 - DNA, 679 bp, Homo sapiens
  misc_feature (112)..(112): n is a, c, g, or t
  misc_feature (114)..(114): n is a, c, g, or t
  misc_feature (116)..(117): n is a, c, g, or t
  misc_feature (119)..(120): n is a, c, g, or t
  misc_feature (126)..(127): n is a, c, g, or t
  misc_feature (395)..(395): n is a, c, g, or t
tcatacggcgcttcatcgggtggagaccctgtgtcgtcaatctgtatcaaggcgcgatggatgcctacgcggtgcaaaagagtacaaacaccaatgcaaatcctttgggcgnananngnnctcggnnacagcggaacaagcaaagtgatgagccacctttttgctccaatgcagaaaataacaacctcactggtaactgatgttaacttcaatggagagcaaggcggtcagcttaacccgctcatcaagatgaagaaccttggtgacactctcatgggaacagccgaagttgccgtagccacatacggtggattgaaagctttggaaagagttaccgatggcaatagcgcagtgggtttaacgacaaagttcgtaaactttttctcaggaggatnggatgctggcaaaggtttacttgatgcaatgtccccatttatcataatggcgatcttcgcattgtttctgctaggagcgactttatcaatatacctgccaatgacgcctttcattatttggttcggtgcagcaattaactggcttgttgtcgttggagaagcaataatcgcagcaccgctttgggcttttacccatcttggtggtgaaggtgacggtatgggacagcgaacggcacacggttatctattccttctaaattgcttgttccgctgggggatcctct

SEQ ID NO: 483762 - DNA, 398 bp, Homo sapiens
ggtggctgcatatatgatattggcggttagccgttcaactttgggctttggggagtccagctgacttagggtggatatagcccaccagcacagcacagctgctgtacaaaagcatggccagactgcttctttgagcaggtcccggattcattcctcctcgctgtttgggacttcccaactggggcctccagccgcccccactggtgttctcctgctgagggtgatttcagttttttcttggctggagctccctgatggaggggcaggccgtcatgtttgctgtttttgcaacttaaccacttcaaccttcagtctttggagtgtccaaggagaccgggggctgatgtggaccctcagcatagcacagatgctctataaaaatgtggtcagactgctta

SEQ ID NO: 483763 - DNA, 240 bp, Homo sapiens
  misc_feature (66)..(66): n is a, c, g, or t
  misc_feature (88)..(88): n is a, c, g, or t
  misc_feature (107)..(107): n is a, c, g, or t
  misc_feature (109)..(109): n is a, c, g, or t
  misc_feature (239)..(239): n is a, c, g, or t
tcagttcagtgttttaatctgacgcagcttatgcggaggagaatgttttcaatgttactttatctnacaataagtttccttcctatangggtgataagattggtccnanttggtgtgaggagttcagttatatgtttgggattttttaggtagtgggtgttgagcttgaacgctttctttaattggtggctgcttttaggcctactatgggtgttaaattttactctctctaccaaggnt

SEQ ID NO: 483764 - DNA, 544 bp, Homo sapiens
  misc_feature (260)..(260): n is a, c, g, or t
cactagaatcgtgctggggcctgctagtggatgggccgtctgttaaaccatacagtggtgactgatgtaaccctggcgggagagcaaggcggtcagcttaacccgctcatcaagatgaagaaccttggtgacactctcatgggaacagccgaagttgccgtagccacatacggtggattgaaagctttggaaagagttaccgatggcaatagcgcagtgggtttaacgacaaagttcgtaaactttttctcaggaggatnggatgctggcaaaggtttacttgatgcaatgtccccatttatcataatggcgatcttcgcattgtttctgctaggagcgactttatcaatatacctgccaatgacgcctttcattatttggttcggtgcagcaattaactggcttgttgtcgttggagaagcaataatcgcagcaccgctttgggcttttacccatcttggtggtgaaggtgacggtatgggacagcgaacggcacacggttatctattccttctaaattgcttgttccgctgggggatcctct

SEQ ID NO: 483765 - DNA, 239 bp, Homo sapiens
  misc_feature (14)..(14): n is a, c, g, or t
  misc_feature (38)..(38): n is a, c, g, or t
catctcagctcggnacccagtagtgcggcaggaacagntcccagctgaccgagcacgtgaatccgatgaggaccgtgatggggtgagcgttgtgacggcccaccgcattaaaggtcgcgaattcgacgtcgtcgccgtgtgtggtctcgaagaaggtaattggcctgctggtaaccacacagggtcccttgttcgcgcagaccgctggtctcccgacggcctcgtagcagcgcctggat

SEQ ID NO: 483766 - DNA, 421 bp, Homo sapiens
ggcaacctcggcctcctaggttcgagcgactctctgtgcttcagcctcccaagtagcggggactacgggtgcgaaccaccaggaccaggtaattttggtattttaagtagagatgaggtttcaccaggtgggccaggctgggtctcaaagtggtggactcaagtgatccaccgggccgggcctcccaaagtacaggcttgagccatttcgcccagggataaaggctggtttaaagcttcggggtatggggggggggtgtaaggcagcctcactgggggcaggggctgaggggtacaatcagatagaacccggaggccccgggaagcttcgagggtctatgagggacctttccgggcctttacagcccaaattggaagacccatttctcgtgagggactgtatggaaatttctaaaactagg

SEQ ID NO: 483767 - DNA, 127 bp, Homo sapiens
tagatcgagctcggtcccatggtttagcagaggcccatcgacgggggcctgggtcatcgtctggcctgcgggggtagtacgcggatttctgccattcatctccagtgtccttcagcgattacctcta

SEQ ID NO: 483768 - DNA, 633 bp, Homo sapiens
  misc_feature (218)..(218): n is a, c, g, or t
gcgtcgacaggcaaaataataaaaagagccttgggtcattgaaaaaaaaaaaggagctgccattactttggatccacatggaagtttggtgaaactctactgtgaataatttttactgttgatcccttttggacaggaactcttcaccctaagacagtagatgtaaaatctggtttcattctcctgctcctttaatcctcatccatgctcttttcttngcttgtggtatgaattgacttgataattgggtctctgacatcttccaactcccataaccaactctgtcattaggacttgcccagtattctgtattttttaaagcaagcattattgagtgcatactttatgccatgctaagtgctttatatttattcattaaatcctcaaaacaatcccattactatacctgtttcacagttgaggaaactacattagtttttctttctctctggatcattcccttcaacataacaaaaagaaaaaaaaactgttcttttcataagaaaaaaacaaagttcttgacctaagtttcccttcagctaccatcccattgctgtgcttctcttgacagcagaattttattcttataagagttgtctgcactgtgtccagttcctctcctgtcagtctctg

SEQ ID NO: 483769 - DNA, 100 bp, Homo sapiens
acccgctgatatgacagtcggcagctcagtaaattggaagagagaagaaaaattatccaattctggccaggcacgctggctcacacctgtaatcccaaca

SEQ ID NO: 483770 - DNA, 123 bp, Homo sapiens
ggctatctagaggatcccgaaggtcccatgttatttatactacattagttcttctatagggtgatagatgggtccaattgagagagcgtgacgaagcgcaacactcgctatgagctaaaaaat

SEQ ID NO: 483771 - DNA, 170 bp, Homo sapiens
aatgtgggagcccccggacaagctgaccaatctctgtgattgtgtcccatcacccttgttttgaaaaggggatgctgatggtatccacctcctaaggttgatgcgaggatgaaattatttgacctataaagtgctgagccttggaaaggacaaataaagcaatgaataca

SEQ ID NO: 483772 - DNA, 757 bp, Homo sapiens
  misc_feature (351)..(351): n is a, c, g, or t
caggcacctcggggcctcccccgggaaacccgagcatgcccccacaactatgcctcctggggcgcaggacatggccccccatcggcaggaacccaaggggcaggacatcctcggtcaaggacactcacatcctcacccattccacaccgggtgggatgcgcccactccagggatgtctcgagatgcaagcttgcacaccatggccctcataggcttaggacatccccacgcctggacccccaggctctgggggccagccagccgccccgaccacgcacactggaatgccctcataccctggacctctctcctaaatgggcatgcacccctccgagcggccatgccacttcnggagtctcccagatgggtcacccaggctcctatgcgcgtccgcatcggtaagacgtggaccatcctcacagcatgaagcgcccacaaatggatagcagcatggccgctgccacggacctccacgacgccgtgaaggcgtaacacgagacgggggcactactccccgtcgcatctccagaccgcagctcccgcaggccaccagttcccgcctcgaggccgcacttgagaggccctctcgcgctcaggaaattcacatgtttccttcctcctgttacattttcccaatatcttttctattccttggaccaatcagagatgctgtagctccatggggcaaaggtactaatccctctcagcacccccactccattcccctttttaaggtaactgtttccacaggagtacc

SEQ ID NO: 483773 - DNA, 382 bp, Homo sapiens
tgacacagagttttactcttgttgctcagactggagtgcaatggtgcgatctcggctcagtgcaacctctgcctcccgggttcaagtgattctcctgcctcagcctcccaagtagctgggaccatgggcaactgccaccacaccccactaattttgtatttttagtagagatgaggtttcaccatgttggtcaggctggtctcgaactctggaccccaggtgatccgcctgccttggcctaccaaactgctgggattagaggcttgtgccactgtgcctggccaaattccaaacattttaactgaaaaattgttttagtcatttacacaaatgccactttccaaatgttttctaggatttggagaaattcactttatgaatg

SEQ ID NO: 483774 - DNA, 729 bp, Homo sapiens
tggcaccaggaccacgtggcgttaagtctgccatctcccaggaagagaatcagaagtttctgagagcccgtgaggaaaccagagagtgcgctgtccctgattcttcactgtgatgggcgcgttcttcatggttatccgcagctgttcacaagtaactggagccgtagaatgtccactgtgatcaggagccataagaccctacccagagcccaagggggcttcaccgcagaccctcaagccattgacgcacatcatcccaaagcacgtgcgccaacatcctgcggatcaccctgatgccttgtcacatgatagcggtagctggtcctacaggcgttgagggacactgctgggtcgatgtgcggctcggattcatgccagtttctgctgctgcagccaaacgatggtcacgaagcattgtcactatcaagtaacatcaagtgctcaaagacagtggcaaccgttcagtggtacttagagtattcaacaatatacaaactagcagattctctgagcagaaacccagcacggggtcttcaccttcattcaccccacaggcgacatgcgagggagaacagcatctcagtgctgatttccaaaccaagcctgttgttttcggtgtgagggttttgggggtatgcttgtaatgctttagtgaaattgtaaatgttgggctttttattttgatgtaaactgagaataactggaaaacttagggcctgtgacctaaaa

SEQ ID NO: 483775 - DNA, 128 bp, Homo sapiens
ggagactggtttctctcacagtgaagctccatgtttatgattcttgggcctagatgtgtattagaatcacttgttgccgggcgtagtggctcatgcccgtaatcccaacacttgggaggctgagatgg

SEQ ID NO: 483776 - DNA, 667 bp, Homo sapiens
tagggctggcccgcctctcttcagtctggtgtctggccaacatggtgaaaccccatctactaagaaaaatacaaaaattagccagacctggtggcgggtgcccgtattcccagctacttgggaggctgaggcaggagaattgtttgaacctgggaggcggaggttgcagtgagccaagatcacgccactgcactccagcctgggtgacagagcaaggctctgtctcaaaaaaaaaaacaaaaacaaaaacaaaaaagacggatatcgcacctaaattattattatattaaaagaagcagagtatgagagacaggtgacatggtccagtaggaagagaagcagccctgattctaccagttaaggtgatggtatggatcgttaggctgggacagttctctccctcatcggtttgcctcttcaacataatgaaatagatggaaagtctctaaggctctatcagttcggacattctaggctctcatatacattcaacgtggagccatatgtaatccacgggtgcgtcaggttagaaacagtgagtatcgaagttcatatatggttccaggctactaccttgcaatgtggctggcgaaccctttcgaatccagaacctatcccagatctcagtagaaccatccactgtcctgttgtcacgttccaccttagg

SEQ ID NO: 483777 - DNA, 1182 bp, Homo sapiens
  misc_feature (189)..(189): n is a, c, g, or t
  misc_feature (191)..(191): n is a, c, g, or t
  misc_feature (201)..(201): n is a, c, g, or t
  misc_feature (209)..(210): n is a, c, g, or t
  misc_feature (214)..(215): n is a, c, g, or t
  misc_feature (226)..(226): n is a, c, g, or t
  misc_feature (231)..(231): n is a, c, g, or t
  misc_feature (237)..(237): n is a, c, g, or t
  misc_feature (239)..(240): n is a, c, g, or t
  misc_feature (257)..(257): n is a, c, g, or t
  misc_feature (260)..(260): n is a, c, g, or t
  misc_feature (263)..(263): n is a, c, g, or t
  misc_feature (275)..(275): n is a, c, g, or t
  misc_feature (282)..(282): n is a, c, g, or t
  misc_feature (293)..(293): n is a, c, g, or t
  misc_feature (301)..(302): n is a, c, g, or t
  misc_feature (310)..(310): n is a, c, g, or t
  misc_feature (312)..(314): n is a, c, g, or t
  misc_feature (320)..(320): n is a, c, g, or t
  misc_feature (333)..(333): n is a, c, g, or t
  misc_feature (342)..(342): n is a, c, g, or t
  misc_feature (354)..(354): n is a, c, g, or t
  misc_feature (363)..(363): n is a, c, g, or t
  misc_feature (367)..(367): n is a, c, g, or t
  misc_feature (371)..(372): n is a, c, g, or t
  misc_feature (388)..(388): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (403)..(403): n is a, c, g, or t
  misc_feature (405)..(405): n is a, c, g, or t
  misc_feature (408)..(408): n is a, c, g, or t
  misc_feature (412)..(413): n is a, c, g, or t
  misc_feature (418)..(418): n is a, c, g, or t
  misc_feature (428)..(428): n is a, c, g, or t
  misc_feature (432)..(432): n is a, c, g, or t
  misc_feature (445)..(445): n is a, c, g, or t
tagtctcatctgtctcccgggctggagtgcaggggtgtgatctgggctcactgcaacctccttctgccgggttcaagcagttctccgtgcctcagcctcccaagtagctagtactacagatgcatgccactattttttagtacaaaaatattaaaaatttgggtcgggtgtggtagcttacgcctgtantnccagcacttngggaggcnnaggnnggtggatcacnaggtnaggagntnnagaccagcctggccaanatngtnaaaccccatctntactaanaatacaaaatnagccaggnntggtgcangnnnctgtantcccagctactcnggaggctgnggcaggagaatngcttgaacncagnaggnngaggttgcagtgagcngnatngcnccactgnantcnagcnngggcnacagagcagnctcnatctcaaaaaaanaaaaagaagtaacaaaacagaaaaatgaacaaaacaatttaaatgttaaacattctattcaccaggctggtaattgtgctagcactgaggatacaaaaattaaagactctggttggcagcttacattctaaagagagcgaggaatagatttccagactctgtgctaagtgcagtaatgacagtaggcccaacatgctgtaggagctccacgtcagggggtaccctgggggcaggagggtagagggttttaagaatgtcagacagaacaatgagtaaagtaggaaggcaaatagctacaaaatatcacaagcactgtgtatagctggaaccaaaagtgtgaggcaggacctgggtggagaggtagacagggtcagagcttggagggccttgatactatgctggaagactgcactttatcttgttgataatgggatcctctgaagcatttcaagcaaggaagtgacaatgtcagttttagtttcagcaggatcagatggtagttcaatatggaggaaatatgtgtggcagaaagatatggccctgaactagggcaggtatagtaaaccttttattataagtatgtatgtgtatcggtatatagatagatataggtatatatgtatgtatatgtattccaaatgacaacagtatcatgacttattataaagttaaaagctcattttttaaaaaatggcaatatggaaaaatataaagcaaaacaattatttgaaatctca

SEQ ID NO: 483778 - DNA, 345 bp, Homo sapiens
tgggtggatcacgaggtcacgagttcgagaccagcttgaccaacatggtgaaaccctgtctctactaaaaatacaaaaattagccggccgtggtgaagggcatctgtaatcccagctactcaggaggatgaggcaggagaatcacttgaatccaggaggcggaggttgctgtgagccaagatcgcaccactgcactgcagcctgggcaacagaatgagactccatctcaaaaaaaaaaaaaaaaggcaattcctggagccccatcacgggcctgtggaatcagaaactctgaggatgggtctagcagcccgctttaccaattcctccggggtggtcccataattg

SEQ ID NO: 483779 - DNA, 2468 bp, Homo sapiens
  misc_feature (189)..(189): n is a, c, g, or t
  misc_feature (191)..(191): n is a, c, g, or t
  misc_feature (201)..(201): n is a, c, g, or t
  misc_feature (209)..(210): n is a, c, g, or t
  misc_feature (214)..(215): n is a, c, g, or t
  misc_feature (226)..(226): n is a, c, g, or t
  misc_feature (231)..(231): n is a, c, g, or t
  misc_feature (237)..(237): n is a, c, g, or t
  misc_feature (239)..(240): n is a, c, g, or t
  misc_feature (257)..(257): n is a, c, g, or t
  misc_feature (260)..(260): n is a, c, g, or t
  misc_feature (263)..(263): n is a, c, g, or t
  misc_feature (275)..(275): n is a, c, g, or t
  misc_feature (282)..(282): n is a, c, g, or t
  misc_feature (293)..(293): n is a, c, g, or t
  misc_feature (301)..(302): n is a, c, g, or t
  misc_feature (310)..(310): n is a, c, g, or t
  misc_feature (312)..(314): n is a, c, g, or t
  misc_feature (320)..(320): n is a, c, g, or t
  misc_feature (333)..(333): n is a, c, g, or t
  misc_feature (342)..(342): n is a, c, g, or t
  misc_feature (354)..(354): n is a, c, g, or t
  misc_feature (363)..(363): n is a, c, g, or t
  misc_feature (367)..(367): n is a, c, g, or t
  misc_feature (371)..(372): n is a, c, g, or t
  misc_feature (388)..(388): n is a, c, g, or t
  misc_feature (390)..(390): n is a, c, g, or t
  misc_feature (393)..(393): n is a, c, g, or t
  misc_feature (396)..(396): n is a, c, g, or t
  misc_feature (403)..(403): n is a, c, g, or t
  misc_feature (405)..(405): n is a, c, g, or t
  misc_feature (408)..(408): n is a, c, g, or t
  misc_feature (412)..(413): n is a, c, g, or t
  misc_feature (418)..(418): n is a, c, g, or t
  misc_feature (428)..(428): n is a, c, g, or t
  misc_feature (432)..(432): n is a, c, g, or t
  misc_feature (445)..(445): n is a, c, g, or t
  misc_feature (1225)..(1225): n is a, c, g, or t
  misc_feature (1233)..(1233): n is a, c, g, or t
tagtctcatctgtctcccgggctggagtgcaggggtgtgatctgggctcactgcaacctccttctgccgggttcaagcagttctccgtgcctcagcctcccaagtagctagtactacagatgcatgccactattttttagtacaaaaatattaaaaatttgggtcgggtgtggtagcttacgcctgtantnccagcacttngggaggcnnaggnnggtggatcacnaggtnaggagntnnagaccagcctggccaanatngtnaaaccccatctntactaanaatacaaaatnagccaggnntggtgcangnnnctgtantcccagctactcnggaggctgnggcaggagaatngcttgaacncagnaggnngaggttgcagtgagcngnatngcnccactgnantcnagcnngggcnacagagcagnctcnatctcaaaaaaanaaaaagaagtaacaaaacagaaaaatgaacaaaacaatttaaatgttaaacattctattcaccaggctggtaattgtgctagcactgaggatacaaaaattaaagactctggttggcagcttacattctaaagagagcgaggaatagatttccagactctgtgctaagtgcagtaatgacagtaggcccaacatgctgtaggagctccacgtcagggggtaccctgggggcaggagggtagagggttttaagaatgtcagacagaacaatgagtaaagtaggaaggcaaatagctacaaaatatcacaagcactgtgtatagctggaaccaaaagtgtgaggcaggacctgggtggagaggtagacagggtcagagcttggagggccttgatactatgctggaagactgcactttatcttgttgataatgggatcctctgaagcatttcaagcaaggaagtgacaatgtcagttttagtttcagcaggatcagatggtagttcaatatggaggaaatatgtgtggcagaaagatatggccctgaactagggcaggtatagtaaaccttttattataagtatgtatgtgtatcggtatatagatagatataggtatatatgtatgtatatgtattccaaatgacaacagtatcatgacttattataaagttaaaagctcattttttaaaaaatggcaatatggaaaaatataaagcaaaacaattatttgaaatctcactaccaagggattataccaatgtacactttttttgttttgttntttttttnagtctcatctgatctcccggcgctggagttgcagatggatgatgatcatgggacatcacgtgagaacctcacttcatgaccggagttcaacgcagattactccgtgaccatcagacacttccacaagatagacatagatacatacagagtgcagtgccacatatttttatatagatacaaaaaaatatttaaaacattgtgggatcggagtgtggatagctatacagccgtgatagataccagcaacttggaggaggccaagggatgggtggaatcaacaagagtcaggagtttaagagaccagccgtggccacagatggatgaaacacccaatcgtcatactaaggaaatcacaaagtattcaagccagagttgttgagtgacagaggagtgcacagtgataagataacacagacataactactagagagagacatgggagcagagaagaaatgggagttgaaacaccaaagaaaggggtggaagagtatgaaagattgaagtgcaaggagatcaggagacacaagtgataacatccatacgacacgtgtgggcccaaccaagaaggcaagggactcccaaatcgttcaacagaaacaaagagaaaaaaaaaaaacacaaagaaagaggagaatcaataaagtacaggggagtggacgagaaacaaaaaacagaggaaaaagtgaaaccaatggaaacaaaaaggaaacaaaaaacaagagatatcacagtagcaccaccaaagaatacagagtaaggaacacagaagtgggagcaaaaaattacacagaggatacacaccatatattagcgtagacggcaggcgacgtagattaaagacaagaaaaagacacacgtggtcagaaccgagagaaataaacggaagcacacgagagcagaaaagcagagaagcgagaagaagaagaagaaaaaaacaaaaaacaagaaaaaaaaagaagaaaaggaaaaaggaagaacataacaaaaaaaaaaactaagaaaaaaaagaaagcaaaagcgaagagaaaaaaggaaaagcaacaaaaagaaaggagaaaagaaaggaacaaagaaaaaaaaaaggagacagaagaaaacaagagaacaagaagaaaaaaagcaagaaagacagaaaagaaaggaaaaaagagaagaagacaagaaaaaacaaaggaaagaggaaagaaagagaaagacaagagaagagaaaaagaatagagaaaaaaacaaaaaag

SEQ ID NO: 483780 - DNA, 459 bp, Homo sapiens
attgagcccttgatgctgtcttccttggtgttcgccatcaagcaggatctccccaaagccatgtaatgcggccgtagatcacagacaagctggtgctgcactcacgtatgccataggaactgatacattcaggccagctgcgccaccagcggctacggtctctatgaaggactggactggctgtccaatcagttccggaaccatacgtgaccgcgagccccctccctctcactcctcttgccctctgctttactctcatgtggcaatcgtgcggctcgtggtgtgagtgacagaagctgcctccgtgggtatggtcaccgtgtgcattgcagctgtgctgtagatttgggagacgcatgctgcggccaggcttttcattttatgtcccttgtccctgtttcccatgaggtcccttctggtactcctattcggtattactccgcttttgttcttgtcgac

SEQ ID NO: 483781 - DNA, 397 bp, Homo sapiens
tactgggatagtttgtaaagaataggtatttattcttctttagaagtgtatggtataatacaatagataaagccgtctggtttaggattctctggtagttgaagtatcttttactactgaatctctctcagtgacttgtagatcaggtctataagtgttttctaatcctactgggttccatctttatatcgttgtatgtgtccaggactttattcatatcctttaaatttccaaatttatagggattttgtagttcatcatactctctaatgatccttttaatactattgtgtccattgtgactttttctcttccgtttatgacttgtgtacttttgattcatacattgtctgatcgacctactttcattctctttattttaactttcgtgcatcta

SEQ ID NO: 483782 - DNA, 413 bp, Homo sapiens
gcgaggagtatacaagccctgaggagatcgagcgcagtgcggctgagacgcagacggttaaaaaaaaaaaaaaaaaaaaaaaaaattgggggggcgcgggccggaaaaaaggctttctaaaccccacttttcggtggtcggcgcgcgcgccccaacgaagtgtaagtggaacatggggacaagacggctgcccccaaaaggagagaatccgtggcgcacagcacataaagcgcttgcgggttttccccaccccaaatagaaaaaaacccccgcggggggacaccccggcagctgttttggacacaaatctccaagagtgggggtgtccagcgagcaccaagcacggggtctctaaccacacgaggggcgccacaagcgaacgccgaagataaaaataagccccgccgggggca

SEQ ID NO: 483783 - DNA, 140 bp, Homo sapiens
gaaggcgcacgatggcgcgtccgctacatggtggactgacaaggttcacagaggtccagaaagcaggggggcctgagatcaccatatgacagacctggtccctgccgttccatgaacctgagtgaacagactgtgagcgc

SEQ ID NO: 483784 - DNA, 141 bp, Homo sapiens
gaaacaggggcgtttcctaattggtctttatcctgcgacacactttcagcagactagcctctcctatctcacagatcacaggcacccctagatagtgtgatcctgtcaagaagcattacgaaaacctctataggtaaaggc

SEQ ID NO: 483785 - DNA, 278 bp, Homo sapiens
  misc_feature (54)..(54): n is a, c, g, or t
  misc_feature (78)..(78): n is a, c, g, or t
  misc_feature (81)..(81): n is a, c, g, or t
  misc_feature (133)..(133): n is a, c, g, or t
  misc_feature (194)..(194): n is a, c, g, or t
tttttaaaatccgagttgtccggaaatcccttgcccgtgttttcccagtttttnacccgactccaaaaaaaaacctcnggnaatttttcaagggcaaaaagttcaagcccctggaccttcggcctaaaaaaanccgtgccatgggcccccgggtcaacaagcccgaggaaaaccttaagacccaaaaaccccancggaaggagcggctgttcccccttcggaagtacccggtcaaggccttaggggggccttgtccataaagcccaactggtttggga

SEQ ID NO: 483786 - DNA, 1609 bp, Homo sapiens
gggcatataaccagattaaagtgactggcactttctgctggttatgtgccaccgctcagcggtctggtaaaatagggaacacacgctagctggttctagtaatcctggtgtgtttatcacggttcagagaaactcaagctatggcatggagttagccccctatctgaacagaggaagagcccctatacaggaaggaaacagacaaacctgcgcctgcgaccgcctctgcgtcctgggtagtctgtgctgtgtaatccagcatgtgtcacagagtaagcctgatgtgacttagcttttggggtctatgtcattggtttctgatgcttgtacaaacacgcacacacaaatggataaaacagtacctctggctgttacattaccataaaccatatcagcatgcctacattttacaaatgatttctggtgttctctatagttgcttctctaacatagtactttcgtttccagcaaaagcgaaaatgtgtttgcagattcgttactttaataaaggttatccataccaataaaaagtgtacaacacagcattttctgtagattatcatggttctcagtgtaaatttgtattttatctggcatgcgttattaattattaaactgggttctagcaatacaacaatatggaagcttaactttttctcctaaaatattcgggaacagtgttggccattataaatacgggaacttttggacctatggttcggaaaaggaagtcaaacaagctctttacacgtgcctgcaacatcacaccactattctctaaacacggggtacagactaatgctgatcctacgggagcggagccctcaccaaacgacatacctattaagttaatctttttttccttttgtgtttcatacatctccctcactgatacacacaactacaacaaatactactctatcaacacagagtacatatagaactagacaacacagacatacaactaacacacaaaaatacaccagacacacacacagaccacaagaaaaaaacagaacaaggaacagagaaagaaacaaagagaaaaaagcacgggagggaagaaaacaacaagcaccaagagagcaaagagaagaaacagcgcaaaacagaaaacaggaagagagaaagagcagaaaggagaaaaagagagaagagcagaaaaacaaagcaagagaagagcacaggaaacaaggaaagacgaagagaggcaacagagagagaagagagaaagaagaagcaggaagaagaacgaaagaacgaaagaaaagaacgaggtagaaaagcaggagagaagacatcagaatatagagacagagacagaagagagacaccagagaaagagcaagcaggaagaaaaatcacgaagcaagaacgaagagataaagaagagacacagaagaaaaagatcagatacaaagacaaagaagagacagcgagacgaagcaacgagagaagccgaagaagaaagaagaggaggaagcagagaagagacagaagaagagaaaaaaagaaagagaaaaaaaacagacaagagaaagaaaaaaacataaaagacacacacacaaaaacaagacaaacaaagaaacagagaagaacacagcagcaa

SEQ ID NO: 483787 - DNA, 327 bp, Homo sapiens
atgcaggccgtatctctcttgaccctcaggtcctgggctaccatttcctgctatatgaattccggttggggcgaccctcggaccgaactccaatctcctagcagtacatgctttgacttcaccagtctttgcgaactactgtactctcttgatcccctgacttgacctccggatcgtgttaccctttgtatttctgcgctatcctattctaataggtccttttatccctagggtttccgaccccgatgttcgattttgagcttccgttggttctgccgcttttcttggttcgtttgttccacgatttgtgtccgttctgatctgggg

SEQ ID NO: 483788 - DNA, 98 bp, Homo sapiens
  misc_feature (66)..(66): n is a, c, g, or t
  misc_feature (93)..(93): n is a, c, g, or t
gtgtgtcgcgatgccggagctggcagtgcagaaggtggtggaccacccccgggtgctgctcagctntagtggtatcatcatcaaccagattcntccat

SEQ ID NO: 483789 - DNA, 623 bp, Homo sapiens
  misc_feature (48)..(48): n is a, c, g, or t
  misc_feature (78)..(78): n is a, c, g, or t
  misc_feature (104)..(104): n is a, c, g, or t
  misc_feature (154)..(154): n is a, c, g, or t
  misc_feature (165)..(165): n is a, c, g, or t
  misc_feature (168)..(169): n is a, c, g, or t
  misc_feature (171)..(171): n is a, c, g, or t
  misc_feature (174)..(174): n is a, c, g, or t
  misc_feature (178)..(178): n is a, c, g, or t
  misc_feature (186)..(186): n is a, c, g, or t
  misc_feature (200)..(200): n is a, c, g, or t
  misc_feature (203)..(203): n is a, c, g, or t
  misc_feature (214)..(214): n is a, c, g, or t
  misc_feature (219)..(219): n is a, c, g, or t
  misc_feature (246)..(246): n is a, c, g, or t
  misc_feature (248)..(249): n is a, c, g, or t
  misc_feature (252)..(253): n is a, c, g, or t
  misc_feature (256)..(256): n is a, c, g, or t
  misc_feature (259)..(260): n is a, c, g, or t
  misc_feature (274)..(275): n is a, c, g, or t
  misc_feature (282)..(282): n is a, c, g, or t
  misc_feature (297)..(297): n is a, c, g, or t
  misc_feature (307)..(307): n is a, c, g, or t
  misc_feature (315)..(315): n is a, c, g, or t
  misc_feature (317)..(317): n is a, c, g, or t
  misc_feature (327)..(327): n is a, c, g, or t
  misc_feature (355)..(355): n is a, c, g, or t
  misc_feature (368)..(368): n is a, c, g, or t
  misc_feature (376)..(377): n is a, c, g, or t
  misc_feature (408)..(409): n is a, c, g, or t
  misc_feature (422)..(422): n is a, c, g, or t
  misc_feature (430)..(430): n is a, c, g, or t
  misc_feature (432)..(432): n is a, c, g, or t
  misc_feature (436)..(436): n is a, c, g, or t
  misc_feature (452)..(452): n is a, c, g, or t
  misc_feature (460)..(460): n is a, c, g, or t
  misc_feature (466)..(466): n is a, c, g, or t
  misc_feature (473)..(473): n is a, c, g, or t
  misc_feature (476)..(476): n is a, c, g, or t
  misc_feature (512)..(512): n is a, c, g, or t
  misc_feature (516)..(516): n is a, c, g, or t
  misc_feature (520)..(520): n is a, c, g, or t
  misc_feature (579)..(579): n is a, c, g, or t
  misc_feature (586)..(586): n is a, c, g, or t
caaacatacagaagtatgtgtgtgtgggtggggtgagtgtggtggganccgttaggtcgccatctctgccaatgtggnaaaaaataaaaaaaaaaggaaaaganaaaatgactgagacagcgaggttcattcttgtgttggagcggaggcagcngccctagctcntgnnanagngggnatactggngggcgggctccctnggngtaggtgtggngggtngggggccccgcaagcgcgtagcagagngnngcnnagnggnnggccagccgcgtgnncgctccngccttgcgatcgcanaggcgctgcntgaggagngngggagggggnatctctacattggacaccatggtctctncttgtccccaggntcttgggnnagggactgagagtagaaagcgacattttggnnagcccgagggggngagggggngngggnaaggatctgtgtgggnggggcagnacagcngaggagnggnggggggagggagtgacaggaacctggggtaccaggntgcngggnagatgcagaggatgagagagcttgcgcgatgctggcaccccatgccaaccactctgcgnggctttnctcttcggagaggtggtgggctcccttcttcactgtg

SEQ ID NO: 483790 - DNA, 1128 bp, Homo sapiens
  misc_feature (1128)..(1128): n is a, c, g, or t
ggcggttgtgcatcccgtcgctcgtgcgacggggcagtggaggatcgaggacacctgggtggtgcaccgtagatgctcgtgacccaccggtggagaaccctgcgagtcacacgccaaatgcgaacaggagcgcccataccgagccgacgaacctgatggtggactccatgtcagggtgggacactgcctcatggaagacatgacggctgggatgttggaatgcctataggaatgactaacctgatcgagtgctgtatagaaaaaccgaggcatctattcaggtgagagcacgcacgctttaccaccatggacgaccggtgcaactagaatcgttgctgtgatgccccaacatactatgtccccatcataagattggcaatatctcggtcccgatgcgtgcaatgaatgctacacctatactatgtatgcccttacttgctacttgccatgggcatgccgcggtacccgtagacgcgcagggcgtcgcgcggctgtactcggctagtggtcgcttgtgatcgtggctgcttatgatgacagattgtgtgtgtatgtagccgtcgcaaacggggtgggtacaccccccagaaggcacaagcgagaacaagacccacatatagaggacacagagagagcgatgggaaatgcgcccagataacgagccaggcacgggaaatagacaccaactgccgaggacacataacgagcaatggatcggaggacgatcaggagaccacaacaatgcacgagcataccatgggcattgaaattacacgccaagcatcccaacaagtaacaaacacagtattagtaacaacatcagaagaaaacccaaaatggatgggaaccaattgaagatcaaaggacctttggcgttgctgtgatagagacacggaccaaaacagataatccccttggacgacccttaacgagacatgcacctgagtgcttcctttcgctagccccatgcattagggcacaaacactgaaccgtttgtgcatcaaactaggctctacctcatgccacgagagaccatgtgatccatagcaggtagatctcttcgaaagcttaggtggtcaggcatttggatctatcggtatgagcaccgccgataaagagacaaaacn

SEQ ID NO: 483791 - DNA, 434 bp, Homo sapiens
gcatgtctacacattagctctacagacttcaggctttcagaccatgacgacatgtgtgttgacacgtcatgaactgtgtaacaggtatacgcacggaggacacaaatggaagggagatggctgaagaaacgttcaggttggaagaagttggtcctccatggtctatagagcaagagaacccaggaggggccgctggcagataaaagtataatacaccagctactatcacctcttcatgaacgcatgccttatttatgacaatgttgcttttacagctcctctacgctaaaagccaatactatagtgtagactctaggctcccgcagggaactgggcaggtaaataaccttctgtcggctatggaccgctctaggcatggctcctgtgtacatccttgcaaaggtgcctgctgacctgctactctgtactgtaca

SEQ ID NO: 483792 - DNA, 229 bp, Homo sapiens
actctagatgtgatcccccaattttgtgtgctgtaaccatgtgaataatgtggttgagatgttaaattgagccacttattagtaatgtttgatagtagaatgatgtgctatggtgacttcatatagagatttgtttgggctacttgctcgcagtgtgccgatcatggtgtattttgagtttgatgctcaccctgtatcagagtgatttgagtaaactggctagtgctag

SEQ ID NO: 483793 - DNA, 142 bp, Homo sapiens
agtgctatgcccgcgctaccgctggatatcgcgccggatcggtgtcgaatttggccttgcattccggtgctgcaaaacaagtacgtgttccccaagtgcgtggagcggtgctccgacgccgccgtgaccgccatgccacaca

SEQ ID NO: 483794 - DNA, 806 bp, Homo sapiens
gactggccgcgcgatggacccgctgcccgcggctgcagtctggggcggcagcttgaggcggaggctgacgaggaggcggatcccccggcgtcagatctgccgacacccaggccatcgagccccagtgcatcgtgcagcaggtcccagcccccagtcgaatgcagatgccgcaggggaacccgctgcatgctgtcccataccctgcaggagctggctggccagggacaccgtgcaggtggagctcattccggagacgaagggcctcttccttgaagcatgtggcgtatgaggttccagccagcgcttcaagtcctcgggtatacagacggtacaattgactttcgtgggtcttcccaggagatgctccgtgcacaagttccccataccgtatggtggcctgcccttgccaaccaagagcaatgctgggagctgacaggggagttcatcgaggccaggaggaagagccctgaagcgcttccgtcgaactgtgtggacgcagacaaccccctgttctccgaggatggtgggtcctcaaggctcttcctgtcctttcagcgggctcggatgttgaaggaagcaagtccacaggaagtcaggaacagtgcgtcagggggaccgaaattccttgaacttgtaagcttggtaccaagggcaatggaattcatcccaggtttgacatccagggctcacgtttgccataatgcgtgtaagtgatctgggaacatctacaaatagctttaaaaagacttgagaaagggccgagaggaatcgagtcggggacatggaaagttgtgagatttctcatt

SEQ ID NO: 483795 - DNA, 995 bp, Homo sapiens
  misc_feature (89)..(89): n is a, c, g, or t
  misc_feature (933)..(933): n is a, c, g, or t
ggcggggcgcgtggctcacgcttgtaatcccagcacttggggaggccgagggggggggatcacgaggtcatgagatcgagaccatctgntaaacgggtgaacccggtctctataacacttacaaaaaaatttagccgggcgtgatggcgggccgctttgttagtccacagatactcaggaggcttgagggcagcgagattggctgtgacccccggggagccgaaggtttgccggttgacgcccggagactccggccacccaatttggccacctcccagttgtggggccaccaaggaggtggagaattccgggtcctcaaaaaacactatcagatggcaacagcggggacgacacaaacatgtggctattaatataccctttagttcctgtgtgtcatcacgggggcttggtgaaaatttttgtggaaccacttcaaaatttgcagggtgggaatatatttcaaaaaacagaaggtttatataccggttttaacacatatagttttacacgttctgtaatatgaggaaagaagaggatattcatttaaacaagaggcctgcaggggaaatattatacttttcctaacgagcaggttaccaatttcaggttgacggctacatatttaaccccacgttatgtgtccctcttaggttggacgacacacgttagggcttattttcaaattggtgtggtatacagccctcagggtgcctaacgtttgctgtcgccaataaaattctcgggagaaattaccttggatgtgtaaaacccattcgggttgtggtttacaattggccaagaattttacaagaggactggtattatatggtacattcctggaccattattactttaagattggatcctccaagtattagctgcggggggtggactagatcactatcgtctccaattttattaactctcaattantggttgtgttacaagctcttcctttcttcaagcgtacttttcacacactcgtgcgtctctcc

SEQ ID NO: 483796 - DNA, 377 bp, Homo sapiens
aaattaacatattcatcatcttacagttacctgttttcctccctgtggcaagagcaaaaatcctgactatagcaaactcttattaaaagtcctcatggctgggtgcgggctcatatctgtaatcctagcactttgggaggccgaggcaggctgatcacttgagcccaggaggtccaaacctagcttgggcaacgtggcggaaccccgtctctacaaaaaatacaaaaattaccttgcatgttggcatgcgactgtagtcccagcaacttgggaggctgaggtgggaggatcgcttgggcctaggtggatgaggctgcagtgagttttgattaagccactgtgctctagcctgggcaatagagggagaccctgttgct

SEQ ID NO: 483797 - DNA, 132 bp, Homo sapiens
ggttaatgcgggccctggctcgcaggtcagcctgctgcggccacctgagccgagttggaaatcctacggtagggccctatgtcactgaggccacccgagtgcagctggtgctgccactcctggtggctgaag

SEQ ID NO: 483798 - DNA, 802 bp, Homo sapiens
  misc_feature (484)..(484): n is a, c, g, or t
tggaaaaagtcagggaggccagggggtgggcttgaaaccagcttgggggggtctcgatccctccctttttggtctaaatttaatgtaatacgggttcttcgaatgtgtggtaggggtggggggcactccattattagcctcacctccgaggggttaagtgggagggttcttctctacttatttaggacttttctcgctctcgaaagcgaaaggcttcctcaaatctcagtgaaaaattattaaatatatacgtgcgtgtatagaagaaaagtgcaatgtgagccctctacagacatgtgatatgaggagtgtgttctacagtggtgagtgtgtgtatgtgcatctgcggggaaatagactccgcagtataagcggctgcggggagacatatctcgcggatatcaggcccgagaaacgagtgtgtttgtgggtgggagaaacacacaggctctagacattctactacgcgcccccgcgagatganaattctagttgacaaatgagggtggaaaagagggtgggaatattttgagcggcgcgtaaagagggcgtgggagcgcccccaagtaggggggtttgtattacccccttgtggaaaaacattctaggggggggaacacatcttcacgtgtggaaatgttgagagggccctctccctataatgtagaagtgggggcgaaaaatcatccaagggcgcctccccaataatgttgggcatctaagggggaaccatatatgtggcgcggaaataggggtggagcgctatcaccacaccggttaagacacccggagtgtctccagg

SEQ ID NO: 483799 - DNA, 137 bp, Homo sapiens
ctgtgttgtggcgggatttgtgtgaagggagtcgataggggacacattgatgttgctgccgtagcagcgcaggcaaataagtcagcaccccgctctgcaataccacggacccatgagggacaccctggaacagggcc

SEQ ID NO: 483800 - DNA, 84 bp, Homo sapiens
  misc_feature (44)..(44): n is a, c, g, or t
tttaggtagagctggagacgctgccgggggacggggccccccantgcttgttggggcccagggctgctgttcgctatatgatgc

SEQ ID NO: 483801 - DNA, 408 bp, Homo sapiens
  misc_feature (171)..(171): n is a, c, g, or t
  misc_feature (311)..(311): n is a, c, g, or t
gtggtatgaggtatcaatgaaatacatttaagatgtacattggtttgtttcagaaaggcgagacaagtcaaagcggggacttccaggctataggtaaatttatacatttcctggttaagattggttgagtttgtctaaggacctgggatcaacagagaggaaatgtttggnttaagacaaggattgtggagaccaaagttttactacgcagaggaagctcttagctagcaggcataagacagaagaggctgtaaaatgttttcttatgagactgaaaagggtgcctgactcttaattgattatctcctggntctggaaagaaaaaaaaaagggaatggccaggtgcggtggctcaggacgggtctggtggctcacacctgtaatctttcttaaaacgttatgaagttc

SEQ ID NO: 483802 - DNA, 458 bp, Homo sapiens
  misc_feature (30)..(30): n is a, c, g, or t
  misc_feature (289)..(289): n is a, c, g, or t
  misc_feature (297)..(297): n is a, c, g, or t
  misc_feature (303)..(303): n is a, c, g, or t
  misc_feature (315)..(315): n is a, c, g, or t
  misc_feature (324)..(324): n is a, c, g, or t
  misc_feature (336)..(336): n is a, c, g, or t
  misc_feature (343)..(343): n is a, c, g, or t
tgtgatgtccctgaagtgttcatctaaaanagctgacctcatagaagtagcgagtagattgatggtgaacaggggctgaggagcagatgtgtagaggggtggcagagggaagaaatgggggggttgttggtcaaaggaccaaagtctcagttggaaaggatgaagaggttttgacatctagtgcaccgtagggtaaccagagtcaatgggaatgtattgcctatggcaaaacacctgagagagtccatgtcgaatcctggcattcagaatggagaaaacaaagccctgnagttcaanaacatnaaaaacctgggnacaaattgnaccatgtgtagnactccanacagctgtgggtgagaaccgggcaagatgacgacgctgccatgtgcccaatacacctggcccagaggcattcagcagaggacggaggtgtacaaactgctaccagggtcaatgaa

SEQ ID NO: 483803 - DNA, 112 bp, Homo sapiens
gtactgagaggcagaggttgcagtgagccaggaacacgccactgcactccagccgggggcggacaagagtgaaacgtctgtctcagtaccaagaaaaaaaatgttcatatat

SEQ ID NO: 483804 - DNA, 209 bp, Homo sapiens
ccattcccttaccgtctcatctcccttaccgtcactcatctccctataccgtactcatctcccttaccctcctcatctcccttaccgtctggcattaagcctgtaaaatataaattagcaatacaatattacagtggatctagggtatctacagacagtctatgcaaagcggaactgtggtaacactggaggacagagagaggccctgg

SEQ ID NO: 483805 - DNA, 511 bp, Homo sapiens
gtgcccgccgccgattcccaggcgctctctctcttgcgtcgcgcccctccgcccggcgcgacacggggccctcgtgtcgtccgagttctcccggggctctgtccccccccgggcctgccgaggcttcttttggcgatgttttccaggcccgtttcgctggatttctcctcacccccggggcccagttctggcccctccccccctggccccggttttcccggcccccctcctcccccccggggggggcctttcttcaaccctaaaccaaagaaccccccagcccttgctgtcccccctactccggggcctggaagttaaagtgggggggagcgggtgaaccccagaaagcagaaccccttttgtttttcccccccccggggtttggggggggggcccctataagaactcgcccgggggggtttatcccccccggcccaattctttttttaaactttttagaataatttaaaatttccaaaaagtggcaaaaataaaaccccgtaaactttta

SEQ ID NO: 483806 - DNA, 419 bp, Homo sapiens
aattcgctacggttaagtatagcattgtccttcaaccagtcaaaagaattgggggctaagaccgaccagcagcaacccgctcaaaatggagggataaaccaaacctggtggggggaaaccccgaaaaaaagccgggaaataccactccaaaagcggaaaaggggggggcccctaaaagaagccttgggaatggggaagaagaccgtaggaataactaaaagcgggggaactggggaacggcctgggggcccttggaccggcgggcctaagcacagttcccgggccggaaaggcgcaagggccgtggaacccccggagagtgaagggggagcgcctgggtgggaagcgccaggcgggaaaagctcgcgagggaagcgcgcgaaaaaaacgcggcaaaagagagcacgaggccccaagggc

SEQ ID NO: 483807 - DNA, 244 bp, Homo sapiens
gcggcctgctgaatattgagtgaagacataaaaaagaaatgctataaaacaataatttagctacagtattgtttaatatcaaaactcaccagataatccaattttaaatgaaattgatggaaaaatgcttcccctaacgtgaactatggttagatagcattgtctgtcaggaaatatcacgaaatgcagaaataacattaatgtaggaaacaaaaataaggatttgtccttattcataagtaca

SEQ ID NO: 483808 - DNA, 549 bp, Homo sapiens
  misc_feature (107)..(107): n is a, c, g, or t
tttgaatctttcttttcacaaattggacgctgtaatacccataacattgttgtatctaactaaataaatgactgcgtatacacacataccctcaattctcttgcttncccatatttctttttcatacccctgtgctcaggacttatatatttcagtgttgagctttggtttgtgcctatatcactggtataggaaatctcctgagaggaatgactagtgaccccactctccaaatgtctaagttagtagttaccgctgattttttatgatgcctaattggcatgtggagcctctgaagttgtgataagcttgtacattaatttccgatgtcattctaaagaatgaggggtgtgagggatttatagttagaaacgacagtgcaggaaggagtattttcttgttggtcagggctggaatgaatcactgctgctccagtccaaggttcttgaatatccttagtttttgcatttaccctccttttcctttgacctttatttatttaattatgtatacacttatatatttatatacttttgctccggatcagcg

SEQ ID NO: 483809 - DNA, 1075 bp, Homo sapiens
ggtcagtgatttcagcaggtcctcagactagtgctgagtctctggggtactgggcagagctgtggctcgaattcccaggagttcgaggtggtgggactcaccagtctggccagggtgcctgtttgagcatacacatgtgtcgtgagagggccggtagatgtttgcatccagactcgaaaagctttggagccgtttgggattctgtacgagtgaatcacgagagccctaaaaacgagtatcgccgatctgttcatgcgcctggcttggcttcagacccgtactcaggctagcgtgagtcattggtcctataacggtcgatcgtacttgacggaaggttcctgaagcttcctcttgggtagcttgacacgatagaacgttgacagggctacaagaaggaccgcggaaagctgtctcttgcgtccttaatgaaacttactggcctggaactgactatcaaagaggtctatgcctctcagccgaactgagagctggcgaaatgggctgtactgagaagagcgcggtcggacgtagtccaagcagcatggggcccgtgcaatcactcctagtaatgaggataatgcgtatcatcatagggccttcagaaaaacattgccgtggaagttcactcgtgcttctacatgtaagggcaagctgagacattacagaagcttgcgtcctgcgtgggagcactggtggcgacagttgtctggcattttggactggacacagttgcattacccggacagttgcagatcgaaattgtacgggcaacttgggctgtaaagacaggttcacccctcaacgagtaaactaacaaatcttacacgatgcgacaaggactgccttcaatccacagaatccacacggagcaacttctggacaaaggcacagaggaatccagcaaagaagcccaatccaggagcgaacaacggaaggaaggaatccatcggcagagagcactacaagaaagaacgcacactgagaaaacctggagacaccaaggcggaagcgtcaaaccccataactgcaaagacgcaagcgcagggacagcagtactcgaagggcccggaaacca

SEQ ID NO: 483810 - DNA, 273 bp, Homo sapiens
  misc_feature (248)..(248): n is a, c, g, or t
gtcgctctagaggtcccacgtagccactgattagaaaagggaaatgaaatgaagatattttcttagtacaagtgcatacatcgcacaaacatgtttttaacaaaagaaggaaatactcatgatagttccagtcctcatttctgcagctggtcaggtggttgtagctggtattgataactactttattccactattcattctgtattccctttgccttcagaaagcacctcagcaggttgtgccccaanggggtgggctcaggagcccgtgcag

SEQ ID NO: 483811 - DNA, 650 bp, Homo sapiens
gtgaatgtgcctgtgtgtgtgtgtgtgtgtgtgtgtgtgtgtacatgtagcgcgtgtgcagtgaggagagagagactgaacagagagtactgtgctgctaacgaatccatctgggactaaattctgacggaggcctcagtttccccagtgttgtgcagggagtaggtcagacagggttcttcagtgtctagtatgttagctggattagattttcctctaaaatcttaccggcagatgctgaatccataaagccaaggagtgctgagggctggagtgggtgggccctctctcccacaggccccagggagatacatctggagctcctgggactctggattaagacaacgtcgtgctgatgaaagaggacggagtgctcacgccactcgtgacccggggagagtgtcccgagtctggttgtggtctggtgtgctcctagaaggggatgtggcccagacgtggggactcatagacagagagatgaagtaggggaggggatgtcctccacgcggtgatctctctcctggaggactggatatgctttacactagggtggtgggcagccctgacaccctcatcccctcctcagccaggagctctagagcaggtggtgctctcttgatggcaggaatccagaatgttgccttcccaaa

SEQ ID NO: 483812 - DNA, 637 bp, Homo sapiens
agcgggggggcgggcgcctgtagtcccagctactcgggaggctgaggcaggagaattgcttgaacccaggaggcgggggttgcagtgagctgagatcatgccactgcattctggcctgggtgacagaatgagactctgtctcaaatagtaaaaaaaagccaagaaaccagaaaacaaccaagcaaagtctgagaaactgtcacagcctagaggaacctggagacagctgatccctaaatgtcacgtgggatcctgggctggggctcctggcgagagcacaagcaagcacattggcagggaacactggaggcaacactactgcacactacaagctactgcgcgctcttagggcttaactaaaacaaacacagtgaacagcacaagaggaaccacacacaagaaaaacgtgtctcccaggcgcgcgggacccccggcgcccaatagaggcgccctagaactccccttccgaagggagggacccccgatatacacacccactttgtgcgaatccccttttagagtgaaacggcgttaaattaccaaacatctttgggccttcaaacacctgtggtacctattacgctgttaccccccgtcagtctaaccatgtggtaatccggctcacaaaattttgcca

SEQ ID NO: 483813 - DNA, 225 bp, Homo sapiens
cagaggacctgacactgaaacgtaagacgtcccagataagtttaatataaggcagacactctcaaggtcgcgcagacgggacaagacctcaaagaggagcatccggtgggtcgcactacactcgcccctttcctttaatcactcgtgcgtgtttacagaaccgtgggcgttgctgacacccttcagacagtcagcgaatgacgctcatcaacgctctatcgtgta

SEQ ID NO: 483814 - DNA, 346 bp, Homo sapiens
  misc_feature (288)..(288): n is a, c, g, or t
gtcgaccaaagctttagcagaaaaacactagctagaaatttgttaaagagtccttctccaccatgacaatgctcctgctcattcctgtcatcaaacaagggcaatttttaaagagtttcaatggaaaatcaatatagtcctgatttggctccttctgacttctttttgtttcctaatctttttgtttgtttgtttttgagatagtgtcttgctctgtcacacaggctggagtgcagtggggtttggtatcttggggtcactgcgaccttgacctctggggctcaaggnaagatcctacctcagcctcccaagtagctaggactacaaggtgtgccaccatgcctgg

SEQ ID NO: 483815 - DNA, 133 bp, Homo sapiens
tactacactgaattcacctcctctgaaaaagatgagtatgcctgccgtgtgaagcatgtgactttgtcacagcccaagatagttaagtgggggtgaattcagtgtagtacaagagatagaaagaccagtcctt

SEQ ID NO: 483816 - DNA, 523 bp, Homo sapiens
ccatgcagcgggcttcatgaacagtggcctgcccactacataggcacgggtctccagccgtggggtcagggtggcgatagacgtgagtgtcattaagggctccacaaatatctgggcatatagagcatgcttggctgatgggaagattccagtcagtgcatccacaggacgagactgctgatttggcggaacagaatccaaaggaatttgacgaagtcaccaaactccagcaaattccacacctgcaatctatccagagttgtgccaagacagggcaggagataaggagatagataaaactttgaatccatcagggaagtaagaggctaaatcctctcccccaaaacaaaaagcaaaccgatatttaggtgattggggaaaacattcagtcatgagcagcctctaggagctgttctgagaggccaaaatccctgccccattgcccccagctggcagggtggggttggttttctccaggaggcggccagggaataacctttaatttgatggaagcgtcgcgcat

SEQ ID NO: 483817 - DNA, 416 bp, Homo sapiens
  misc_feature (222)..(222): n is a, c, g, or t
  misc_feature (325)..(325): n is a, c, g, or t
  misc_feature (372)..(372): n is a, c, g, or t
  misc_feature (409)..(409): n is a, c, g, or t
aaaccttgcagaaggcctgggtaaccacagctcagctacattccctcctaccttcaggctactgagaatgcaggtccacgccagccgactctgaaagactagagctagtttacaaacactagtaatagagtgagttcccacctattgttccatagtaaaaatccccattttttcctctccgtatggcataccacacctgtgatcccagaactccagagtcangtaagaccttgtctcacccgtgcagcaagcaaaatcacggatgacaagatgaacaagcaaaaggaacttgtccctccacgtgggcaggaaaggaacaaaaggngctttgtttgagcagcctgggtttgtcgaattttacgggttttaggnattctccttaattaccggggaactggcaaagttcatnaatgggg

SEQ ID NO: 483818 - DNA, 455 bp, Homo sapiens
gggaacaagtgtgacatggacgacaagagagttgtaccgaaaggcaaaggagaacagattgcaagggagcatggtattaggttttttgagactagtgcaaaagcaaatataaacatcgaaaaggcgttcctcacattagctgaagacatcctccgaaagacccctgtaaaagaacccaacagtgaaaacgtagatatcagcagtggaggaggcgtgacgggctggaagagcaagtgctgctgagtgctctcctgtccatctgctgccatccaccatccggttctcttcttgctgcaaaataaaacactctgtccatttttaactctaaacagatatttttgtttctcatcttaactattcaatccacctattttatttgttctttcatctgtgactgcttgcggactattataattttcttcaaacaaacaaacaaaaatgtatagagaaaaaaa

SEQ ID NO: 483819 - DNA, 373 bp, Homo sapiens
caatttggaatttaaaaaggtaacccattttaacttaagttaatccaaaagcggccggaaaaccggtggactgaaaccggcctggggttgggggcccttgggggacccgttgttttttgggaaaggggggacctgaagggacattttttcaacatttaacccaagtggggtaaatacttaaggtttgtttccaaaacccagaaggttttccgggaccacaggtttaacacctttttggattcaaagttggaatggaattaatagttaaggggaatcgggaacttggctggtggaataaggcactttaaaccagggaaccgtttaaggccagcatgggggttaatgcctgaaatccaagcatttgggaaggtta

SEQ ID NO: 483820 - DNA, 1322 bp, Homo sapiens
agcaggtgtcagtgactcaatgacaccaccccctccaggtggctggggcccagtgagcctctccctgctacagggggtgggggtcctgctcagcagtggctaggtaggtggtttaaggtcttgtcaccctcactcagctgtgaactgcctctgtggagctttggctgtctgtgactaacaggtgacgctggattgctcagtgtcagctgctcggtggctcccagtgctggtcgtgtgccttagccacaggcacgtggctgtcaataacccccttacctcactggccaccaaccatgacactcatgcacctagctgacccgcgctgtgtccacgcacgtggccgtcggcccctggcgtgaacgggcttatgatccctaaagaatgtgacccacccgcccatcctcattggcgtcctccaccggggccacaagcccctggacccctgtccctctatgctaaccccatgtggcttgctcccacaggtgccccactgacatgcccacatacgcgacgacgccgtgttgggccactgcgaccccaccaaaaacatagttcccttgttccttaggtccttcccttccccggaagctcatctgtgccttctgcctagaccttcccaacgccttctgcaacaagggagtgcccacctcgcgcccacgtcaatccccattcgcgctgctaacgattctcccacgaagcgaattgcccaacagccagaccttttggctagttacttccccaaccacgaccctgctgcctttctccttgacccccacgctccccggggtgctatcaccgcgcgaccattgcttcccggaatcccctccttgggaccagcaccactcctcaagcctgctccaacttcgtttcccacccactacaccgtgtggcttgttatgcccagctcttccgaccttaggctcctccacgactttcaccctcgccagaagctcctccgtcactgttagctcagcgttttcacaaaccgcggcctcctccatacattcccactccactgggccccttctgggctatcacgcgcgggtccaagacttatcatcggtccggcacaacgcttcgcccttaccgcacactgtcccagcgctcatgcgcacacacaagaccgcgtgctagacgaccgccgcttcccataggtcaggcacccgcccattcacaacgccacatctcccttctcgcatccgcctgtggccacactcggatccacacacgacgcgatcgcccttctcctgccacgttgcgacacccccaaccgccccacgtgctgtcactcaactttcctcatcgcttcgctcttaatctcg

SEQ ID NO: 483821 - DNA, 863 bp, Homo sapiens
caaaaacgaaacgaagaacagcggagacaagacaaagtttatcagcgtatcgtggccaaaggacccgtacagcctgtcccacacggttctccaaggccctgggcacgttcggccctggcaacagggcccaagctgcgaacagacctgagcactttgggcagaaagaacaacactcagggcggacaaggcaacgcacccaaaggggtcaccacagtggggcaccccagagatcacgcacgaacacatgggcctgtgcccagtgcccctaacttgggcagaactcccctggctaaccattctttgggcaccccgcctgggcgaaaaagtcatccactttcatcgctcctggcagttaccccaaggaaaggtctttaatgatttgcccggggaccatttatactaggcccgcactctggtcacagcatcaaatgatgccctcagctactgacccgttttgtacgcatagcggatgaaccccatgggggggccttgtccccacacaaatgaaacgcagcccaaggaagtggggtgcacatctcgaccagtcgttctcgcgggacaccacaaccggggggttacaccctacgagacagcgtccttttcggtctcacaacgcacaaggctgggtcattggcagacagttgtacccctcaggttgcctggcgacgccccccccacacgttgggcccattgcaccctttccgaaccctctgtccagaggtaacaacacacttcctctggggcccccttacacgaaggacacccacttcgcgacaggagacatgtggtgtgtaacgcaccgcgaccaaattttccatcttgggcgggcgttccaaaaaaagtaattttccccccacataaca

SEQ ID NO: 483822 - DNA, 471 bp, Homo sapiens
  misc_feature (25)..(25): n is a, c, g, or t
  misc_feature (28)..(28): n is a, c, g, or t
  misc_feature (35)..(35): n is a, c, g, or t
  misc_feature (43)..(44): n is a, c, g, or t
  misc_feature (57)..(58): n is a, c, g, or t
  misc_feature (61)..(61): n is a, c, g, or t
  misc_feature (337)..(337): n is a, c, g, or t
atccccgcaggcggacattgtcgcnccnacagggntgtcgcanncgccgtgacaggnntcntccagatcaaaaattaccaaagccatcagtcacgctctctcaaataaatcgtgcgtcaggctacttcacacaacgcacttgggtcgatggaaagtgccaatcgcagaccgtccgggtgcaaatcgtcggccgaacggttgagtacatcgaccaccagttccaccccacgggcttcgatgcggtagcgaatcacattgcccaacaggctgtggctgcgcaccagcgcgtccagttcgccgctgcggctgagctcgatggcttccgggcgaatggcgntgcgcccgttgatcgggcgctgcaacagtttgctggccttgtcggcgtccagcaggttgtagttgccgataaacccggcgggcaagctgttcaacgctgccaagcacaagcatcagcagcagttccagggtacc

SEQ ID NO: 483823 - DNA, 167 bp, Homo sapiens
tgtacgacgtaagcagtggatgtactaggggaatgtaaaactgcaaacttaaaaactgcatcttcttgaagcatcagttttactttaccaaatggtttagagtcataagagtgacctattttatataaaaagttatattatagaataaaatgttcatacgcatagac

SEQ ID NO: 483824 - DNA, 418 bp, Homo sapiens
  misc_feature (93)..(93): n is a, c, g, or t
  misc_feature (164)..(164): n is a, c, g, or t
tcaccatattctcaaggctctcagggtccctttttcttggcaaccgttccagtccattgcgagggacctttggtgttcacccgtggcatttantagggagcttgggtccttaaccagaaccttttttggccaggattagagaatacaaatctaagcgccagacnatctggaggacctgttgatgctagttcaaagtatcaccaaaagctggaaagggagctttttaagctcaagcaaatgtttggtaatgcagacatgaaaacctttccccccttcaaatttgaagatccccaatttgaagtcctcgaaaaacccccggcctgaaaaaataaagtaaaattaatttggtaatttgtcccggattagttggccaactagttaaaagtttcagaataaacatgcctttcataactgtcca

SEQ ID NO: 483825 - DNA, 415 bp, Homo sapiens
catctagcgatcctatccccggctctgggtattacccaaaggataagaagtcattataccagaaagacacttgatggcagtacaagtcacaattgcaaagatgtggacaccaacccatcaaccagtgagtggataaataaaatgtgtatctctacaccatggaatatgacttagcaataaaaaagaacaaaataatgtttgtggttttttttttttggcagcaatttgggatggcgctggaggatattatcctaggtgaggcacttcaggattgtaaacccaaattctgtgtgtccccctttataggtgagagctaatttatggttccaaaaggttatccagagtgccttattgccccctagagcctcaaagtggggagggtaagagggggccaaggtataaaaacccccttttt

SEQ ID NO: 483826 - DNA, 208 bp, Homo sapiens
  misc_feature (29)..(31): n is a, c, g, or t
atagcattttcttggggactttctagtcnnnagagctctctccatactggacctgcagccgggcgccccagtggagggcagccccgcactccgtggtccttggtctggaacctcggtgctgcccagggctggaggggagctgcttgcagagtctgagcctggcaccctgcactgagctatggaggcggctgagaggcctggggcgccg

SEQ ID NO: 483827 - DNA, 170 bp, Homo sapiens
gacgttcggcgcaccgtgcgtcgctgcgcccacgacctgcaccgcccgttgtgcggcggcctggttgtcgccgtactgcaccaccgccggtttgcggccggctttctccttggcctcgttccacgcccgcaggactttttcctggttggtgccggcgccgacgctgctct

SEQ ID NO: 483828 - DNA, 359 bp, Homo sapiens
aaaaaaaagggtccaagggggttggggggggggaaaaaaccccccctgggccctaaaccccccaaaaaggtttttttatcccccccctttttttctccccaaaaaaaaaggacccccccggctttgggaaggggggtaattcccccacaggggtttgggccggcccccaagggaagggggaccccccccccttttttttggaaaatttccttttttccctttgggggggggtccccccccccccccttgggtttggtttttccccccatttggaatttttttttgggggggacccgggggtttttttttaattgaaaaaaaggcctcgcccccaaagcccaaaaaaaatgggggttgga

SEQ ID NO: 483829 - DNA, 288 bp, Homo sapiens
ttggtcactatgtgttaaaatgtgatggtaccttctcccattatacgtagagtttggcacgaggatatgaaaaacagttttctatctttgctttggactagtggtgttgttccttaagatacgaagtcacagactattagatattatctcacattacctcctcattttacatactgcaaaataaaggctcaagtgattttcttgccccaggtttcactggaaatgcaaactagactaagaaacaaattcaacactaggtcggccgtggtgactcacgcctgtaatccc

SEQ ID NO: 483830 - DNA, 1096 bp, Homo sapiens
taaacatagtattgagactctcgctacgatctgatagtaatttaacctaccagactcatcttggtcgcccatgtaggacagcaaagagactcctggtgtggcgcgcccgaaggtggtatacttcctaacaatgacacctcctaacatgcactgctaaggtgcgctgctatgagtgcaagtaatgtgtggcctcattgtggtgcatgctgacttgcgttgcgtcagcctgcctactgcatgccggggtgcctcagtcctcgttggtgacgtgctgcacagtgctcccgagagactaatactcgagtgcataaggactccaggtatcactagaccataaagctactgaccacctagtaaagactgatactcgtggcggggcagtcattattagggacacattggtactactctggtactcttggatgcacatgactaccttggctgccatagatgaaggccctggcctaacttgtacgtgacagtctccacgtactccactgcaagacggtttcattcctgagcccactctgagtctactttcgcttggctccatggctgatggatgcagaatcacatatggacttacaacggagcatacaagggtcgtctagacctctgtgaggaaacaaagggctctgctggcgaacagtagaaatggtggggtcagcacgaccattgggcagtgaatggggcaagagagtccatcaatgctgagttggagctacccagtaatccccctcagtcttgtgtgcctgtgtactggtgttcttcctggacctccactccgtgttcgaggggctggccggtaggctgtagtgagaaccgggctcgggccatggagctgtgctcgggttttgctgctcaccagggcattctggtgataggctgtctctgcggatgtggagaagcacttaggcacaagttggtggtgctgaggaatctacttttcatgcttaagcttaggattggtggtgccgtcggaaatggaggaccttagaccatgcgaagtggttaaagatgcatgaaccttagaaacaaggaactgccgagtcggttagaaagacgggagaaaccaaaacgacagagatataaaaga

SEQ ID NO: 483831 - DNA, 181 bp, Homo sapiens
agtcgacggaagcagacctgaggttattgagccaataatgacgtgaagtccgtggaagcctgtggctccaaagaatattagccgtagatgccgtcggagaatggtgaagggagactcgaagtactctgaggcttgtagttagggtaaaatacgagacccacgtaaaatttgtaataacgca

SEQ ID NO: 483832 - DNA, 474 bp, Homo sapiens
  misc_feature (144)..(144): n is a, c, g, or t
gggactttgggtgaggcggttcagccatgaggctgggtgtgcttttctcgggggccctgctggggctactggcatgcccagtgggcacagggaatgactgtcctcactaaagaaatcaggtacttggctgtcatccttcacggntgacacctcagcggttacagagcagcactggaacgaaccagtccacaggactagcaagagccacaaaatcatcacgtcacaggactgacacaccgacaggcaccaccagcgacggacccatgattgccactctacaagccgcaccatccacgagccatggaaacgtcacgagttcatccaactaagcaatagcactgacagcagccagggaccctcaatctgccattcatagtcctgcgcaccactagtcttggaaatgccacggttcatccaataagcatcatgcactgtcagcaggcgaggattcatcagtttctgcccagccagaac

SEQ ID NO: 483833 - DNA, 1151 bp, Homo sapiens
gacggacgtgcggacagcccgcggggaggatgtgcacagagggcccaggaggagcctcaggagccggactgacgttggtcaaccgagtcccagggagactcttaagggaaattaaactgcagagtgcaagagatgcctcagtcaagtcgagacaagaaacacggcgggttcatccccaagccccagagagtgactagagcccaccgatgacacggacaccgtcggctgtgtgtcacttcaccatgggttctgggcctcccgacgaggcgtctgagattgacaggcgatgtgcctcagacattagcatccattgttctgtctttcctgggcaagttattcatccatggtggccagccgcagcgacgaaactggatttaggatctactggagctgcatcccagaagttattgctgcaattgagcaaagccaaactgaacatcggtaaaggaggttcaacacagtttgtctggaccagacttgaagagactgaccaagctctcacagaacccgaggtctgagcacttgctgacagaccggccatccttacacttgcgggggaagcagcatacattacacagaatgcagctgaaccagacaagaaggggagcaggtaaccacacgcagacaacagcgactgagcctgggctagacccagggatagaatggacgcgattggatacagtggatagggcatgcacactggaaggcatcactgagcatgggcggagacgcaaactcggcagggaacgaccagatggagctgaagcatctacactgcatgagaaatcacgcggaacaagaggagggccatgacggtcgaagccaggcgaaaatctgctacggaggcaaggccatcccgaccaaggcacttacagcagctcagagcacaggaagcgaggtgacaatacagtacaaggacaactgatcaccagcaccaatggcacaggaactcacagacaggacgaagtgccacttacgcgggaccaaacagggcaggaagcgcaaagacaaaacaagagaaccacagagaaacaacgtaaagcacagggacagagggaaaaaatggacgagaaagacaaggtaaagagaaaacaaaacaagaagaacaaaaaaacaaaaacgaaactgcacaaaagaacagaacgaaacaa

SEQ ID NO: 483834 - DNA, 1962 bp, Homo sapiens
ttgcttgctgcttctccttctctccctctcgctgtcttgggtctgctcgactcagtgccggtcttcgatcgtctcctcccttctgctggcactgtcgtctgctgcatcgtcacgcgagtcctgtacattgctttgctctgcttccgtggctctgttcctctcggtgtcgtcgcgtgatcttatatcactatagcatatcttcaccgttttcatctcgtggcttcattcgtgttctgggtgcctcatggactggctcatgcttgagagtgagtggacgtccacgtgccctgctttcatcgctggtagctccctgtagtgctatcacgtctgtccctcccttgtgtgctttcaactgatgacgcactggcgagtgccgtgtacttgctcatatcatttgctgcttaggtgggtccccatactgggtgtgcgtcgctccgtgccttgctacttgtggtggcgcgagtcgtgtggacgctcgttgggtgtgactgtgtgtcgtgtggactaattgacgtgggtgttacatcgtggttcgttgcttagtaattgctcgtggcgtcttgtgcttatattctctcttgtgttgagctaggttggtcggggctcgcttgtgttgcctttcattgtcgttctctgatctgggtgcatggtttgtggtatcgcgtgtagtccttgttcgtatccgctcgtatacatactaggtcatgggattgcaattacggtataaatgggttgttgttactatatatcgtatgttaagttggaagtccttgctggccatgatagtgcgtggtatgcctcgcgtctgctacttgtggtttgtatcctctagactgtagaggcgtgtgtacatcgctcgtttccttagaggttcgaatgtgcatctaccatagtatagtattattgaattgggtcatccagagtccgctatggctgctgcagtggtggaaccaatctaggtgcgttgtctaaaatcctggggcctctggcgggtggtgtattcatatcgtaaattcccggttggcctcactatgggtgtattgcaatcatcaatgtcaagtctgtgctgtttggcccctggtgtaagagtgattggggtgaatacatctgtggttgaactggttcatttttggtctgtgcctcaatcacgacgtggtgtgttgttcatatgttgttgcggccttgcgtggtaatactggtagttgtatatgcacatgttggtgtagtattgtgagagcgcttgtgctccactgttggtagatggatggtgtcgggtggccatgtgtataccatcaatggacatatggatccgtatgtattatgatccctcttgttagttgtgatacgtcctgtttgtcataatttttttaagttataaatggtggacctatattaaccattggtaatcgtcgtgataatcctatgatagtccgcacaggcaatgtggttaccctgtatatagtcgtagctcaagatatctctggccaattgtattattatattttgcgtgtgtttggtggtctgtatctctgcaggagtcatagtatatctctctatatctctgctcggagtctaggtatctagtgccttgagatgacctgtctatcctaggtctagatagtctgatactgatcctatatcgtcatatgtgagtcgcaagtaatcttgaccaatctggatatcaatgttacctctagggataatcagcgcaatcctatttctagagtctcatatcaatcaatagggtttacgatcctcgatgttgtgatcatggatcatcccaattggtgcagtccgctattaaaggttcgtttgttcaacgattaaagtcctacgtgatctgagttcagaccggagtaatccaggtcggtttctatctacttcaaattccggcctgtacgaattggatcatagagaaataaggcctacttcacaaagcgcaagtcccccggtaaatgagta

SEQ ID NO: 483835 - DNA, 120 bp, Homo sapiens
  misc_feature (72)..(72): n is a, c, g, or t
gtgggcagtgggcacatttagtaaaccgaaggtgtcagccccccactctcccagcctgggctatgttcaggnctgacaccgtcccggggactaggagaggaaaggcttgtgttagagggg

SEQ ID NO: 483836 - DNA, 391 bp, Homo sapiens
cccaccccgatctccttgaccctttctgcggacaatcgccactgcgtggccactgtacccaatttaacctcttaatgcgttcgttaaccttagtttggacatctcagtttccctctgaagaaatggcaaaatgtgttatggtttagtgatggcccgcagcggtccccacaaacctctcagggtcgcgtcgctgctgtcgtgactgtcaccacccttccgctgagaattcgaggacgtggtgctgtgggtgctgcgagtccccggggcggcaggcgctgcaggaagggccgcctacaatttgtccaggaagttgtccagggcagggatgccttctttcaggcccttgcgcttgcgggtctccgccaccacctggctggggcggctgctgttg

SEQ ID NO: 483837 - DNA, 1073 bp, Homo sapiens
gagtcggcgggcggcaccaagggcagcagccaagaaggcgtcggcggcgcagctgcggatccagcaaggacataaacgacgctgaacctgcccaagcacgtgtgatatcagcttctcagatccagacgacctcctcaacattcaacgctggctcatcatgcatcctgactgcagcggcttcatacaagcagctgcggaagctttgctgcttcacgcttcttaacggctgggaccaagggcttacccacgcactgaatcccaccacacggctgacagctgctgacgagcaaatggctactatcacacccgaacgattgcaacctcgcagaggcacacgatctgacacatccaagcaatccatcatgagcaggcacctggcacagctcagcatcactctaccgacctaacacctcacagtaacgttatactaggaccatgcgaggtagtcgtcgattcattgcgcagcccacataccaccagagagacgccaactgcagcacaacggaacggccagcagcacggctccatgcatgacacaaccctggcaggcatgatcactgcagctagacacagtgccacgccgtcatcacaatgccagagaggcttgggcctaccactcaggcatccagccctaacttatgaagccagctagcactgacaactacgcgcaaggccgcactacaccacaccccatgccacaggcacaacaaagccccctgcgccatcccccgtgccaacactactgtctcatctggacagagagcacacctggacgatcaaggagagctaatcgagcgcacgtagctggatccagagatgaagagagggcacaataccccccttagacacctatggagcacccattatagccccatcaccccacctataacacttgggccccaagtgacttggccccgcccataacggataacaattcaaccagaagtctctctacagttagtacagcaaaacaccaaatagcacagaactactcacaaggcgatcaagaaggcaaacactagtccacttccacgacctcgcgagaaacccaacatcaacctaagagtcatcag

SEQ ID NO: 483838 - DNA, 107 bp, Homo sapiens
tcaatggaagatagatggtcgcgtggccaccgtgcggcctccgcatccgctcaccgtgtccaaacactcgacccaccacttacatttacaccgtgcggctgctcata

SEQ ID NO: 483839 - DNA, 161 bp, Homo sapiens
tgctgtatagagacttgtttaaatttcagaaaatagataaataatataaacatacagcatttttttttttggtcttttgggcctcttctagggacgctcctgcgcagactaatggagctccccaggctaggggtccactcagagcctacaccagagccaca

SEQ ID NO: 483840 - DNA, 143 bp, Homo sapiens
atcgagctcggtacctgtgtgctccatccaccgtgtgctcgggagacaaaaggttattttgaggagattgatttattatataagattaatgggctgggctaggtggctcatgcctgtattcccggcacttggggagcacacag

SEQ ID NO: 483841 - DNA, 227 bp, Homo sapiens
gaggtctgctctaccagacacgaaaccccagatagtacgttctcatcactcttgaacctctcaatcaatgagtaagcaacgtgtgtatcgagtaagaaattaaatttcttttataagacttagcataaaactggtgtgagaacctgggaatacttagtcacaatttggatataaaattatttttaatttgttggcactgaggtaatataatattttctcagtatgat

SEQ ID NO: 483842 - DNA, 1078 bp, Homo sapiens
ggcgcccaagggatggcgatggcgtaccttggctagatcactggcccgattgaagtccgagtcactagtttcccggatagtccagctgcacatgaatagcaacagcaatgagagccagtcagaaggacttgtgaaaattcaagtgaatcaagtgaaacttctgtgaacaaaggctccaggaaaccgaaggtgaagctaaaactctacgcgctattataagcaggccactgaaggaccttgttaacatgcccaaaccaggtgtattggacttgatcaacaaggccaaattgggacgcatggaatgcccttggcaagcctgcccaaaggaagctgccaggcaagaactatgtggactcgggtgtcagttgacgtccttcatgtggaatcctctagtcacggtgacagcctggaaacagaccaggaaattcaccgtgggtttgaaactctgggtgggtgaccttcggaagattggatctacaaagatcatgtcaaccggccacaacacgaaccatgccataaaccctgagatgttcatgacattattgcgtgcccttagaaggtgccaggaaggatgactcaatcatcacgtggtttcaccaggaattggtgtctcttacacgatggggactgatcttgacatcactcccctgatttcccccgggtgttgatctacgaacacgttacatatgcggaccggaagactggggccgcaaagatttcaacccagtgtggggacacgccccgggacttctacccattgaatacaacgagtaattgcaggaccaacaactcgccaccaaccaaggggacttacatcctcgccactgtatttgtttgtgttatcttcaatttattttcttgtttatgtctaagtccgacgatcccgcaccgcccgagttctagcgcacgcacactacccactaccgcaacactagccaccctgacgcccccacacccatccgctcacctccatacccctccctcatccaatccaccactgactccacacctcgatcctagcgctcaccgcacacaccaccgatccacaactcaccaccacaccaagcgatccgctgtt

SEQ ID NO: 483843 - DNA, 3926 bp, Homo sapiens
cccacccagaaggggtgcctctttggggctcattcctgtacctaccaacagcctgacccgcggctcctgttcagctgcccctgagggcagggcctggcaagaaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcaggtgcgctgcgccacacgtgggttcgtgtgcatttgtgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagcactg

SEQ ID NO: 483844 - DNA, 156 bp, Homo sapiens
ctctagcggatcccctgcgtttcatatgcaagtctcaaggtggcagaattggtcagatttatccatatttcctgtattccattttagcactgacagtcaagttgcctacgagtgtgaacaaatactgacatgtaaaggggagttacactcatatgt

SEQ ID NO: 483845 - DNA, 3703 bp, Homo sapiens
  misc_feature (29)..(29): n is a, c, g, or t
  misc_feature (555)..(555): n is a, c, g, or t
cttcctgctctgccaatgcattggcaggnagtcaagttgggggagcaggttgtgtgtgtgaaagaaatttcaaccctcatcttccatagtggacagtcaaaaatgtaataggacataatgaaaactgaaacatcggaaagtattaatctaagcattttttttttaagaaacagagtagaattccaaaagaatccattaagagagttgaaattggttgcctatagggagctggacattgaagagaggttgggttgtggaggactattgtttgcaaaaaccttatagaacaacgactcttttaattgttgatgacagtaaaatgtaaaattaaatttagatataaattaaaaacaaagcaaaagaaggaaaggaggaagagtaaggaagaaaggagggagggagaagaggaggaagaagaggagaaggaagaagagagaggggaaggagggaggcagggagaaagatgaaaagacgatcacgctgtctctgctctggccaggccaactcttgcttgttccagacatcaccctccccaagcatgagcctctcttgggnagagcagctggaagcagagggagctgggagaccagacacaaactcggggctcagcttggggacgggagttgatagtcaggtgcctggaacataatggagaccgtccatattggttgaatgagtggatgaatgaattaatgaatttcttttctcttaagtcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcaggtgcgctgcgccacacgtgggttcgtgtgcatttgtgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagcactg

SEQ ID NO: 483846 - DNA, 317 bp, Homo sapiens
cccctctgtccagatccataagcaccggtcagctcagggttcgtcggaggccagtacggaggcacaagtaccagcagcacagctcctctgaacagagacttgctaggatcatccttctccctccgggcctgtttgctgatggcataatccgggtggcaaccaaaatcttgagctcaagcccaggtgagcttaaaagccactggagccaggacgactttggggccttgcacgcctacaggtgtcaacgacttgtggcaaggtgcaatgtaaggaagtgacctaccccaaggcctctgcccagcaaactgggatctggc

SEQ ID NO: 483847 - DNA, 3308 bp, Homo sapiens
ctctgtgattctcgggtagacagcctgttggaaaatcatgcactgtgcgccgctggggcaagagaagcccagtggccccacgaaggacgcacaccagaggttgcccagccatgtagacaaggggttcgggcgggggaagccttgcaaaagcccaggcagaaaatcgatcagtgacacatctcttctcttctaaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcaggtgcgctgcgccacacgtgggttcgtgtgcatttgtgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagcactg

SEQ ID NO: 483848 - DNA, 2362 bp, Homo sapiens
cacgaggcctggccaccctgccaccatcactctgcagcccgggtcatccagctgcccgcccccagccccgaagcttgtcaggcctggatcagcagggcttctcaccagaggcccgggcatgttcttgttccaggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcaggtgcgctgcgccacacgtgggttcgtgtgcatttgtgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagcactg

SEQ ID NO: 483849 - DNA, 225 bp, Homo sapiens
  misc_feature (8)..(8): n is a, c, g, or t
  misc_feature (186)..(186): n is a, c, g, or t
tcagacanccgttctgcactcacagggactcacacctctttttttttaaggtggagtctcactctgtcacccaggctggagtgcagtggcacaatcttggctcactgcaacctctgactcccaggttcaagtgattctcctgccttggcctcccaaagggctgggatgacaggcgtgagccaccanccctggcccctcatccatctctttattcttgagacctgg

SEQ ID NO: 483850 - DNA, 4181 bp, Homo sapiens
ggggcaggccgtggtcccagttgagaagctgtgctcccttgggtgttttggaggttcagggtgggtgctgaaaagccccgctgggtacagatggttcgggggcctgtctagggcatggcatcccacgtgggtgtcagcacggccgcagaagaaccacttctctggcccacccatgcctgctaggccatgcttcttcagaagtggccacaactctcctgacgtctccagagccggtcattccacccagggggacttcagctgccactggacacttcaattgtacgctgcgaccagttgccaggaaggagagggctggcaagagagccgcggcagccgtggcagggtgtaggggacggtggacggccagggcccccccctctctctctttctctctctctctcttgcttggtttctgtaatgaggaagttctccgcagctcagtttcctttccctcactgagcgcctgaaacaggaagtcagtcagttaagctggtggcagcagccgaggccaccaagaggcaacgggcggcaggttgcagtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcaggtgcgctgcgccacacgtgggttcgtgtgcatttgtgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagcactg

SEQ ID NO: 483851 - DNA, 318 bp, Homo sapiens
ctgctcgctctgaggatccccttccgtctcttacaacataattatactcggcgcagtggctcatgcctgtatcccagcactttgggaggccacggcaggcggatcacgaggtcgcggagcttcgcacacccgtctgcgccaatatggtgaaaccccatctctactaaaaatacaaaaattagctgggtgtggtggtgcacgcctgtagtcccagctacttgagaggctgaggcagaagaatctcttaaacctgggaggtggaggttgcagtgagccaagatggtgtcagcactccagcctgggtgacagagcgagaca

SEQ ID NO: 483852 - DNA, 4043 bp, Homo sapiens
ggggcaggccgtggtcccagttgagaagctgtgctcccttgggtgttttggaggttcagggtgggtgctgaaaagccccgctgggtacagatggttcgggggcctgtctagggcatggcatcccacgtgggtgtcagcacggccgcagaagaaccacttctctggcccacccatgcctgctaggccatgcttcttcagaagtggccacaactctcctgacgtctccagagccggtcattccacccagggggacttcagctgccactggacacttcaattgtacgctgcgaccagttgccaggaaggagagggctggcaagagagccgcggcagccgtggcagggtgtaggggacggtggacggccagggcccccccctctctctctttctctctctctctcttgcttggtttctgtaatgaggaagttctccgcagctcagtttcctttccctcactgagcgcctgaaacaggaagtcagtcagttaagctggtggcagcagccgaggccaccaagaggcaacgggcggcaggttgcagtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcggtaagagcagcaaccccggctgggagcggtggctcacacctgtaatcccagcactttaggaggccgaggcgggcggatcacgagatcaggagatggagaccatcctggctaacacagtgaaaccccgtctctacttaaaaaaatacaaaaaattagccgggtgtggtggcgggtgcctgtagtctcagctacttgggaggctgaggggaaggactgcttgagcccaagaggttgaggcagcagtgagccatgaccgcaccactgcactccagcctgggtgacagagcgagactctgtctctaaaacaaaacaagacaaaacaatttggtgccattcagtaaatttgcaatgttacacgtctctatctagttcagaaacatttgtatcaccccaaagaaagacccagagccattaagcagccatgctcccatgtcttctcccctggacatgtgtcttccctgctctgtccctggctctaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcaggtgcgctgcgccacacgtgggttcgtgtgcatttgtgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagcactg

SEQ ID NO: 483853 - DNA, 181 bp, Homo sapiens
  misc_feature (9)..(9): n is a, c, g, or t
gagctcggnaccccagaacgagattgcgattgtgcgtggtcgagaaattgtgagatacccccgatgcgacgattgatccaccgccagcactaacctccatgacgatggcggtggatcgatccaagggagaccgccgactcaacacccgcgcccaagagcgaaggatgatgcctgattgtcg

SEQ ID NO: 483854 - DNA, 3243 bp, Homo sapiens
ggggcaggccgtggtcccagttgagaagctgtgctcccttgggtgttttggaggttcagggtgggtgctgaaaagccccgctgggtacagatggttcgggggcctgtctagggcatggcatcccacgtgggtgtcagcacggccgcagaagaaccacttctctggcccacccatgcctgctaggccatgcttcttcagaagtggccacaactctcctgacgtctccagagccggtcattccacccagggggacttcagctgccactggacacttcaattgtacgctgcgaccagttgccaggaaggagagggctggcaagagagccgcggcagccgtggcagggtgtaggggacggtggacggccagggcccccccctctctctctttctctctctctctcttgcttggtttctgtaatgaggaagttctccgcagctcagtttcctttccctcactgagcgcctgaaacaggaagtcagtcagttaagctggtggcagcagccgaggccaccaagaggcaacgggcggcaggttgcagtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcaggtgcgctgcgccacacgtgggttcgtgtgcatttgtgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagcactg

SEQ ID NO: 483855 - DNA, 2705 bp, Homo sapiens
ggggcaggccgtggtcccagttgagaagctgtgctcccttgggtgttttggaggttcagggtgggtgctgaaaagccccgctgggtacagatggttcgggggcctgtctagggcatggcatcccacgtgggtgtcagcacggccgcagaagaaccacttctctggcccacccatgcctgctaggccatgcttcttcagaagtggccacaactctcctgacgtctccagagccggtcattccacccagggggacttcagctgccactggacacttcaattgtacgctgcgaccagttgccaggaaggagagggctggcaagagagccgcggcagccgtggcagggtgtaggggacggtggacggccagggcccccccctctctctctttctctctctctctcttgcttggtttctgtaatgaggaagttctccgcagctcagtttcctttccctcactgagcgcctgaaacaggaagtcagtcagttaagctggtggcagcagccgaggccaccaagaggcaacgggcggcaggttgcagtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaatcctcttcatagacaccttccctgccctccatctcctccccgctggtgtctgttcccaaaaggtgaacagaaagtgtcttcatccattaggc

SEQ ID NO: 483856 - DNA, 162 bp, Homo sapiens
tcggtgtagaggatccccccttccccacagtgagtctacgtggtgacgcacgagagggatggcaagaagtacaagctcttctatggaatgagttctgaaatggccatgaaaaagtaagctgggggcgtgcgcgaagtacaggagcctcagacgggaaagaca

SEQ ID NO: 483857 - DNA, 2189 bp, Homo sapiens
ggggcaggccgtggtcccagttgagaagctgtgctcccttgggtgttttggaggttcagggtgggtgctgaaaagccccgctgggtacagatggttcgggggcctgtctagggcatggcatcccacgtgggtgtcagcacggccgcagaagaaccacttctctggcccacccatgcctgctaggccatgcttcttcagaagtggccacaactctcctgacgtctccagagccggtcattccacccagggggacttcagctgccactggacacttcaattgtacgctgcgaccagttgccaggaaggagagggctggcaagagagccgcggcagccgtggcagggtgtaggggacggtggacggccagggcccccccctctctctctttctctctctctctcttgcttggtttctgtaatgaggaagttctccgcagctcagtttcctttccctcactgagcgcctgaaacaggaagtcagtcagttaagctggtggcagcagccgaggccaccaagaggcaacgggcggcaggttgcagtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcaccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcaggtgcgctgcgccacacgtgggttcgtgtgcatttgtgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagcactg

SEQ ID NO: 483858 - DNA, 1766 bp, Homo sapiens
cacgaggcctggccaccctgccaccatcactctgcagcccgggtcatccagctgcccgcccccagccccgaagcttgtcaggcctggatcagcagggcttctcaccagaggcccgggcatgttcttgttccaggaggcagaaaccatcatccagaaaatcaagcagcagcagtacgcagacctcctgtcccacgaccagctgctcacagagaggagggagcagaaggtcttcctacacttcggtaagagcagcaaccccggctgggagcggtggctcacacctgtaatcccagcactttaggaggccgaggcgggcggatcacgagatcaggagatggagaccatcctggctaacacagtgaaaccccgtctctacttaaaaaaatacaaaaaattagccgggtgtggtggcgggtgcctgtagtctcagctacttgggaggctgaggggaaggactgcttgagcccaagaggttgaggcagcagtgagccatgaccgcaccactgcactccagcctgggtgacagagcgagactctgtctctaaaacaaaacaagacaaaacaatttggtgccattcagtaaatttgcaatgttacacgtctctatctagttcagaaacatttgtatcaccccaaagaaagacccagagccattaagcagccatgctcccatgtcttctcccctggacatgtgtcttccctgctctgtccctggctctaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcaggtgcgctgcgccacacgtgggttcgtgtgcatttgtgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagcactg

SEQ ID NO: 483859 - DNA, 203 bp, Homo sapiens
  misc_feature (54)..(54): n is a, c, g, or t
tctctgtttcttacgcacatctctacaaatagggccgccctactgtcactgtanattcatacgattatctttctatacatgataaaattgaaactctgggagcctcggaaggaagcaaatgaagccataagggcaaggccctgatgcaatagaactggtgtccttgtgagaataggaagatgccaggagtgtgacgcacagga

SEQ ID NO: 483860 - DNA, 723 bp, Homo sapiens
  misc_feature (202)..(202): n is a, c, g, or t
gaaggcaccccggtcaacggatgctcgagtccggagcgcctagccctaccggactacgagtatctgggctcaggcgacatgtcctcacctacatggagcgatgcagtgtgcccgctggctaccagaaacaggtaaggatacttagccacactatggcaattcgccaggcttctctcactgcaagtatttttaactagctgtnatgacccagcggtcagacgacgaccagttctcctatgtgcgtagcgaattctagactatcgatcgcagaggccgaccgccccgacgagataggggtatcgattatgttaacgtggccgttgctgggagatgccttccggaacgtgtggggccagagaacactgtgccgatatttgctggacgcatgcacagagaatagtcagctgctattgtctcgcaagttactgtgtcctgatttcccgctggagctcactcataacagcacccaggatagtgctcatggcacgatgccactggagctgcttgatgtcgtttttcaggattgcctctttgccttccagtgtccagttttactactcgagacagttcctggcacagtgctggctgccatctatgaggacctgctgtcaggcatgaaccccgacacagtgattgtgccgacgtcgtccagtgggcagtggcgcgatagcgactgccttgggctggggcctgcgcgctggagggcgtggggcgtgctgtcta

SEQ ID NO: 483861 - DNA, 138 bp, Homo sapiens
agtgctgctgttaagatgtggtctccagaatgccacgagtgtaaacatgctaatgacatggcatgtgatcttctggcttactcagagaaccctgcccaggcagattagtctcagaccatgccaacaccccattgagaa

SEQ ID NO: 483862 - DNA, 101 bp, Homo sapiens
ggggtaggcctgtgcatctgggtgaggtgtgtcacgagctttgttactgccaaactcactcctttttaggaaaaacaaaaaaaaagggcagaaggtcattc

SEQ ID NO: 483863 - DNA, 265 bp, Homo sapiens
cgccccctgggttcgggcagttctcctgcctcagcctcccaagtagctgggattgcaggtatgcgccaccaaacccggctaattttagagatggggtttcaccggtgtgggccaggcgtggtctggaactcctgacctcaggtgatacacccgcctcggcctcccaaagtgctgggcatccaggcgtaagctgctatgctggtgaagtagctggacttctaccttcaacctaggccacgataatcacatactacttgctggcctt

SEQ ID NO: 483864 - DNA, 399 bp, Homo sapiens
ccccactgggtcctgtggtctaagtaccaatgttggctactctctgggtatgaggcaccgtgcgtggcacttgggtgaaggcctgcctcacactgctaatgtggcccggggggcgccaaggcacaattggtgcccggaccattgaggcacttgaagggtagccagcttgtggtgcagacaccacagagagagaaaagttgaatgaagtggtgggaatactcagggtggcacactgtgcctagaagcttccagggccaccaagagaatggaaagggaacctccaacattcacaacagaatataggagtcaattcacttagacccagatctacagaaagggggagtgtaggatatccacaatttcaaagacagctcgtgtctacctagagccacaatgtgc

SEQ ID NO: 483865 - DNA, 301 bp, Homo sapiens
ctaaattcgaggccgatcgactctagttctgtgaagaatgatagtagtatattaataaaaattgcattgaataagtagactgcttaatggcgtatacatattttcacaatattgattctacccatccatgagcatagggagtgtatccatttgtatgagtaatctaagatttctttcaggagagtttagtagtatacctcgtagagatctttcacctccaaatggtgttcacagacaacctggatggaattggaggccattattctaagtcaaccaactacaggaatggaaaattgaaata

SEQ ID NO: 483866 - DNA, 848 bp, Homo sapiens
caagagtccgtctcaaaaaaaaaaaaaaaaagtgttctgtaataaaagtgaactgataagttctgggcatccctgagaatttgttttcctttcagaaagtttcctacactactgaggtttaggggcactgtgaagcaaaagccacgcctcagaatcccaggcggagactccgacctcgtcccgggagggaagccagtagctgagcacctgcgggagattaaagagaggaataaggaggtgagtacatgacaaagagccacagtcgcaggcggtggggcctggctcagaacaggctgtgctgggaagcgggagcaggagctggcgccgccttgcgggctggcagaggaccatccactccctggcgctggggccgtcccatctcatgggcaagaaacgtgagacccctggctcgctccacacacaacctaagtgccagatggatgagacgcctacgcgtgagtaaatgccaggaacatgagactcgaacgtggcaggatatccttctgcccacgaatctaaaagcttactcggtaatgggagaatggttccaatttgataaactcgggtttttggaacgtctgtgctccagaaacactggaaggcaagtggctgctgactggaggagataattggatgctgcaagcggcaaagggctcgggatgcaaaacaccgcaagaaatgcaacaagtgaggagcattcccgcaaagaaaaaacgcacaggccgagagcagtggctcacgcctgtaatcccagcagtttgggaggccgaggcaggtgcatcgcttgaggacaggagttcgagactaggctggccaacatggtgaaaccccatctctactaaaaatac

SEQ ID NO: 483867 - DNA, 814 bp, Homo sapiens
  misc_feature (494)..(494): n is a, c, g, or t
  misc_feature (814)..(814): n is a, c, g, or t
cctcccaagcagctgggagtacaggtgtgcaccaccacacctggctaattaattagacataaaaaaaaaacaaaaacacaccaaaaaaaccaaacaaaacaaaactacgaagccacatataaccacccagcagaagccgcccaagaggaacgaagaggacgaatggaacagcaagaatcttccgctcgcgaatctatagcggatgaatgggggagaggaatagagtagaagaaagaggaacaaaaaaacagaaaaagtaccaggagggacacgtagtttacaattttttttgacgaaaaccttttagaatgccagactggggttgtactctagacgccttttacttgcacgttttgacaggcctacctacgttgttgacacgacctacctacgtgtcactacgttggactacgacgacacggcaacttctttttggacgatccctgactttttacgccaacggacttccgacactacactacttttgaccacancttttgggggggactctttgattggccctctagatatactttttacctcacacggactactctctcacacgacaaataattgggcattttgtcggtacgtatattttcctggtaagatatctaccaacgacatcatatatcataattaatataataaacaaaaggcataataatatcagataaagcatatttagcatagagaacaataggttattcggagatttacgcggggctatatattgggttggggtttttttcggtttgctgtcgttttccttccctggtaccacgcatggatggaggattctggcttttcggcn

SEQ ID NO: 483868 - DNA, 842 bp, Homo sapiens
gcattgatcctaagaagacacaggcgagatgtgtctaagaacttcgcattgggtcaagacgttatagatcttactggtcatgctcttgcacttgtacagaactgatgatgacttagatcaaccgtgattatagaacaccgattaatagaattcaaagctctttcaccagatgaatctatatggccacagcatcatggcaagagagccgcatacctattgatccactctccatggcgctctgtgcgcaacttgacgcgccaaggcatttgcgcaggctcaagtggctattctctggaggttacctatgatggctgcacataaaaggccagttgcaagcaacatcccattctgtagccaacgacactcgggactaacggttcacttcctgggtctgttaccaccactcctgtcgcgactggacgacgcattcaggctcggctcggtagaggacccaggtacgcattcttggtggagcccccaatggattaacgctacaccacaggcagtcccggaggtaaggacaccaacaggttgggagccccacgttggaatcccaggacaagtttaattatctggacagtgccccttcaaggagcacagccccactccaaagaaacaatccgactgggactggccaaagatcccctagcgccagaatcccagatcaatctcccaacgagaaacaccaacagatccaatccgacaacaagtcccggaattcatctaccggtctgatggtacttgaatgcctcccatgtatggcggcccaccgaagtggtaacgccagagctcgcgacgggaggcactggatccgatttgcgcagagaacgcacaagaagcga

SEQ ID NO: 483869 - DNA, 638 bp, Homo sapiens
caagagtccgtctcaaaaaaaaaaaaaaaaagtgttctgtaataaaagtgaactgataagttctgggcatccctgagaatttgttttcctttcagaaagtttcctacactactgaggtttaggggcactgtgaagcaaaagccacgcctcagaatcccaggcggagactccgacctcgtcccgggagggaagccagtagctgagcacctgcgggagattaaagagaggaataaggaggtgagtacatgacaaagagccacagtcgcaggcggtggggcctggctcagaacaggctgtgctgggaagcgggagcaggagctggcgccgccttgcgggctggcagaggaccatccactccctggcgctggggccgtcccatctcatgggcaagaaacgtgagacccctggctcgctccacacacaacctaagtgccagatggatgagacgcctacgcgtgagtaaatgccaggaacatgagactcgaacgtggcaggatatccttctgcccacgaatctaaaagcttactcgggaggctgaggcaggagaatcgcttgaacctgggagacggaggttgcagtgagccgagatcgtgtcactgcactccagcctgggcaacagagtgagactctgtcaaaa

SEQ ID NO: 483870 - DNA, 120 bp, Homo sapiens
gacttgtcgcagttgcatacatcaccttttttccgacagttgttgcgaaagtcaggtgattatcatcgcttttttgggtgattgaaaatagatccatcgataaagtagattgtttatgca

SEQ ID NO: 483871 - DNA, 165 bp, Homo sapiens
atccccttaaacccacgatcacctgcatcatggcccaggtctctatccctcctctgtggagcaacaggtggaaaacgacatgtgaggtgtgtgagctctgagatgtgagtgtatgtgcgtctgagaatgtgtgtgtgagaatgtgtgtcagattcaatgtgtgag

SEQ ID NO: 483872 - DNA, 116 bp, Homo sapiens
cggaaccgacaggactcccgtttgtaagtttgtgattttgctttggcatgtttcattgactagtagaactcattctgttttagtgtatatttcaatactaacttaacattttgctc

SEQ ID NO: 483873 - DNA, 956 bp, Homo sapiens
  misc_feature (747)..(747): n is a, c, g, or t
cgcggttcccacccgcggatattctttcccgccgtgtgtgtgacggcggaaaagcgtgccgcgcccaccaaaggggggcccgcccccacaaagggtgctcgccccgccgaattgacaccttttttctggcgaccttttttaaatcaccaggcgaccccccttgtgggccgacacttccccttgggccataagcgtcggagtattcttttggcgcttcccctcagagtctgtcaaagggcgacctgattctctctagaggcaaggacaacacatctgcttttgcgtaaccccacgagacacacctgttctctgtcccaccacgtcgtaccacccacagggtgtgagcagaggagacgctttttcccaagcaccctgggaaaaacatctgccccttgttgccccccggtggtttttagcgagagttgacattcgccacagaacagaggtgctctgtccccaataaccatgttgtctgcgcacccgcgccgtttcttattttcaaggaaatcttagagtgtcttcaatattttcgaagaatttctcctcaagagtatacttgatgcgaataataggagggacatatctttgtacgcacacttatatatatctagcgtgtgacactattacgtgctagcatctcccataacaagaaacaccccgttctctggcgattattcttataccccacacatataaacggtcttattgtctccttcgattatagcacaaatcttggcaccagtgtgngtattaacacaaccaaccaatgttcttgaatttcaccggatctatgcctatgcactttgttcatagtaccccgccctttatcatctggtgttcttatattttctgcaccatgcccaaatctacgaacgccgccttatgactgacgccttatcaaaccccacggtcaagattttgcccccttaaaaaatccagattctaaaaaaaaaaca

SEQ ID NO: 483874 - DNA, 230 bp, Homo sapiens
cttatttttgtattttgagtagagacggggtgtcgccatgttggccaggctggtcttgaactcctgacctcaggtgatccactggcctcagcctctcaaagtgctgggattataggcgtaagctaccacgcccgacactttgttttttggtttttagagatggggtctcactctgtcactcaggctacagtgcaggtgcatcataactcactgtagccttgaactccttt

SEQ ID NO: 483875 - DNA, 111 bp, Homo sapiens
gacacgcacctggatgtagcaaggaaagacaaacagcagcacgtgtgatactcgtgaccctcctcactcacaggctgactcacaccaaccctgccagggagagatgttatc

SEQ ID NO: 483876 - DNA, 105 bp, Homo sapiens
acaggttatcatgtggcaggatgtctcgatctctgactcatgatcgctgctcagctccaagtgtggatacaggcgtgagcacggccactatatgatttactaatg

SEQ ID NO: 483877 - DNA, 212 bp, Homo sapiens
agctttagaccagcctgagcaacatagtgagaccctgtctctccaaaaaaaaaaaaaaaaaaaaagttaaaaaaaaaattaggcaggcatagtggcacatgcctgcagtcccagcttctcagaaagctgaggtgggaggattgcttgaggttgagattgcagtaagccatgactatgccactgaactctaccctgggagcgagaccctacct

SEQ ID NO: 483878 - DNA, 319 bp, Homo sapiens
tagagcggtcgagttgagtatgtttcaagtgcttgttggccatctgtatatcttccttggagaaatgtctattcaggtccttgcccattatcaatgggttgtggcttttttgctgttgagttgtacaagttggtatattttagagattaggcccttgtcaattgcatcatttgaaactattttctcccattctgtaagttgtcttttgggtttcttttgggtttcctttgctgtgcaaaagcttgtcagtgtgattaggtcccatttgtttatttgtgtctttattatacaaggtaataaataaaattctaggaggtgg

SEQ ID NO: 483879 - DNA, 666 bp, Homo sapiens
cccccatggaagcatctggcttcactgctcaggtgattatcctgaaccatcccgccacataagcgccggctatgcccctgtattggagtcgccacacggctcaccattgcatgccagtttgctgagctgaaggaacaagattgatccccgttctggtaaaaagctggaagatgcgccctaaattcttgaagtctggtgatgcgtccccttgttgatatggttcctgcgccagcccatgtgtgttgagagcttttcccagactactccccctttgggctccctttgctgttcgtgatatgagcaccagcccagttcgcggtgggtgtcatcaaacccagtggaccagaaggctgctggagctggcaaggtcacccagtctgccccagaaagctcagaaggctaaatgaatattatccctaatacctgcccaccccactcttaacacagtggtggaagaccggtctccagaactgtttgtttccattgcccctttaagtttagtagtaaaagactggttaatgatacccagcatcgtaaaccttcagaaggaaaggagaatttttgtggccccctttggttttcttttttgcgtgtgcccgttttaagttattagtttttaaaacccagtactttttaatggaacccacttaaaactgccacacgcca

SEQ ID NO: 483880 - DNA, 151 bp, Homo sapiens
cccaggattatgctattgaagggtttggcagaggtgtattttcaaaatggcaaatttcgaaagccgctctggctgcgtctttacagggaatggacggggtgggagccaggtaaagaagttgctgcagtcttccacgccagagaggacggtg

SEQ ID NO: 483881 - DNA, 291 bp, Homo sapiens
agaggtgactgccttcagcaagagaaacatcgtgaagatcagttgtaacggatgaactgtgcccgcttctcttcagtcatagctttggtcgggaaaggaaagcagcagggaaggcgaatatggacgagaatcatctagaacaattaagccgagcaggaaacctcattcctacctacactggaaggagcgctctcactgtggaagagttctgctaacagaagctggtctgcatgtttgtggactccagcggagagtggcagactttcttctccttttccctctcacctataa

SEQ ID NO: 483882 - DNA, 1440 bp, Homo sapiens
  misc_feature (808)..(808): n is a, c, g, or t
  misc_feature (863)..(863): n is a, c, g, or t
  misc_feature (989)..(989): n is a, c, g, or t
  misc_feature (1286)..(1286): n is a, c, g, or t
  misc_feature (1326)..(1326): n is a, c, g, or t
ctggttggtcatgcttttctgttggggggcgtttgtttggctgtggtgctgcctggtttccgcgttttctgttgtgctcgcttgcggtttgcgtgtgtgctcgccgcttttgccgggtgtgttgctgtatatcagtttgtggtttgtggctgttctcgtgggggtgggttcgcctgtttgggtggttctgttgttggccaggtggtgcattgtttgtgtcggcccgggttttgggctccgggggcgcagtttttgtttgcggctctggtgttgacaagggttgcggtgggtgcctgcgcgtcggtgttgtcggtggttcgtgactgccgtgttttggtgtgggtgttctagtgatgttggtccaggatgtgttttgtttaaatggatgggttatctcatgttgttagtgcagtggtgttggtgtgtgggtgcgtggggggtgggtctgtgtttatattggtgtgttagtgtcccgccccccgctgttgtttttgtaacggcgctacacaacggttaaataaccagttgagccccctttaattggggatccagaacccaccaataacccgatttttagagtggaccacgttataggtagacttccggaaagggatccccaccaagtgtttggggacccacaaatatacaccaaggcttttgtgtaagaccgcaccgcgcccacgtttaacgtattacaccggtgcctcaaagggtataccgaaaggcccctctgggtgggcgcgagattttcggccacacgagaggctctcgaaagattatagagtttcgccgcactttcacttgtgancgagcacaccgcgcgataactatattccgccactctatgaaaagtgttgtcactngagcctcacactccgcagctatacttcacagagggagaacacacaaatgggtcacattgaatggtccgcgtcacccccggcggagaaggcgcaccacgcgtgtcctataagaccacgcagaaattntcgcggagaaaaatctatgccccacagaatgggtacccaagagaccaccacccgcgagtgtttacttctcttggtaatttggagattcacgaaactccactctttgtgtggtgggcccaagagcacacactcgggctcttggccactgagatttaatgagattctccctcggagatataatgccacaaagagaaataatgagacccccaacaatagaccttcgccaagaccatggccctgtaatgagaaagagaaaaagaccctccaagagaaagccaaccgagaaaggaaccgccnagacaccaagaaatgaagaaaagtccagggggacacgccnaaagcgccaaatgttggtgctggccaaaagaccgaaggagtaaaggtgctgccatgatgttagctgtggcccctgtggatttttccccagaacacttaataaacttaaaacctt

SEQ ID NO: 483883 - DNA, 229 bp, Homo sapiens
cagtttcactgggcctcatctccacctagtattatcatagtccagcagcataccgtgcttgcaagggtgccggaacacgctactctgtgtccccacttctagccttagctcatgctaacttaatgtgagttcagcttcaggagtccttccctacaggagcctttgctttctcagtgaggtgcgttgagaagctaaagcttatacaaaggacaaccctcagctaatgatc

SEQ ID NO: 483884 - DNA, 933 bp, Homo sapiens
  misc_feature (518)..(518): n is a, c, g, or t
atgttattgagcacatatgtttgggcgggctcccagataggcctacttgaatatgagatgcattcatctgtatcgctagagatacccgtgaatgcgatgacttggttgctctgtgactcacttgcatccatagttgatagacaaacgctcgggtgagatcaccggtcccggttctcgatacgcaatcccagcaattgcagatcgtggaggtcgttgaagttgggagtcatatcaaacttggagtcctgatctgaaggcatcgaatcatgcaagattactgctcggccgatccggtgttgtgttccccgtgtggttttttgccccggactcaatatcttttacagaggtgctgcccaaatccttgctataattttccctccatcactgcacactttcaatatacagcctgcgcaatggaggtatgtgcttcttacatactctctgagaattcacgtacgccagagaccttctctccagctctctgtgacaatgcagccaactcaaagccggttcatgtnagctgtagattcaggtggttacacagataccacgtgctggcataatgatttcacaaatatggcatgacttatcaaagcatgtgattctattttacagtttcattcctatcggtacacttgaatacactgtctctatcagttatttctgaggcctgttacaacgggaccttcaaatctgggaagattccccttctgaaggcaaacatgtgactgcttagtacgtggattcctgacttctgttttttcccctggccaacaaagaagtggtatttaaggtcattaagaacacatgatgatgcttgggaaattagagttcaatgccacggaatacatttacagtaatgagttgccaaatcattgagattccaggaatgggcggaaagagtggttagaaaaggaaacaagggccttagct

SEQ ID NO: 483885 - DNA, 194 bp, Homo sapiens
agtggcagccgaagtccacacagcctgcttaccttgccaccctgcacacgagcaaggggcagattggtgggcttcctccactcagagataggggggaatggaggaatttcattccagaagaaaacctagaggaacttgctctgccccagtgagccctccccatctcactgatgggttcgtgaggaaactctcag

SEQ ID NO: 483886 - DNA, 212 bp, Homo sapiens
aagtgtgctgcgtagatctagaggatcccagtccgggtcctaatgggtcgtcgggtccccactcccctcacattccacgggcccagggactcactttggtaacaaactcctaccaacacggaccaataaaaaaagagtgtgggttttttttttttttttttttttttttttttttttttttttttttttttttttttttttttttttccccc

SEQ ID NO: 483887 - DNA, 343 bp, Homo sapiens
agactaagacgagacgacgagagaatcgcgtccttgctgctgcaggcggtaatgcaaaagtgctggccagtaagcagtgtccccacattagagtgggcaccccagggcagggaccgaagagcatgccattgtgatcccagcagaggcgtgtcgttgcacttgcccagaggaaagggactgagacccgtgctaccaggtgtggtctagggcatcaaacacgggattggtctgaaaagccgaggcacggagacctcggctgatcctgtgcttgagggagaagagactgtgaaggagctggccattctagaggaagggagggagccgttccgaggtcatcctagaa

SEQ ID NO: 483888 - DNA, 897 bp, Homo sapiens
  misc_feature (14)..(14): n is a, c, g, or t
  misc_feature (145)..(145): n is a, c, g, or t
  misc_feature (235)..(235): n is a, c, g, or t
  misc_feature (237)..(237): n is a, c, g, or t
  misc_feature (245)..(246): n is a, c, g, or t
  misc_feature (254)..(254): n is a, c, g, or t
  misc_feature (261)..(261): n is a, c, g, or t
  misc_feature (269)..(269): n is a, c, g, or t
  misc_feature (281)..(281): n is a, c, g, or t
  misc_feature (284)..(285): n is a, c, g, or t
  misc_feature (287)..(287): n is a, c, g, or t
  misc_feature (309)..(309): n is a, c, g, or t
  misc_feature (312)..(312): n is a, c, g, or t
  misc_feature (325)..(325): n is a, c, g, or t
  misc_feature (327)..(327): n is a, c, g, or t
  misc_feature (329)..(330): n is a, c, g, or t
  misc_feature (332)..(333): n is a, c, g, or t
  misc_feature (343)..(343): n is a, c, g, or t
  misc_feature (345)..(345): n is a, c, g, or t
  misc_feature (347)..(348): n is a, c, g, or t
  misc_feature (350)..(353): n is a, c, g, or t
  misc_feature (359)..(359): n is a, c, g, or t
  misc_feature (362)..(362): n is a, c, g, or t
  misc_feature (373)..(373): n is a, c, g, or t
  misc_feature (382)..(382): n is a, c, g, or t
  misc_feature (386)..(386): n is a, c, g, or t
  misc_feature (408)..(408): n is a, c, g, or t
  misc_feature (414)..(414): n is a, c, g, or t
  misc_feature (425)..(425): n is a, c, g, or t
  misc_feature (445)..(445): n is a, c, g, or t
  misc_feature (464)..(464): n is a, c, g, or t
  misc_feature (576)..(576): n is a, c, g, or t
gctaatactgattntttcattactaccattttatttattacagctcagaggagagtcatttactagacattcggttgttattaaacacgggagagagagttaggcagagactggagggggtgaggataagagaacaggataaggngagcagaaagacgctcaggagagtagaaagacactcaggagagaacaagagatcctgcccattcttattatgaggatgaactggctacangncatgagtnncccaatcngatctancttaaatnccagcctctccnaanncnttttccaataaagatcccctancanttattttctggtnantnntnnttgttttttntngnngnnnnggtctngtngggacagaagngccaacttngggnccaacttaatacatagatagcnccatgncagagctgggntccattaagacatgactgtngacaataccatctctaggnacacactgtcactcacacatggatgtgttgttttatggcctaaagatgttgtagacggttctcacataaatttcatcaggggggggcttcttcttgctgccaggttcaaggnatctcttaattgtagggatattacttagtttcactgtgtattcctggaggaaaggaaatgcagacaggatattaggaattttctcttctagagctaaaatggtttggagtaaaatcacatctgcaaggctcagctgattaccaacaagaaagctttgtccgtgaccccttaaaatcttttcaaacacaggaaagtatctaattatagccttctgggccatgttaaccacttccttttgctgatcatctggttttaagaaaggatgcatgataagcagttccagcagatccagtgtcccctccacgtacatgtcaatcaggg

SEQ ID NO: 483889 - DNA, 1041 bp, Homo sapiens
gcagctaccacaaagacaggtcgacctcaccgaggagaagaaaggagaagcgagaaagatgtcggggcgcggcaagggaggcaaggggctcggcaagggcggcgccaagcgccaccggaaggtcctccgcgacaacatccaggcatcaccaagccggcgatccgtcgtctggcgcgtcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccaggacgcaccctctacggattcggaggctaggccaccatcaccgccagattagagtgtctagggttcgtggtcgttgatgtaatcgcagtatctcgctgctgtttgctatcttctgtagaatggaattgaatggaaatcgaactagtttatcgttgaaaaaaaaaaaaaaaaaaaaaaaaaaaaaaaaaaaaaaaagaaaaaaaaaaaaaaaaaaaagaaaaaaaaaaagggggggggggagcccaagaagaatacccgccggggggggccccgcaatatatgggcgaaaccccaaatatgttgagagaaaaagaggggtcgccacaaaaaggaggggcgcggctcaaaacgcaccgagaagacgagaggcagcatgatacacaaaacgcgagtctggatggaggaaaaaacatgtgaccacagggcgcacacaacctagcggagagcgaacaaccaccccaaaccgcggggggggggggggacaaacacatagagggcagacaaacacacaaaccaactgacagaagaagacaaagaacagccaccgggacggaggcgacatcacacaaccgcaccgccaggaagggacaagagggcgagggaaaaacaaaccgaggacgtcaaactgagcagcgtgccgcactcgaaaagacctgagtaggacaccgcagcaaactgataaaacaaagaacaaaagctgacc

SEQ ID NO: 483890 - DNA, 355 bp, Homo sapiens
attgcaagcatattttttttaatgactccagcaaaagtaagcatcaattaaacaagtggaaagtgacctacacttttaacttgtctcactagtgcctaaatgtaaaaaaggctgcttaagttttgagtgtagttggattttttggagtccgaaggtatccatctgcataaattgaggcccaaatcgaattaggattcaagtggatactaaatactttgcttatctggaagagagaaccttcttaaggaataaacgcgttgaatagagaaaacactggtggataataggcatttcaacggtctttgcaatgtttcctgctgagaaacattaaaagatttattgattattttttttc

SEQ ID NO: 483891 - DNA, 108 bp, Homo sapiens
  misc_feature (96)..(96): n is a, c, g, or t
acctcgcttagtgccccctgggcaccactcacggggccctcagtgccaccaccgtcttcagagcgcatcagcgaggagctgcagcagccccacctnctcgctgatgcg

SEQ ID NO: 483892 - DNA, 338 bp, Homo sapiens
acagtgacggcttgttgcgggccttctcacccctgagaactctgggacctcaacagtgggcacgctgatgacacacttggcagtgactttcccccagtggctgcggtgctggatgtcatgtatgagtcccctttcacactgctgtcctgtgtctctgacacctatgttcgctactgggacctccgcaccagcgtccggaaatgtgtcatggagtgggaggagccccacgatagcaccctgtactgcctgcagacaagatggcaaccaccctgctggccacaggttcctcctactacggtgttgtacgagttgtgggaaccggcgtcaaaagggcctgc

SEQ ID NO: 483893 - DNA, 265 bp, Homo sapiens
ccggacacggcgggagcagagaggaaccccagacacaccccacccccacagccctacccagcagccacaaagcgcacacacggggccacccgccaaaacgtagtcccacgcccaggcacgcaaaagaggagaaaagaatgcgacgtgctggcgacgggaccactaagacgcggagcacccaccggcaacgcacaccctagccaagtccgaagcccacagaaccggagagacacaggctccaacaagggtgcagcacccgccagcc

SEQ ID NO: 483894 - DNA, 1065 bp, Homo sapiens
agcggaagggactcgcggacatctcaggtctcttggtctggctcggtccctccggagacggctgagcgacgcgttgctgtcatccttatggggtagacctggcttgtgcctccggtgatagcccaaatcttccagacgtgcaagagagctagatttgactgccagagcctccgaagacatgagcggcgtgacctacgatcgcgtccgacgctggggcattatccgggcaaggagatctccgcgaagcgcgaaggtaggtacgcgactcgtaacctcctataacttcactcactgtggtcattccggaccctgaagttctcggaccctcacatccctcctggaagaacgtagtgacgataactacacattgttgcttcccaagccctatcattcgatgtcctttcgtaggtgagttcgcaggtaatgactctgagttgtcaccgtgtggtgcactcgcatagtaatagggttcaaccttgtggtgaaagggcaacttgagatgaattatgtttacaagtgctaccccatgacctttgtttcctgcggtgatctctgagaccctaggaaagggtgtgttggcgtacccttttaaggtgcgtccaatggattggtcaactctagacaatcgaagtgtgtccagcgtgttccatgatagttacgccgcattgtaacatttcataccggactaatggtgccgacatgcatcgtgggttaagctagtaagaacccttctgaagaatttgaggtgcctagtgcccacgtgggaattcaattgtgttgaagcttgttaggccagtaatgcctagaaccatacgtgccctggtgagggacattgtggtcctggcaacgcgtaggtaccagaacaaggtggaaacccgtctttgagagaggtggacgaatcctttgtcccatgtgtgtgttgagaattacactttttagttaatttccctgacataagaattcctacttttgaagggccgccagtagtacacaggatttaggtcgttcgaaacgacgcgatgttgataaatgcaatcgtatattatttgaactataacagtatcg

SEQ ID NO: 483895 - DNA, 172 bp, Homo sapiens
cggcagctacagaggacttcccagtgaagcagggactcagaagattggtgcagcacgctagcccgactggaaaaggcatctgagagaaggaagccggagaatgttcattcctcctccgaggaatcacatgcatgttcaagactgaaaaggcagctccaactttcatcagaat

SEQ ID NO: 483896 - DNA, 984 bp, Homo sapiens
aggagcccatggaatcatagtgtgtatgatgtgacagatcaggagtccttccaataatgttaaacagggctgcaggaaatagatcgttatgccagtgcatcatgtcaagcaaatgtaggtagggaacaaatgtgatcatgacccacacagaaagtagtagactacacaaaagcagaaggaattagcatgattccccttggaaattccgtattaggaaacacagatgcgtaagaagtgcaacgcaaatgtagaaccagatcttacatgcacgatggcaagcatgagattaaacacagcgaatgggtcccggtagcaaagctggtggtgctgcaaaagtacaaatgttaaaattcaaaagcaattcaaggtcaaagcagatcaagggtggacggttgctgcatacaattagacatccatccttatgctcaaaaagacaatggaatgtgaaatcctggaagaccaagtgaaacaaaaacaaacattgctgaacatgtactgtatgtaagatgaaatacaaagcagatatcattaaccggtataccacacaggtcaagagattggacacatggtccatacatgacttataaaaattagacaaattagggtataagaacacagatacagtacaattaataagaaaatgaagagaaaccatttggggatgcagggatactacaacacagggagtacaacacctgtgagataacatggaaccaagacggacccgggatgggaagacaaactctaagaaggcgacataggaagaaaagaagacaggaaaaaacaggaaaagagaaaaactagtcaacacaaagcggacagtaataagaacaaagaagaagaaaaacacaaagacaaaacgaaagacagagaagaaaacgcaagaacacagataagagacaagaagaaacagaacaagagaaagaaagaagacagacaaacagaacaaaaagcgacaccgagaaaacaaacgacaagtaagaa

SEQ ID NO: 483897 - DNA, 413 bp, Homo sapiens
  misc_feature (69)..(69): n is a, c, g, or t
  misc_feature (94)..(94): n is a, c, g, or t
  misc_feature (108)..(108): n is a, c, g, or t
  misc_feature (124)..(124): n is a, c, g, or t
  misc_feature (131)..(131): n is a, c, g, or t
  misc_feature (173)..(173): n is a, c, g, or t
  misc_feature (271)..(271): n is a, c, g, or t
  misc_feature (305)..(305): n is a, c, g, or t
  misc_feature (307)..(307): n is a, c, g, or t
  misc_feature (373)..(373): n is a, c, g, or t
  misc_feature (381)..(381): n is a, c, g, or t
cgacaaagcgagactttgtctcaaaaaaaaaaaaaagaaaaaagaaaaaccaaaaaataaaaataaaanttaattaattaattaatggggccgnggcgccccggctgngggccgtggtggatgncccttgnttcagtggtcctacaaaggtagatggtgggcggacaccgaantcaacttgactgtgtaccccataccgttgacgcgcttgtggcagacctgtgggtgcggtctcccctctcctccacctcttcctgctccctcctctttnggctcctactcagtagttccattgagggctgcantnaatataaggacctgttctggacacaagactgggcccgctgggggttttagtagggcaacccccttnccttgcangaagtgaggcatgggtgacagtagtcccctgg

SEQ ID NO: 483898 - DNA, 2145 bp, Homo sapiens
agaacagcgcagtttgccctccgctcacgcagagcctctccgtggcctccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaaggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagt

SEQ ID NO: 483899 - DNA, 786 bp, Homo sapiens
  misc_feature (450)..(451): n is a, c, g, or t
  misc_feature (455)..(455): n is a, c, g, or t
aggttctaagggattctcctgcttcagcctcccgagtatttagggttacctgccaccacgcccggctgatttttttttattttcactggagacggggtctcaccacgttggccaggctggtctggaaatcctgacctcaggtgatccatcagcctcggccgcccaaaatgctgggattacaggtgtgagccatggtgctgggccaagagttatagattcaattcatttggaaacacagctcctatctttgagtgtgcatgtacttttatgaagaaatgatgtcagaaaaccgaaggatgataatatgaaaagtaacaggcatgtgaaaaggtcttccgattgagaactataaggttcgacgtcgttttcagataatggggtcctagctcttgtgtcgttcttttacatattctacatcaatggaagttgtagcacggtgtcagaataaannagantgtatttcacggcttcttaatttctttcaattacactgagatctttttcttcaagagagaaggacattgtcatggcattgtattttttctgaaaagagtaggctgtattttactgagattacggatttgttatatatgacgttttggtcttctaatattcttcagtggattttctctaaagtagtatgtacagaaagccttgtatagcaaaaaagtaaatcacgtaataattctgagatttttggaattgtcacaactgagaaacattgctggcggtgtatggaccgcaagtgtgaagatgttccttgtgaattgcttgcatccagcatta

SEQ ID NO: 483900 - DNA, 119 bp, Homo sapiens
tctacgaggatctcctgggcagggtgggaaatcaaaactattcctgttgaaatgacttaaaacccatactacctctaaagcctcatctcttgactctctccgcaccaaggcttcactgt

SEQ ID NO: 483901 - DNA, 103 bp, Homo sapiens
aaaaaatggttaaacgtgatcaatttaacaccttgctgattgaccgtaaagaaagatgcgctacatacaagtgtagcaccgtttattctctgtaaattcctta

SEQ ID NO: 483902 - DNA, 427 bp, Homo sapiens
  misc_feature (119)..(119): n is a, c, g, or t
  misc_feature (136)..(136): n is a, c, g, or t
  misc_feature (151)..(151): n is a, c, g, or t
  misc_feature (190)..(191): n is a, c, g, or t
  misc_feature (196)..(196): n is a, c, g, or t
  misc_feature (241)..(241): n is a, c, g, or t
  misc_feature (270)..(270): n is a, c, g, or t
  misc_feature (301)..(301): n is a, c, g, or t
  misc_feature (310)..(310): n is a, c, g, or t
  misc_feature (355)..(355): n is a, c, g, or t
  misc_feature (377)..(377): n is a, c, g, or t
  misc_feature (381)..(381): n is a, c, g, or t
aataagtagaaaaatggcagacctaaatccaaccttagcaatgattagttacaatgtaagtggacaaatactctacttaagacagagactgccagacctgagaggaaggcaagacccancaatatggcatccacanagacacaatttaaanacaaagacacaaagtatgagaaaaaatatgcttgcagannctaancataaaaatatgctatccagacactaatcataaaaagcttcaacngagatgttaacactagatgaaagaggctncagaacaaaatatatcaccagaaataaacanggtaatttnataaaaataaaagaatcagagaggatgatgttacaattataaatngtgcctcaaagtgcacacaaantacncacacacacagagcctcaaattatgtgaatcaaaaacaacagaaca

SEQ ID NO: 483903 - DNA, 991 bp, Homo sapiens
agcgggctgctctcccgataggacggatgaagggccgggggtcgtgggcatggggtcccctgcgggtccgagtgctgcccacggagaagcgctggggcagactggtcccgagatacccgtctaaattccccgatacgggccggtcgacgatgcagatagatcaaggtattcatgggtaagacttaatgggtaagctgcaggcgaccgagtcgccgtacgtgccggagtggatcgtggactagataccacacttgacacggtgctcggcacaggatacgccacgaatggttacctataccacgaggcacgacttcactggttggtgacggactgtggtgtctgactagggtctggtgatgataacgcaggggactagtggacttatgatcgtcgtggctaagcggaactctgccggggaccagaagagttggaggaagaaaagtagtgcttgcctagcagcgtatgtcccatagacacatctgtcatatgggcgagcaatccgactggtgacgaaacggatagacgcgttgtgttgcaatagagcgtcgagtcaagagggatatcgatttgcactgaggtggtcaaaagcgcgaggtagaggacggcagaactggttgcttgcagagatgtcctaagggttgagacaggtggaacggtgggcttgtatggacactttatataggggttgagcgacaaagtggataaggcactgtgctcagagtaccaaagagaatgggctctttctaacggtgggaattgatcaaagagggttatgatcagggcgcctatatagcagcgacaatgaactacaccagcaatcagggggagagtaccaaaagtcaatcgctcggcatggcctcagtagaccacagcagaggcctcggaggcactttcggacgagcgtatcgtaacataatcccaggcgtcgcccattgttcaaccggcaccccgcggaatcccactagagcttggtggaaatgttgggggaacg

SEQ ID NO: 483904 - DNA, 786 bp, Homo sapiens
cccagctactcgggaggctgaggcaggagaatggcttgaacctgggaggcagaggttgcagtgagccgagatcacaccattgcactccagcctggccaaccagagcgaaaccccgtctcaaaaaaaagaaaagatttaggtagtttgatgaaacacatttgtactttactttagccagctggggactctgggttaaaaacactgcttttctagatgtggtagcaagttttaatttccttcttttttttttccttttttggcagtgggagtgcctcaagcttatggcctctcaaaaatttacagacaaacgcatgggctattaaggggcaaggctgctgtagatgaaagacaagatgtccatcttctcatgaccaacggtatcaagaatgatcttaatcatagcacgcaattcgtacaggggtcagccctttgtaccctcggctgcatgggctcctcagagatgtgcagagatcttgccggagaggtagagaaggctcctgaaaaactcaaatcttacttaagacaaacggtacttttaagtgaaccaaatgtctgttggataaggggagtattatgggagatagcagaagggcgattactcactttgtggacgattctggtgggtactgttaaggcattttcggtgtggaaaatcggttcctggctatattattaacctaaattccttttgtaaggaaggttataacacaatgtccgggcttttcacgggggtacaattctaggtttggtcttcacgagtacgcaaggtgtttacacagttttaaa

SEQ ID NO: 483905 - DNA, 113 bp, Homo sapiens
agttgccacagaatggggagtcaaacctattcttaaaaaaaaaaagaaaacaatcaggccaggtgcggtggttcctacctataatcccagcacttcaggaggtcaaggtgggt

SEQ ID NO: 483906 - DNA, 1004 bp, Homo sapiens
gatacacccttaatagaattacgcttgacaatgcaatctttgtgaacatatggcacacgtcacactacctttatgccactactgatggcacttggctcaactgcccaagggattatcaaggatatctgctatagatggagtgttacctatatgctgaataaaagcccacatgaaagaatataccatttgtgacactagaatgttgacaaagtacacttgtgtgtacagattcatgagacccgagagaatttgtctcgctggtaagccagttcatctgtggaggctcgcaaggctaagtgttaccagatcattctggcttgagaacaaaggctggtgccaggctcgatcatgaggtgtattcgggattccctgcatgcacccccatcagaaacacccattgaatagccaaggaccatgccagaatcattattccacagaaccaagtcaagcgcaagtcagatatctacgtctgcatgatctcctttgcgcacaatgtaagcagcacaagggaagtacattgctatagttaggtacaactgtggaaaccaaggagcctgagaaggaaatcagacagctttggagctcttggaacccaattgaaccagaaatttgtagcatcagttgactcctggtaccaaacagacttgggaacagaaagccaggatctttattccccgcacatatgatgccaccatcattttggaggaccaactgtgtgatgacccttcacacaacattctatagagcgatgacaggaattcagaggttcgactttggagagcaaatggaagcgcaagcaagaactgaaatctatggggaagactacaacgcaagttataaagtactagggacatcaactggccacacagcaatcagacacacaccgtcacgcgtcattatacccgtacaagcatcccgcaaacatcccaactatacaacgacaaactcgacaacacgacatccaccacagctctcctacacacctagcagcaaaatatcagacg

SEQ ID NO: 483907 - DNA, 413 bp, Homo sapiens
cctctaattgtgcagcccggcaatcagaaaccaagaatctaagccccctttccggtacggataggacctgtgcgccacccacgtagaattggttcactaatagattctattgagcctagtgagatctaaatatctgtgttgcatagaactctctcaagtgctgtccatgtaggaccttctccataaggcacagtcggcgtgttccttgggccacgccccacccatcgggcaccgccaatgtagggtcgtatgaccggccaagccaaatccaaacattctcccggtactctcatcagcgccctttctataccacacggtctggtgggaatgcccactcctcttccacacctcccatatttctctaaagctggccgcaagaatcccctttaggtgcccctcccctaagacattcc

SEQ ID NO: 483908 - DNA, 521 bp, Homo sapiens
atagagttgtgataggcgcagagaaaatactcaataaatatttggttcttatatcccaccatgttttactgtaattaggagagagggtggtgctagaaattttcccccaaagaccctgtaactgaatcagttttcttctccttaatgctttttccatttaaaaaggcatcatttcacaatttttgaaatggaaactatgtttacagattaactagttccagctgaactcccttattttaaatacaaggtaactgaagtctagggctcttaagtgactttccccaaatctcatggtttggaggtactaaagctaatatcagaaatcagtcctcataataacttggctggggtcctcttttaactgtttttctctttatcacaatagtcaagcacacataaaaataattatattaaaaatattaatctcaggacaaatgctagtttttttctgtaaataactcttaagcaattaatttatgaacaatcattaaaaattaaataatgtcatttagatgatcaaa

SEQ ID NO: 483909 - DNA, 317 bp, Homo sapiens
acacaaggtgaggaaagaaataaaggtgtgaggaaaagaccttactatacgaagaaaagcatttccagtggtgtggcgtgaaaacaagaggagataacctaggctgctggaaagcacccttttgttgttttcattctgttccctcccattgtagattgaactttgttctctgctttctttttcttggaaagagcaggacttagctttaagtcagcactgattggggcactgttcctaaaggcatatccagtgcttcattgtcattgtgttttcaacactttttaaaattaaaaccagttcattttggggcatgcatc

SEQ ID NO: 483910 - DNA, 222 bp, Homo sapiens
tttttttggggcccccaaaaaaccgggttttaaaaaaaaaggggggggggccgggttttcattttcctgttttttccccccccccgggccccggaaccctttttttttttgggggggggggggcccgccccccttcctttttttgccagggggggggggttttttttttttttggcggccccaaattttttttttggggggggggggtttttttttttttta

SEQ ID NO: 483911 - DNA, 1726 bp, Homo sapiens
gtagtagttgttagtggtgtgcactagtatagttagatatgttatgattgatgttgtgtatggcgtgtatatatttggtagttatattgcgtgtagtactaagattgtttataattgtgtatatgttgtgtaatatatgttggttgttctcatataatagttgtctagttgtatatttatggatcttttgtatgtgagggtattagtggcttgtggtctgttggtgcaatattttgtgttgctgtttggtacttccgaatatctttatgtattagatatatggtgctttgaattatatagatatcaattttgtgtttgtagtctttttgtggtttgtctatagatgtatgggataatggaaactttagaagtattttattatatgtggtgtctttaatatggttgaatatcactatatattgatccagaatggtgattattggttataagatcaatgggttgttgggaatttttgggttattgttagatgtgtacataggtgtgatgattacatggggtgtgacttttgcccttttgatgaatatttatgtccactgtcgggggacgttcgtgggtcttgtattttgcagctaagtggggcctaagccatatgggtaagatgtatacttgggatatagttgcggtattaattatggtgctttagtggagatattctgtgtaattcatagtctgttagtgggtaagttggtatctgtatgatgttaaagtatgtgatatttatgtactttataatgaatgtggtgctggataaataggggtttgtctggtccgggggattgttacattccaagtttaaattttgcatatactcgtatagaaatagcaattccggtgttgtatggttttgataggtataaattgtgattaatgaatacaatgcatgaaatgcttgtgtatgtactcctgggtgtcgcctagttgtttggaatcagtccatattgcggagctctttcgtggctccgcgttgctgtgactagcgttggtgtacgcgacgtgtcatagtcttcctctattgtgaattctttctacataacgcccgccctgttatatgtacgagggatacgctttccatatcaaacatgtggatgggttcctaggctgtcgtccaatccctgcaatatctccagcgatcgagaccttaggttctagtatggatgtgcttcccacttggtgaaccatcgttgaatacgcgtgtctaatatatgtgtgactaatacgcggtccttatcgccttggatcgccgcagggatgcatctgcaggggctctgcgctttgagcgatgccatgaatgactgcgttgatgtcacccatgtggcctatgggccattggtgcacaatggtccctctggcatgcaactatgcgtatcatttggtgacggaagcacacctctcatccatgttgatagtctatgtctacgtacaaaagtagtataatgttggacatgggccacaggtggctcatcgccctgataatctccagcaacatatgtgggagttccgatggcaatgcggagtcaacttgacggatcaggagatctagagatgccagccctggcacaatattggtgaaactcacgcatctctacgtaagagaacacaacatatagttagccgggacgtggtggcaggcgtctgtaatcccagctgcttgggaggctagaggcaggagaatcatcttgattcctggagaatgtcggttgcagtg

SEQ ID NO: 483912 - DNA, 311 bp, Homo sapiens
atttggccccccgggcccaaaatttgggccgggggttaaaaccaaccccccttttccgtttgttttgggccgaaaaaaaccccagccttttggccccccctccccctaaagggaatctttttttatcccggggggggccccaaaaatttttttttttaaaaaacccccccccccaaaaaaggccccccggccaagggtttgggccccccccctcccctttgcccccccgggtttggtttccccaaaaaaccaaagggggccctttggttggttcccccataaaccctttttaaaaaaccctttttttttta

SEQ ID NO: 483913 - DNA, 952 bp, Homo sapiens
agaccttggaacccaaagtcattgatgaagtccgcactggtgacctaccggcagctcttccaccctgagtcagtctgcatcacaggcatggtatgatgctgccaataacttatgcccggtagggcgctacaccacttcggtatggcagatcatggctctggtgttggtccggaattcgcaaggtggtctgaagcggtgcaccggtgtcttccgtggacttctggggtttagccacagctttggatgggggaactggggactgggttcccccatcacctgctcgtggaacgtctctcggatcgtgttctgggccaagaaaatccgagctggtgttcgtccagttgtaaccgtggcgaccacccaggtttcccacgagtcatgttaggtgggagcccctaaagagggtcgggatcctctatgcacctcacgatcgatccctgggagtcgactcctgagttgtgccttccagtggatgggacacattcgaggcctgtcgtagtagacatctgtcgtgggaaaaccctcgataatcgagcgcccaaccgtaaatgtaacccttaaccggccttattagccagatgttgtcctccatcactgcttccctggagattgatgcgcgccctgaagtgttgaccttgacagagttcctagagcaacctgtgtggccgtaccccgtattccacttcgctctggctaattttgcccctgtgatcttttgctgagaaaggctaccatgaacaggtttctgtacagaagatcaccattggtggttgggccagccacctggtggtgaatgggcctcggcatggtcatggtggtttgtgccttgtgcccggttctcggtccccatgtgttcggtgtgcttggccctcaaacaggaatcattgggtgggcgccgcccggtgcgcacacctcccgggcggggtgcgcggccaagtgagtggaccagtgg

SEQ ID NO: 483914 - DNA, 186 bp, Homo sapiens
  misc_feature (65)..(65): n is a, c, g, or t
  misc_feature (115)..(115): n is a, c, g, or t
agaagggttgaatgccggccaaaggcttttccacactcaaggcattggtatggcgttttcctccnactatgtgatcacctgtatgtccgaataagggtttgaattctggactaanacgttttttcacatattgctacatttagtaaggtttttctttaggtgtgaatcctctctatgttcaatcaa

SEQ ID NO: 483915 - DNA, 162 bp, Homo sapiens
cacgctctcacaggattcatggtacaccccgtactcgtggcagcagttcctctttgccttatatttgtggtacgcccgggcagccttcaagatagggtttggcacatttccgggcacctccagccaacacaccaaccacagctctgttgtgagcagcgttgg

SEQ ID NO: 483916 - DNA, 620 bp, Homo sapiens
  misc_feature (416)..(416): n is a, c, g, or t
tttacactctgagtacatgatgggattgtatctagatggccctcatgatcatgaccttgagggtcgctttctgaagcacaattttacctatactgaatgttagcctggatcctccattttcaattataaccaattgtgtgccctttctccgactaacttccactactgccctctttaaacaccatttgccatggagttcatgcaagtgttcattgttaacgctgcatataatcgtgaatgcgctccccagtgtatagtgaacgtttaagtgtgatcgatagcttatgcatgctaggagctctccaatactcatttcattgagatttaatcatacgctaatggaaagcttaccacctgtgatatgacctctgtgtccacatctcagctcttaagagctgctgtacaatctttgattngcttttctggcctctctttagtcacctgtcacaagaggttcctgctcagtcatgatactcgagagtacgataatgactcgttttctaatgcgctgcagatttataagaaacgatcctgttgtcattcgaaagaactgctagcttttatcttttaacgcactgaacatttccccaattgagtctatggatgagcagttctttgaa

SEQ ID NO: 483917 - DNA, 167 bp, Homo sapiens
gggaaaagtccaaaatactataaagtctagaaatgagttgttactatacttttcaccaacccaaataatatgttactggaggataagtgcataccggtttataagatttatttcatattttgatagcacaactatttatagggcaaccttaggatacagtagggaga

SEQ ID NO: 483918 - DNA, 293 bp, Homo sapiens
gcaaagtcaaatttagctatacacccattcaataactacaacaaatgaaggtggttttacctttaaggtagacatttgtggcctaggtgcggtggctcacgtctgtaatcccagcactttgggaggccgaggtgggtggatcacctgaggtcaggagttcaagaccagcctggccaacatagcgaaaccctgtctctactaaaaatataaaaattagctgggcatggtggcaggcgcctgcaatcccagctactcgggaggctgaggcaggagaattgcttgaacccaggagg

SEQ ID NO: 483919 - DNA, 286 bp, Homo sapiens
acagggatatagctatgactagagaggatatatatgaactccgtgcaatctgacacataaccaggcttcggacagcgatcattgagacctcttggaacattcatttcctcttcgacggaattggtgttttacagtagtcagccatctatcaaatactttggcagctggcagggggttgacacataaaacagcctcagggctggtgatgcactcctagtcattcccatgctcgctctcctctctcctctctctcctctctctcctgtctctcctctctctcctctct

SEQ ID NO: 483920 - DNA, 678 bp, Homo sapiens
accgcagaggggagcattcgatcattgggctgggcctattcctcactcgtcgactgatgctatgcttcgggcagaggaagaggctcaaccaacaggcgaagtggcctaaaactacggctatggcagaacgaaaatggtgcttaccaaccaaactgtacagaagcccaccggggaagaagcacgaccgtacacagttgagcacgaaagccgtcaactgaagcgctccctataccctcagagggaacaagactaatagctacaggcccggatccggggagctacgacagattcatacttatcagaagtcaacccaactgctcatacgaaaactgcccttacagaggaaagtgacctagatggcgcaggatttcaaaaccgagctgatgataaacacatcatgacatcgacacgcttgaagacactccagtggctcacctgctacacatgactgcagattccaagctgtttgacatccacgctaagagcgatcgcatgatgcccaaagacgttaagctggctaggccgatactgctagagacatgtccatacaacacagttagtcagagggacagtgagccatactggtcctttggactggtccagcattgactttgggcgccaagattctaacgaggctgattagcacttgagcttcaacatgcttaactaggcctgtcg

SEQ ID NO: 483921 - DNA, 201 bp, Homo sapiens
gcactcacatatcagtagcactgagcatacctcagtgccagagcttggtcgtaggtatcactccccaataaaaggcatccatgctccttgagaaacgggatgcttctaggacaagaacaggaaatatacaaagtgagcctggaacattttgtcgtgctagaaaataaggggtgtaggggtgtgtgtgtgtgtgtgtgtgtg

SEQ ID NO: 483922 - DNA, 81 bp, Homo sapiens
tttttgcgtgatgtggaattcgcgcctgtattttaaaaaatggtgtggtttctcccttgtttgtattttaataaccccctg

SEQ ID NO: 483923 - DNA, 151 bp, Homo sapiens
tttcaagtgatatctatgaggctgtggaaataggagacagctattggatcagatgcaaagatggggttgtctttggggagaaaaataggccttctaaaccttatgaaggagggtccacaaaaggctttttaatgttgatcggcaagttgga

SEQ ID NO: 483924 - DNA, 141 bp, Homo sapiens
tcacttgagcccagatttttgagagcagcgtgatcatggctcactgcagcctcaacctcacaggctcaatgcgatcctcccacctcagcctttgagtagctcagactacaggccagcaccaccacactcagctaattgtag

SEQ ID NO: 483925 - DNA, 685 bp, Homo sapiens
cgccgccggggtggggttcaggcgcttcgtgaaggttgaccgtatggcctatgtctactttgaacctcatgccgtaaaataggtcgcgattgtagatgttattgatcagaacaggtaatttgatcgatggaccttgcactcaagtgaggagacaggccatgcctttcaggtgcatgcaggtcactgatttcatcctgaaggttccgaacagtgcccaccagaagtatgtcctacatgcctggcaaaaggcagacatcaatacataatgggcagccacacgataggccatgaggattgaagccagagctagtttaagccactatgacagatttttgtcgtttgaaagttatgatgacaaccgaaaggcggtccacaataagcaagaatgtagttaagaggcttcaatcggcacctatcctgtaagattctcccaaaaaagcacctggtactaagggtactgctgctgctggtgctgatgctgctaaagttacagcaaaaaagaccaccggcgtgagtacaaagtgctcagccccagaaggctcctgcccagaaagccacaggccaaaaagcagcgcctgctccaaatgctacaggggccataaggctccccccagatagcactgttacaaggtatttggcaggaagcttacgtggttgcatgctgctgggctgaattaggttgcag

SEQ ID NO: 483926 - DNA, 269 bp, Homo sapiens
ggggggggttttttttacccccgctttttttttggaccccccctttccctggtggcccccccccccctgtttttcccccccttcccgcccccggggccgttcccccccccgggcccttccctcggccccggggcgggttccctttttcccccggggcccgctttttccctttggccttttttggttgcccttttggcccggtttgttccccaaggcgggttggggccggtttgggttttccggggttttgtcgccccccggggccccca

SEQ ID NO: 483927 - DNA, 379 bp, Homo sapiens
  misc_feature (33)..(33): n is a, c, g, or t
  misc_feature (90)..(90): n is a, c, g, or t
cctagttttagaagtttcaatagcaggtacacnagcaggtaaatggcctcatgggcatcatcgacaactggaatgcttaaaggagtggcngggattctgttccagtcaactcaagctacgcagcaaggcaagctcagttgacagaatttcctgtaattcaaaagaaactaaaaattttctatggcttctattgatttatttatttagagacagggtatcgctctgttccccagactggagtgcaatggtgtgatgccatctcactgcaacctcagcctcctgggctcaagcgattccccccacctcagcctcgcaagtagctgagattacaggagtgagccatcatgccggcggtgctattgaaacttctaaaactagg

SEQ ID NO: 483928 - DNA, 373 bp, Homo sapiens
ttcgcgcccgaacacagtcatctgcttgaggcatactcttaagtcgccacacacaacctcctctcttatgctatctcgcagtaactgtaacccgcattccattaccacaccctgctctcgccaacatcgttcacataaccttcaatacacccatgtagccctctcattcgactgacaccattttagttatttttggccttcttaaagctgggcaatgtaatgatcagactccttgtttgtctgaacacgcatctttatacatgccttttgtaaaccaaaaactttctcaatctctccaggtctctcacatgcttaccactgggctactgtaaatgagacacagaataaaattatttcctgttctaaaaaaaaa

SEQ ID NO: 483929 - DNA, 740 bp, Homo sapiens
tggccgatggattccaagtccccaggagggcttaattttttcttttcaacatccggtcctgcggcttcctgggctcttttggcccgtatgccgaaaagccgagcgtgtggcacgggccatacggaaactagcgaaggcttggaaattcttctcttcctcagtgatgactcgagctttctccttcttatagacgtcccggaggggcatgaccggtccggtcagctgggtggccagtttcagttcttcagcaaaactgtctcccttctggggggccgagggctctccgggggaagaggatgagttgggagcggactccttcagccgtctgcacgtggcgcctgcagggactccggtggacgttgtcccgcctcctcggatccacagaaaatgccgagtggtccgggccacctctctgggtgaatgccggccaccctgagctcctccaggctgaagccgcggccggcgcgcaccttcggggggtaccgaaccgtggggcagcgcacgattgggccggagtgggacccgacgcggtggcgacggggacaatgctgggcgcctgggtttgccgggcctaacgtactgggggatctatacgcgccggctggttagaaccacgtggccacgcgccgttgccagtcctttgtgaaagtgggggcttcaagaaccatgccattcccggtgggcgccatggttgcctagggccctggggttccctgcgccaggaaagagagaggagagac

SEQ ID NO: 483930 - DNA, 963 bp, Homo sapiens
ccagggaggctctgggtggctcgtaaggattcccggggaagggtaaaagtcccaccgcgtaggtgaggtcgaacgtctagggtgcattgtgggcgagtcacggctgtagtgtttggcatcggggttgcgaccagttgcgctagcggatgtatcgataggttcgtagaggggcgctagagtcctttgtagagcccgtttcgctggcgttgcaattgcggaggggcgaaccgggtgcactcctgtgtatgcgcccgatgcgcgggggtgcacggccgcagctgcgagagcgaggatgccatcagtagccccagcgctgcgtggatgcgatcatagtggagaggtgctgggtcaggctgtatgatgaatgcatggtacctctagtcgctttctcgctgacgcagggtctttgcccctggagccgccactttctgggactgttgcctagcgtggcacatcaaaggctcctttgcaggacgcaagtgcaggagtcctggcaaggatggctgccagcattggacttgtgggagccgtgaataatagaggatgttgatagcccacagctaacgaccccgcaagggagctgtgggacctcttgttcctgcgctcgtgcagcatcgcagtctcctagggggtgtcagccatgatgacgtgaacctcaggcttgtcagtctagcagcctctgcctaccgagcccggcagctgctaggaggaggcagtcacgtgtgccggcaccatgacaagtgcctgacgacggtcaggcacttagagaatacctaaggccacaatccacttctgcactttgtttcccactcccattagccctgggccacctcctccagttcttcctcttttacaaatctagttggtcagctttggagagcttgagctggcaccataggagggtagcgcatggtgggggctgggtgggggactgcccacagatagcacgtagcatataggaaa

SEQ ID NO: 483931 - DNA, 107 bp, Homo sapiens
tcaaggattgtctgcgccctcactccggtcgacctgctcgaagattgcgccgatcaccaccgtgcgccgttctcggccgagtacctgtgtcttcacgtgcttggtgt

SEQ ID NO: 483932 - DNA, 518 bp, Homo sapiens
tggggaaatacaatggaatattattcagccataaaataaaatgatgtactgatacatgctgtaacatggatgaaccctgaaaacatgctatatcaaagaagccagttccaaaggatcatacattggatgaacttttatgaaatgtccaaaacagggaaacccatagagacagaaagtagactggtgattcccaaagactggaggagagaaatggattgactgctaatgggaggttcttttgggggtgatgaaaaatgctttaaaaaattgatttggtgatggttgtacaactttgtggattttttgaaaaccactaaactgtacacttttaaaaggtgaattttatgggatgggaataatatctcaatttttttaaaaaacgggaagcaaaaaaaaatgggaaacaaaaaggttggctgggttgggatggccatttcaattttaacatgttgtgcactttgtctcttggagggtaaaatgggaaaccccggccccttaaggtttaaaaaaaaggggcc

SEQ ID NO: 483933 - DNA, 658 bp, Homo sapiens
  misc_feature (23)..(23): n is a, c, g, or t
  misc_feature (105)..(105): n is a, c, g, or t
  misc_feature (109)..(109): n is a, c, g, or t
  misc_feature (160)..(160): n is a, c, g, or t
  misc_feature (162)..(162): n is a, c, g, or t
  misc_feature (200)..(200): n is a, c, g, or t
  misc_feature (207)..(207): n is a, c, g, or t
  misc_feature (268)..(268): n is a, c, g, or t
  misc_feature (285)..(285): n is a, c, g, or t
  misc_feature (295)..(295): n is a, c, g, or t
  misc_feature (378)..(378): n is a, c, g, or t
  misc_feature (380)..(380): n is a, c, g, or t
  misc_feature (417)..(417): n is a, c, g, or t
  misc_feature (420)..(420): n is a, c, g, or t
  misc_feature (422)..(422): n is a, c, g, or t
  misc_feature (428)..(434): n is a, c, g, or t
  misc_feature (497)..(497): n is a, c, g, or t
  misc_feature (657)..(657): n is a, c, g, or t
caactccggtacactgggcctgngggtcaacttcattcgccagctgtgtctttcctccctcactttgcttgcgcgaaagcactctgatagctttcatctccatcntccncatctcggaactgaatgggaccttctgaatcagagtcgcacacctacacancntcctcccgtagacacagaggtaatttaggaatgacggngggaggngtcatttcttcacccgaatgcggatggacagcgtttggcccctcttcttcttcatcgtcanggaacttttgagcattncaatagtgangggaagacgcacctggcccgacccagcgaacagcagaccacagaaaagctgtcactgttttcaaaaagcaacgaatgagctcngngagaaccctccagaataggagtcatgggaagtgggcnggngngggccnnnnnnnttcgaatatgcagtgggagtggagggagcctagagggtatatgggggtcccaaagttctggtncagtatcctcttggggacttcctttttctgatcttcctgctggggaatctcctggtgtatatctaaggatggtggaaactcaatttctggcacaacttgaaaagtcttagcagggaatggaggggtgcgtggaggctctggaggtatatgagtaggcagnc

SEQ ID NO: 483934 - DNA, 107 bp, Homo sapiens
tctccgttttcctggttacttacttgtctgccctcggggccttggtttgtgcaagcggttttagtttcttaaagggcgggttcccggttttccccaaatataggggc

SEQ ID NO: 483935 - DNA, 249 bp, Homo sapiens
tattgggctccagactcatggatcctaaccttccccgggctgtttctacttggatctgtttttttctcttgctcttagcagtgtctaaatgtgaatcttgtttttctatcttccttactcatcccccactctcctccaacttaaagcaccattaaacacccacgccctgtcctactcttgtcctcgtccactcttgcatgccatgctattcaagttaccccacctgccttgtggttactttacttggca

SEQ ID NO: 483936 - DNA, 738 bp, Homo sapiens
gcatacaatgcacttgcttttagtatattcacaatgttccaggcaatttcatcatgtcccttccaaaatcccattatgcataaagtggttacaccctattctgcttccctgagccctaatgaccactaatctaatttacatcccaatgatttgccaattcctgatgtttcatgtgaataaaatcaagcaatattgtcctttgtgcacttaacataatgctttcaaatttcaccaatattataccatatataagtacttcattctttgttatagctgaaaatttggtgtccagttatgagtcaacaagcatatggattgtttccactttttgactgtatgaatattactgctgtaaatattcatgcacatgtttattttttgagcacctatgtttgtaagattaacagctgacttaagagaaacaatggaaggcaagaggcagtagaataatatattcaaaagatgcaaaggaaaaaaaactctcagccacgaattccttatccagcaattattttgtcaaacaatgaagattaacacaaagactttacccagataaacagaaatattagctgaagttgttgctggcagacctaccacattaaaaaaaaaacttccttaaataaatccctaggggtaaaaggccggttacagaagaccgcccttgaacccacttttaacaaagccggtttgggaacttgggcttttaaacgacgcacaccgctttgccctatccaaacg

SEQ ID NO: 483937 - DNA, 490 bp, Homo sapiens
  misc_feature (314)..(314): n is a, c, g, or t
ccttgtgtgtggggtgagttttaaaaatcagagcgctctagccactactgggtagaaagtagcatttttttttacagttaataacatattggggggtggggtggggtgtaacttggtgttcttcctccttagcctattttctggtgcgtatggtcggtgtggggcccctttcacagctgcacaccacgaaaggtgatatatcttaaagtggtgttctgagacctcataaaaaggggaatcaagtctgggcaagcacagtcggaagatggccttttaacaaaggcggggaatttggctggtcatatccagatggnaggccgatggcccgggctttcagcgtagcatggggagttgcccctgcaagtctccttccagctctccctaatcgattccacggacaaggtccctaccccagagcttccagtgcaagggaattcttcaagtttaaatcgggacacaaaattcagatcatggtatggcatcatttagg

SEQ ID NO: 483938 - DNA, 827 bp, Homo sapiens
  misc_feature (665)..(665): n is a, c, g, or t
  misc_feature (678)..(678): n is a, c, g, or t
  misc_feature (745)..(745): n is a, c, g, or t
  misc_feature (748)..(748): n is a, c, g, or t
cccacgcgtccgcttattaatcttcattcttctactatccccaatcctaatttcaatatcaaacctaattaaacacatcaacttcccactgtacaccaccacatcaatcaaattctccttcattattagcctcttacccctattaatatttttccacaataatatagaatatataattacaacctggcactgagtcaccataaattcaatagaacttaaaataagcttcaaaactgactttttctctatcctgtttacatctgtagcccttttgtcacatgatcaattatacaattctcttcatgatatatacactcagacccaaacatcaatcgattcattaaatatcttacactattcctgattaccatgcttatcctcacctcagccaacaacatatttcaacttttcattggctgagaaggggtgggaattatatctttcctactaattggatgatggtacggacgaacagacgcaaatactgcagccctacaagcaatcctctataaccgcatcggagacatcggattcattttagctatagttgattttccctaaacataaactcatgagaacttcaacagattatattctccaacaacaacgacaatctaattccacttataggcctattaatcgcagctacaggaaaaatcagcacnaattggcctccanccatgactaccatcagcaatagaaggcctacacagttcagcactactacactcagtacatagtagtngcngaatttctacggtcgattccacccctcaagactaataatacttattttaacatattaattgctcggagctaacacatat

SEQ ID NO: 483939 - DNA, 319 bp, Homo sapiens
aagaaaaaggggagggagtagggaagaaaaagaaaccaagggaatcacaggaccacggcagctcgtgtctgtaatcccagcactctgagaggctgaggtgggaggatcacttgagcccaggagttcgagaccaacctgggcaacatcgtgagaccctggctctgctaaaaactaaagccagatgtgatggcttgtgactgtagtcctagctactggggaggctgaggcaggaggatccctcgagctcaggagggcaaggccaccatgattgtgccactacactccagcttagatgacagaatgagaccctgtctccaaa

SEQ ID NO: 483940 - DNA, 766 bp, Homo sapiens
gggacccggaagtggcgccctgggctcgcaggagggtgccgcggggatggcgggagccggagcatggagccggagctcgacggaggagacggcaggcgggggtcgaggctcgagctcgctgatccaccgaccgcgcaccagagcaacatcctcagaacaacacatcggacctgcggctcagaccctcggcccctgcaggatgcgcacttggcgggatcatggggggcctggggggtcctgggggaacaaacaggccacctgaaccaacctggagggcatcatatatatacagagggaaacaatgtggaagcagaggcagatagaacggccagctcaaggacagtaccccacttgacatctaacagtgaaatgctgcactcagtcccagtgatggcgtcacatgatgccggatgaacgcacacagaaaacactatggggaccccaattgatgtctggtgagcagggaaagggtcccatactatcatgccagaagacttcattacaccctaccggacacaagttaacagtcgtgccacacgtgggcatggtacaaggcatacggggggcctaggatcccggaaggagccctagagagttccaccccgggattgcagtgttcccaaaacaggccacatacatccgtagcttggtggaactcaggcgggggatagagccatggcaagaaaagggttgtaccacgatcccagccaattgagacattgaaggcaacgggtttaccaaacgcacaggcatgcatattgaaagg

SEQ ID NO: 483941 - DNA, 877 bp, Homo sapiens
  misc_feature (10)..(10): n is a, c, g, or t
  misc_feature (17)..(17): n is a, c, g, or t
  misc_feature (27)..(28): n is a, c, g, or t
  misc_feature (35)..(35): n is a, c, g, or t
  misc_feature (40)..(41): n is a, c, g, or t
  misc_feature (43)..(43): n is a, c, g, or t
  misc_feature (47)..(47): n is a, c, g, or t
  misc_feature (64)..(64): n is a, c, g, or t
  misc_feature (66)..(66): n is a, c, g, or t
  misc_feature (77)..(77): n is a, c, g, or t
  misc_feature (79)..(80): n is a, c, g, or t
  misc_feature (84)..(84): n is a, c, g, or t
  misc_feature (86)..(86): n is a, c, g, or t
  misc_feature (136)..(137): n is a, c, g, or t
  misc_feature (141)..(141): n is a, c, g, or t
  misc_feature (143)..(143): n is a, c, g, or t
  misc_feature (146)..(146): n is a, c, g, or t
  misc_feature (148)..(148): n is a, c, g, or t
  misc_feature (152)..(152): n is a, c, g, or t
  misc_feature (161)..(162): n is a, c, g, or t
  misc_feature (166)..(167): n is a, c, g, or t
  misc_feature (172)..(172): n is a, c, g, or t
  misc_feature (217)..(217): n is a, c, g, or t
  misc_feature (219)..(219): n is a, c, g, or t
  misc_feature (221)..(221): n is a, c, g, or t
  misc_feature (228)..(228): n is a, c, g, or t
  misc_feature (253)..(253): n is a, c, g, or t
  misc_feature (269)..(269): n is a, c, g, or t
  misc_feature (288)..(288): n is a, c, g, or t
  misc_feature (299)..(299): n is a, c, g, or t
  misc_feature (303)..(303): n is a, c, g, or t
  misc_feature (305)..(305): n is a, c, g, or t
  misc_feature (307)..(308): n is a, c, g, or t
  misc_feature (314)..(314): n is a, c, g, or t
  misc_feature (334)..(334): n is a, c, g, or t
  misc_feature (341)..(341): n is a, c, g, or t
  misc_feature (347)..(347): n is a, c, g, or t
  misc_feature (349)..(349): n is a, c, g, or t
  misc_feature (353)..(354): n is a, c, g, or t
  misc_feature (365)..(365): n is a, c, g, or t
  misc_feature (379)..(379): n is a, c, g, or t
  misc_feature (393)..(393): n is a, c, g, or t
  misc_feature (405)..(405): n is a, c, g, or t
  misc_feature (413)..(413): n is a, c, g, or t
  misc_feature (421)..(422): n is a, c, g, or t
  misc_feature (428)..(428): n is a, c, g, or t
  misc_feature (430)..(430): n is a, c, g, or t
  misc_feature (432)..(432): n is a, c, g, or t
  misc_feature (434)..(434): n is a, c, g, or t
  misc_feature (441)..(441): n is a, c, g, or t
  misc_feature (448)..(449): n is a, c, g, or t
  misc_feature (451)..(451): n is a, c, g, or t
  misc_feature (462)..(462): n is a, c, g, or t
  misc_feature (464)..(464): n is a, c, g, or t
  misc_feature (477)..(477): n is a, c, g, or t
  misc_feature (480)..(480): n is a, c, g, or t
  misc_feature (488)..(488): n is a, c, g, or t
  misc_feature (494)..(494): n is a, c, g, or t
  misc_feature (866)..(866): n is a, c, g, or t
taaaaaaccnggtttantgggaaaacnncaaaaanaaaannanaaanaactttttccacaactnanaaaaaaaaaancnnaaantnaaaaaaaaatggttttcattatgtaagtctaaaaggaaaaaaaacaaaannaccnanccnangcancaaaaaaannccanncaaanaaacccaaaacccccaattcccccgtggcatgttttaaaacaaanantnaaaaacngtttaccaaaaaaaaccaggatttnaacaaaaagtaggttnccgcctacaattgcaaacnaacaaaagccngtcnanannaaaaancccaaaaaaacccgaaaatnaaaaaancaagtnanttanncccccgaggcngttttagtggcacntttgtgacaaaaangacccccccaangccttacnacacaacnnaaccanancnancagtcangaaaaannanacccagtccancnttcaatccagtcnacnccggttcngaacanataaacacaaaacactacagatttattaatatagcattttcccacaccctaaccctataaagaactttaaaagagaaaatttcatctaaatatttcacacttaaaggaaagccttaccaactatggcaacaggtttggaccatgaaatagtactttcctagatgacatatcgagtcaacatgaagccttagctgaaatgaatgattcaggatattaatgagaaattctcacaaatgatatgcatttaggaaatgattttgctttccttaaatagttcgaaggcttgaaaataaactttttttttgcatttcttttagaatgtttggtcattaacaacttttaaccttatcttcctcttctccttagcccttnacagaccaagt

SEQ ID NO: 483942 - DNA, 323 bp, Homo sapiens
  misc_feature (30)..(30): n is a, c, g, or t
  misc_feature (47)..(47): n is a, c, g, or t
  misc_feature (64)..(64): n is a, c, g, or t
  misc_feature (114)..(114): n is a, c, g, or t
  misc_feature (169)..(169): n is a, c, g, or t
  misc_feature (299)..(299): n is a, c, g, or t
tccttattggtcagcctggacttgcacccntgacctccaggtgaccnaccaacgtcaggctccnaaagtactgagagtccagtcatgatcctctgtgccagagaccgacaaacnctccagcattctaatagcaatttgatgaccagccaactagccttgactaccctcntggtcaccctatccctaaatacctatctggtgagatgctactctgtactgagcaaataacgatctgtatgatacatgattatacactcttgctacaaagaggtgtacaacattgtgggttggatccctanactccctttacatgaaaaaaaaaa

SEQ ID NO: 483943 - DNA, 137 bp, Homo sapiens
taaagtatgctgtgagcaggataccttccatttgatgtgctctgtggccagggagcatgtgatggacaccttagttcgtatactgtctcgctgtgacatcatggtgctgcaggaggtgttcgaactcttcctggcag

SEQ ID NO: 483944 - DNA, 103 bp, Homo sapiens
ttccgtgagctctgagcaccaggcagggatgaccaccccatctggctgggtgctgagaggtcaggggaagaccttggggctggtcggggatgcagaggagacg

SEQ ID NO: 483945 - DNA, 859 bp, Homo sapiens
gtcatcactcccagaattatctagcacatgcagaagattcgtgggagtgatgacatagttcttaaagctgttcctggtacaacaaaatgagtgagccacaatacgcaaaggctggatgatagtcacattgctgctgccaacagacactagtccttagtccaacaatgtctcttacataaaacaaccagaggtggaacaatctaaatgtgggatagcctcgttctccattacacaaatgtacttgcaagcgatgtgctatgtcgtcgcatcttcctacatgtagtcttcacactatacagcacagatagtcttcatggcagtctaacatccaatcgacataaggaggaatgtcgaaaattctcaagataggaagacaggcgttacgtccagggagtgtctcagtgtatactatttcttctccaaatgcccttgttagttagatactcgtgcacaacaggcatactgcttggtggactgcatggtcatgtctcttatttgtccacgcagcttgaaggtaagtatagctatgtcgagtgtcttgcaaaggagcccctgtggatgagatgtcagaactctccaaggagctcgggaacatcttctactagggcgcgaacatctgtgattggcgtcgagcgaaccagacagaatcatggatgccgacagactctggtcagtgaacccaagccaagaccgaattgtcacatatgcagatatcttgacaatgtcagtgctgggtacagatccaagatgctccagagttagggacaaaagctctaagaatctggcctaaccagttgcagcgtggaacacgtgcgaggaggctgtaatgctagatactaaggttttacagcaagtacca

SEQ ID NO: 483946 - DNA, 718 bp, Homo sapiens
  misc_feature (387)..(387): n is a, c, g, or t
cacgagcatatttcacctccgctaccataatcatcgctatccccaccggctgtcaaagtatttagtctgactcgcgcacatttccacgggaagcaatatgaaatgatctgctgcagtgctctgagccctaggattcatcttactatttcaccgtaggtggcctgactggcatgtgtattagcaaagtcatcactagacatcgtactacacgacacgtcactacgttgtaggctcacttccacttatgtccatatcaagtaggagctgtatttgccgatcataggaggctgtcatatcacgtgatttgccccgtattctcaggctacagcccgtagatcaaagctaggccgaaaatcctatttacactaatacatattcagtcggcgntgaatctgaactttccttcccacaaacactgtttctcggcctaatccggtaatgccccagactgttacctcaggactaccccggatgcatactaccacagtgaaacatcctatcgatctgtaggctcattcagtttctctaaacagctgctgactattaagtaattttcatgatcttgaagaagccttcgacttcggaagcgaaatagtcctaaagtagtagaagaaccctccataaagctggagtgacgtatatggatgcgccccagcctaccacacattcgaaggaacccgtattcctgaaatctagaccaacaaaaggacggaatcga

SEQ ID NO: 483947 - DNA, 134 bp, Homo sapiens
ccctagaggatccccctctacagccatcctgcacttcagactattgtcggagcacggatctaccactcaaggaatacaggaggccaattccaagaaatggaataatattttcaaggtcattcaggtgggctctg

SEQ ID NO: 483948 - DNA, 368 bp, Homo sapiens
  misc_feature (266)..(266): n is a, c, g, or t
  misc_feature (328)..(328): n is a, c, g, or t
  misc_feature (351)..(351): n is a, c, g, or t
atcttgctctgtcgcccagactggagtgcagtggtgtgatcacggcttgctgcagcctcgacctccctggttcaggccatcctgccacctcagcctcctgagtagtagggactacaggtaggcaccaccacacccagctaatacttttaatttttttttgtagagatagggtctcattatgttgcctggggtagtctcgaactcctaggctcaagcgatcctcctgcctcggcctcccaaagtgttgagattataggcgtgacacncgtggcccagattcacagaagtttcatacacctttcacccgggttccctaatgtttaacagnttacattaaccttggtacatttntcaaactaaaggtgcat

SEQ ID NO: 483949 - DNA, 1515 bp, Homo sapiens
  misc_feature (3)..(3): n is a, c, g, or t
agnggagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctccaaacccatccaccagcatgaagaccgctgcttgaggttgaaggtgactgtcagtggcaaaatcactcacagtcctcaggcccatgacaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtgtgccacacctggccttaaagagggacaggctgaagagagggacaggcactccaaacctgtcttggggccactttcagagcccccagccctgggaaccactcccaccacaggcataagctatcacctagcagcctcaaaacgggtcaatattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgga

SEQ ID NO: 483950 - DNA, 157 bp, Homo sapiens
tgtcagtgcactgaatgcctggtcgcctataactggacggtgtcacggtggagttgtcgggtgggggttgggttgccgtgccttgtttctctttcgtttctctagaagcctcgattttatccccgcttccttcctttcctcttgctgccatgccagc

SEQ ID NO: 483951 - DNA, 360 bp, Homo sapiens
tgtagccgaggcactgtacacctttcagaccagtctgcaacctcaggctgagtagcagtgaactcaggtagcgggagcagtccattcagccctgaatattcctccttggtcactgccttctcatgagtagacatgctcttctttttcaatcacttcaggatctctgtagaagtacagatcaggcatgacctcccatgggtgttcacgggaaatggtgccacgcatgcgcagaacttcccgagccagcatccaccacattaaacccactgagtgagctcccttgttgttgcatgggatggcaatgtccacatagcgcagaggagaatctgtgttacacagcgcaatggtaggtaggttaac

SEQ ID NO: 483952 - DNA, 1030 bp, Homo sapiens
  misc_feature (3)..(3): n is a, c, g, or t
  misc_feature (926)..(926): n is a, c, g, or t
  misc_feature (928)..(928): n is a, c, g, or t
  misc_feature (937)..(937): n is a, c, g, or t
  misc_feature (944)..(944): n is a, c, g, or t
  misc_feature (948)..(948): n is a, c, g, or t
  misc_feature (954)..(955): n is a, c, g, or t
  misc_feature (957)..(957): n is a, c, g, or t
  misc_feature (965)..(965): n is a, c, g, or t
  misc_feature (967)..(967): n is a, c, g, or t
  misc_feature (973)..(973): n is a, c, g, or t
agnggagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctccaaacccatccaccagcatgaagaccgctgcttgaggttgaaggtgactgtcagtggcaaaatcactcacagtcctcaggcccatgacaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtgtgccacacctggccttaaagagggacaggctgaagagagggacaggcactccaaacctgtcttggggccactttcagagcccccagccctgggaaccactcccaccacaggcataagctatcacctagcagcctcaaaacgggtcaatattaaggtttcaaccggaggaggcaaccaaccgaaagtccatcccncntcactcggnggatggngaanagtggnnantctttccncnattctncctttaacaaaaaaaaacggtcaggatggccttaaggaaatggggcggactggaggg

SEQ ID NO: 483953 - DNA, 1389 bp, Homo sapiens
  misc_feature (1388)..(1388): n is a, c, g, or t
aacccagcattggtatgtggagaaacggatgcccagtagacgttgtgacttatccgggtcacttctgcaggtctggagtgtcccaccctgagatccatgatcaggggctctcttctggcacaccaagtcaccacagtgcccatcctctgctgttgactgagctagtggatgaggagggagactacctagaggcttagagggtgcttggcgatcccattattccagatccagaagagtacattgatgcattagaaggagtcttgagaatggtagcaatggcactataaacccaggaaaggatccagcagggtactagttgcatgctcagtgaagacatccagggaaggccgagtatcaccggggaacatgttggaatgcccatgatgacggaacatctcagggaaggcttgcatgtggtgagaacagaccgctgaactaaagggaagtcctaggagagttccacgggaaacccccgagggaaatcccgggaattcgatcagtcctcatggactaactcgtacgtcacggagaccctaaggccccaggaggggaaaccgtataacgtaggtgaaaaaccctgtgaactggacggatgggcaggaacggcaagcacacgtgggggtgatgacaagtgagtacactgaggggcggggccttaccgaagtcagggaatcccgagggcttcggggttcgcgatatgcttacgaagaatttggggctttccagaaagacacagggacacacttgttgagcctccaccggttcgagatcctagtggacttcccagtacccctgtggaacctcacacgtgaaactcttgggggctagggaccacctccttgggtgctgcggcagcccgacgaagccgagactcccaaggcagatcgcaaggaccctgactggagacaagggcattggaacctctccagacaatcccgccccaggaacctaggaaggccatggaatcaaccccaaggaagcggcagcagtgacaaacacccaagacaaacggcgcagcacaacgaccccgcaaggcgactagcacaggatcgagaccaccctgaacaccttgccaacacaaaaggggagacctacaaatccaacggcgataggcatcgaacagatgtggagccacccgcggcccgagggtacacaaacgagccaaaacaagggcggaacatccaccagcgggtaccacaccgcgaacagggcgaagagggacagagaaggaccagcaacgagagacagagagaagaagacaccaaaagcgaagtaacaacaaagggcaacacgagaccagagaaacaccaacagaaggggacacaccaagaggaacaagacacgaaaaaaggaagaacacacagacggagaacgagcgccacagtcang

SEQ ID NO: 483954 - DNA, 466 bp, Homo sapiens
gaagcagtattggggaaagtttttttagactagggagaacggagggagcccggcatctttttttttttatcggcttctgtttaaaaagccaacattcctcggcttcataggggttcggcatttggggggaagggaaatttttgctgttccccaaatgaaatgttttagtcccttccaaccagggttgggggggggaagggggtgaaaaactaccattgaaattttgaaccagcaccaggggggggggattttatttttggttatggtggggggtttaaaaaatcccccccaggtaattattgggacccccttgctttggggtccctgtaccatttggggggggggccaggggggaaaagtaccaatagcccccaggccccgggcttttgttcaaaccagggggcaaaaggaaaggtttttttgtaagaaacgttttatgatttttaaaataaatttagggacccta

SEQ ID NO: 483955 - DNA, 723 bp, Homo sapiens
  misc_feature (5)..(5): n is a, c, g, or t
  misc_feature (49)..(49): n is a, c, g, or t
  misc_feature (52)..(53): n is a, c, g, or t
  misc_feature (56)..(56): n is a, c, g, or t
  misc_feature (58)..(58): n is a, c, g, or t
  misc_feature (61)..(61): n is a, c, g, or t
  misc_feature (64)..(64): n is a, c, g, or t
  misc_feature (81)..(81): n is a, c, g, or t
  misc_feature (83)..(83): n is a, c, g, or t
  misc_feature (92)..(92): n is a, c, g, or t
  misc_feature (95)..(95): n is a, c, g, or t
cgccnaattaaccctactaaagccccaattaaccctttctgggtcgccnaannaancntcnctnaagtgctgggattacangngtgagcacngcncctggcctaggagtagtattaagtggcccaggcaagaggaacatattcagactcggaggaatgaaggatgaaatgtggggaggggcagtgtctatgctgagggttatttccaaagaatgagaggctgggctgaacattgggcaggaagttagcaaaaactaaggagggtaggaatcaaggttagagggaagagaagaatgaaattgagtagggagctgagaaagcagggcgaggggcatttggacttacattttcttccagcaaaggtttcttatttaacccctgtgggcttatcttgcagccaaacccatccaccagcatgaagaccgctgcttgaggttgaaggtgactgtcagtggcaaaatcagtgagtgtcggagccctgtgggcctccttcctccatctctatgctgggtgcggtctagtgatctaggatggtatagaagtcttgcagcccagcccactcatacttacagccctctgcctctttgatacagtacctgatctactaccactcttgtctttcagctcacagtcctcaggcccatgtcaatccacaggagaagagacttgcagcagctgcagcaggtgggtagcaggagcggtgagcaattatgtgggacgagca

SEQ ID NO: 483956 - DNA, 248 bp, Homo sapiens
gttttgcggtgcctttctgtttgttagttttacttctaacagacaggacctcagctgcaggtctgttggagtatctgcagtgtgaggtgtcagtgtgccctgctgagggtgctcccagtataggctgctcgggggtcacgggtcagggacccacttgaggaggcagtctgtccgttctcagatctccagctgcgaactggggagaacacgtgctctcttcaaagcttgttagaaagggtaccatttaa

SEQ ID NO: 483957 - DNA, 1836 bp, Homo sapiens
tcggtaattttttccttgaaagaaaccaaagttatttttatcagcgtggttgtggaatagggttaagtccgctgggaattagctgttgccattaacattacttgtgtaacagaaaagtgcaggtgacttatactagagaacaagtattatgtgtttaaacaaaagaaacattgtggcaagaaacaacctatagtatgtgagtataaaaaatttctcacagtatatgtgagccagacacgcacatatataagcgtggtataatctagaaggtgatcaacagtgggaatatagtggggttgtataatagggtgtgaaccattaggtgtatacagcgtgttacagagttaaacgccgtgagacctctacagaataactaggatcataacggaggtatcaccacgacgaagtgtgacacgcgttgtcgaacatattataacacgcggcgggcaattatatctcacgagcaaacaggattataagacacagcgttgcaaaaactgtactcgcagccgttggtataacactctctgtccagaacattcttctatcacaagcccgctgccgatttatgaaagccttgagaagcaccatgttccataatcatgacaacgatactagaaggacatggaggacaaaaacggcgcggaactcctataaacccaaccatcatacgataggaaaattgacaccaccctagagcagaaacaacaagagcgcgccaagtcgaaccactctacacgcaaccacacacctagactacgcaagccaaacaagaccccacataatcgttagcaaccaccaagaaccgtataaaactacaagacgaaacagaggtaacaaagagctaaacagcgacagatgaaaggaatcaaaaaagaaggcaatacgccaaggaccaagaccactaaacaaccaactcacaacagcacaattcttgaccaaaaacgtaaacaaaagataacatacacgcacttcccactataacaccagaggaacaacaaacagagaggctgcgatacaaaacgattgtggaatgcaatcacacgacatctattaaccaagggggctcacgaacaacggtaagagaacggcgtcctataaccccgtgtgagacacatatacagcgggaggggcataatgcaatccgcagccacggaaatccaacgcaaacacagcaagcaattgtgcggcatactgagaaggaaacagacggacgatatcaccaccaagcgactttgatggcagcacacgcgaaacgagaacgggccacacaagaccagtaaatatgacagcgagcaagagagatgaaactacaacacgacgaacacagacaaaccacacgcagcgagcgccaacaccaaacaactccgacacaacggcacaaatcagatcgtcgcgaggaagccaacgccatgaccgaaacacaacgacagcagaacaacacagtacgcagcaccagctgagacgataacacacccaacacgaagcagagctcgcccacacgcagccacagagtcgaccacacacagacaacgcaaacgccacagaacagcagccaaatcagcaaaaaagacgaacagccagaaataacataagcgccataccaacagcgcaaacacacacaaatacacaacgcaaacgcaagataagactaagcagcacttaagacaaaccacacaaatgataacacaacgaagacaaacaaacatcccacaacagacaacagcgagcacacaatgtcaaccagcaaacaaggcaaaggaagaacacagaagaaacgcaaagggacaaaacgagaagaagaaaaagaaaaaaaacatcaaactactaggccaa

SEQ ID NO: 483958 - DNA, 569 bp, Homo sapiens
cctcacactcacagaagccagctaagtgctccatcagcgacttgcactctgcactcagctactttaggcggtgtgtgtcacggtcaaatcaaagctgtggaaatctggcagcaatgccggctgaggagcttgttgcaaaggcacagatgaatgacgtccgatggaacgcgaccattcgctgccctgcaggtcatggaagatcatttgtccctgaaagtgatcaggggccacctatcagctctctggaatacaaggacctcaggggcatatgcacaagactgagaagttacaaggatgctggccaaagatggtccgatgccgacaaacaagagctatacgctgggaactgttaggagaaggcatacgcaggcctgaggaacggtctatttacaggctttggaggagccataatccccagttttctactggctgctgatgttgcctgagaagcacacgaggctgagtgggatccagttacaccagagaatttacttttagaagatggttttctgcatgtagtagagcccctaaaatgtggcaaagaaaagaaaattacaatgctaaatgag

SEQ ID NO: 483959 - DNA, 239 bp, Homo sapiens
cacgagcaagcatgctgcctctcctgtacctggcttccaagcaagaccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgga

SEQ ID NO: 483960 - DNA, 291 bp, Homo sapiens
  misc_feature (242)..(243): n is a, c, g, or t
  misc_feature (286)..(286): n is a, c, g, or t
cacgagcaagcatgctgcctctcctgtacctggcttccaagcaagaccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcggacanncttttctgccactccatattaaaacatatgaccattgagtccntgcta

SEQ ID NO: 483961 - DNA, 643 bp, Homo sapiens
  misc_feature (152)..(152): n is a, c, g, or t
cttcgggctggccttgtggggcggggggggttttcgcgcgccgcccccttggggtctccctgggtgtgttttcccggttgtcccctttttcgtcctggcgggtgattgccctcctggcttatggcccgtgggtggcttttttggtcttccgncttggccggtcctcccccctttatccttcggtggtttctgtttggccgttttgcccggcctccttggggtggtttccccgttgctccccgggatttcccaggtgcggcgccttgggggggtgggggttttttttggcccccaattttttggggcttttcaaaatgtggggcccccccccccccctttttgcccttggggggttggggggggggggggaggcctctttttctttgtttgttttgggggggggcggattttctttccccgccctccccgttgtttttgcctccctttggggcgcccgggcctcccccccctttggttttttgggggggggggggggggggttgcccttttgcccggggggcccctttggccctttgggcgcttttgggggcccttttttacccgtttggcccgctgggcggggggggggcgggccggggtttccggggttttgggggcccccggggccgcccccggggtcgga

SEQ ID NO: 483962 - DNA, 1567 bp, Homo sapiens
  misc_feature (3)..(3): n is a, c, g, or t
  misc_feature (1518)..(1519): n is a, c, g, or t
  misc_feature (1562)..(1562): n is a, c, g, or t
agnggagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctccaaacccatccaccagcatgaagaccgctgcttgaggttgaaggtgactgtcagtggcaaaatcactcacagtcctcaggcccatgacaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtgtgccacacctggccttaaagagggacaggctgaagagagggacaggcactccaaacctgtcttggggccactttcagagcccccagccctgggaaccactcccaccacaggcataagctatcacctagcagcctcaaaacgggtcaatattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcggacanncttttctgccactccatattaaaacatatgaccattgagtccntgcta

SEQ ID NO: 483963 - DNA, 335 bp, Homo sapiens
agaagatcactcaaccccctgtgtgtttatggtcagctatgcctttattttttttcttccaatattatctaaacagtggcagagatttttatattggtagaaagcatcaagaagggtatgccagtcaggtccgggaagtaaaagggaggcacaatatagcacggacggagtggtaaagcctccggccgggagacttcagttatagctgtaataattaatcttatttataaaagccactccactacccttttctctccaacggtaaacacagagacagcttggggactaagccaaaaacgaggggatcttcggcacgaggccgctagaggtgatct

SEQ ID NO: 483964 - DNA, 446 bp, Homo sapiens
gccggcgtgacgggtgaggcgggagatggcgtgctgtactgcagcgctgtcgaggcggctgtccaagtcgagtcggtgcgtgtgttgggctgtaacccgggtccgcatgaccctgccaaggcaccaatcatctacactatgtgtgggagccggccccgaggagaatcctctattgactactggatgaaccagtcaattccacgactacattcagctgtttaatagccagggctctaagctgtacatttatacacatgacaattcctaggcaaagtggctatgtgactcagctggtcgaccggagatctattctgggacggcactcgcgagactatttcgtaaagacgcatcagagtaatgagcactaccttattggctattaaatatgactcgccacgggaatcctcgagagacgcaagaaacttgtacggaaagtggacgaggaa

SEQ ID NO: 483965 - DNA, 1620 bp, Homo sapiens
gaagcccatctaaatatcaggtaagtatcaggggggttatggaaaatgctttggtacccgaaagatactgagtgaatgctatttgaaggaccaacaggagacagtgatggtgcaggggaatgtttagagatggcagagagaaatgtaagacatcaagatcagtacatattgggagttgaaacttcggaaaaatctcttggggtccagtgtgaaatgtgagaggtcatgtaaacattcagaggcccaaggatctggcctggcttctgaatgaccacctgcttcttccccctgtgtgtgtccccaggttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctccaaacccatccaccagcatgaagaccgctgcttgaggttgaaggtgactgtcagtggcaaaatcactcacagtcctcaggcccatgacaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtgtgccacacctggccttaaagagggacaggctgaagagagggacaggcactccaaacctgtcttggggccactttcagagcccccagccctgggaaccactcccaccacaggcataagctatcacctagcagcctcaaaacgggtcaatattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgga

SEQ ID NO: 483966 - DNA, 1449 bp, Homo sapiens
  misc_feature (3)..(3): n is a, c, g, or t
agnggagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctctcacagtcctcaggcccatgacaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtgtgccacacctggccttaaagagggacaggctgaagagagggacaggcactccaaacctgtcttggggccactttcagagcccccagccctgggaaccactcccaccacaggcataagctatcacctagcagcctcaaaacgggtcaatattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgga

SEQ ID NO: 483967 - DNA, 374 bp, Homo sapiens
gaggatcatacatcaggccgaagttgagtaccctacaaagcctcaaagcagttcaatgagaaaggaggagtcgcatgtctctcctttagaccaaaagctagataggatctaggcatagggagtgacggcgtgccgtaagccgcgatacagccgagagccaggcctctcgtgccaaacagcatcgccaagttgtgaatgcgaagggcccgtcttggaggaaattaaaagtgctgctccactgaacacaccaacgataagaaagtgaaactgtcttattgctgatacggagaagtctgagtggtctggatagatcaaaccagccccaacattcccttaagtcatagcaagttccacgaggcggagagaggtgggaa

SEQ ID NO: 483968 - DNA, 1416 bp, Homo sapiens
  misc_feature (5)..(5): n is a, c, g, or t
  misc_feature (49)..(49): n is a, c, g, or t
  misc_feature (52)..(53): n is a, c, g, or t
  misc_feature (56)..(56): n is a, c, g, or t
  misc_feature (58)..(58): n is a, c, g, or t
  misc_feature (61)..(61): n is a, c, g, or t
  misc_feature (64)..(64): n is a, c, g, or t
  misc_feature (81)..(81): n is a, c, g, or t
  misc_feature (83)..(83): n is a, c, g, or t
  misc_feature (92)..(92): n is a, c, g, or t
  misc_feature (95)..(95): n is a, c, g, or t
cgccnaattaaccctactaaagccccaattaaccctttctgggtcgccnaannaancntcnctnaagtgctgggattacangngtgagcacngcncctggcctaggagtagtattaagtggcccaggcaagaggaacatattcagactcggaggaatgaaggatgaaatgtggggaggggcagtgtctatgctgagggttatttccaaagaatgagaggctgggctgaacattgggcaggaagttagcaaaaactaaggagggtaggaatcaaggttagagggaagagaagaatgaaattgagtagggagctgagaaagcagggcgaggggcatttggacttacattttcttccagcaaaggtttcttatttaacccctgtgggcttatcttgcagccaaacccatccaccagcatgaagaccgctgcttgaggttgaaggtgactgtcagtggcaaaatcactcacagtcctcaggcccatgacaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtgtgccacacctggccttaaagagggacaggctgaagagagggacaggcactccaaacctgtcttggggccactttcagagcccccagccctgggaaccactcccaccacaggcataagctatcacctagcagcctcaaaacgggtcaatattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgga

SEQ ID NO: 483969 - DNA, 303 bp, Homo sapiens
ttagccagaactgctagaatagtactagcagacaatcagagggtttgcaccatgtctatttgactttcttatggcatatggacataccctgtctgaaatttaaaaaaaaaaaaaatacagaaaaaaagggaaagatcaggtctattccctaaaaacaggaagagaaataatttcaacacattataaaatatataaaagggaaattcaataatctaatgggaataaactaaccataagggcaaaggcaatgggcaacctttctaaaagggttggaacattaggtaactggggttacctaggaaa

SEQ ID NO: 483970 - DNA, 272 bp, Homo sapiens
  misc_feature (44)..(44): n is a, c, g, or t
  misc_feature (241)..(241): n is a, c, g, or t
gttgaactaaatgatgtggcaggttctataagtaactaaagaancatgttggccggacgcggtggctcacacctgtaatcccagcactttcggaggccgaggtgggggatcacctgagatcaggagttcgagacctgcttggccaacgtggtgaaaccccgtctctactaaaagtacaaaagttagccgggcgtcgtggcaggcgcctgtaatcccagccacttgggaggctgaggcgggnggatcacttgagcccggaaggtggagtttgc

SEQ ID NO: 483971 - DNA, 1514 bp, Homo sapiens
  misc_feature (3)..(3): n is a, c, g, or t
  misc_feature (582)..(582): n is a, c, g, or t
agnggagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctccaaacccatccaccagcatgaagaccgctgcttgaggttgaaggtgactgtcagtggcaaaatcatcacagtcctcaggcccatgncaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtgtgccacacctggccttaaagagggacaggctgaagagagggacaggcactccaaacctgtcttggggccactttcagagcccccagccctgggaaccactcccaccacaggcataagctatcacctagcagcctcaaaacgggtcaatattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgga

SEQ ID NO: 483972 - DNA, 363 bp, Homo sapiens
cgggtacctgagaccgaagcatctacagtactgtgtgtctgtctaaatttagcactgtctgatacaataagcttctttctctccaacgtggtcaacttcagcataggcaggatgtccagagcctcttctaaattcatcgcaggcatctgcttgggcgtctctcaataaagaagatgctggctgctgatgttgggtggtgatacatatagactgtcacaagaatggctgtggctacaatgaggaccaggatgaagattccaacgatgaggccagcgtggagggttccccctttcttctcagctgcactgtcatctgtagaagctccattatcttttagatgtagtgctatcttggtatcatctt

SEQ ID NO: 483973 - DNA, 502 bp, Homo sapiens
tcctggagcgggtgcggtggtaatgctgggtaatcccagcactttgggaggctgagacgggcagatcacctgaggtcaggagtttgagagcagcctggccaacatggcaaaacccgtctctactaaaaatacaaaaattagccaggtgtggtggtgggagcctgtagtcccagcttactggggaggctgagtcaggggaatggtgtgaatctgggaggcggaggttgcagtgagctgagattgcgccactgcattccaacctgggcgacagagcgagactccgtctcaaaaaaaacaaaagaagtaaaatcacagtatggcgccctcccctcgtgctcctccttcctgctctgatgatgcggcgctggtgttgcggaggcctccccttttgccatagctggcatctggaggattacgggcggactcccaactttcaaacaagcttcccttcacagtcctttccgaacgggtccacctcccaggtcactcggcaacgaccggg

SEQ ID NO: 483974 - DNA, 990 bp, Homo sapiens
tcgtctcagcccaaaatctccttaaactgataggcaacttaagcgaagtctcagggtacaaaaatcaatgtgcaaaaatcacaggcattcctaaacaccaataatagacaaacagagccaaatcatgagtgaactcccattcacaattgcttcaaagataataaaatacctaggaatccaacttatattgggatgtgaaggacccttataagggtgtgaaggacccttataagttcacccttatgtgaactacgaaccactgctcaatgaaataaaagaggacacaaacaaatggaagaacattccatgttcatggataggaagaatccatatcgtgaacatggccatactgcccaaggtgtaatttatagattcagtgccatccccatcaagctaccaatgactttcttcacaaaattggaaaaaactactttaaagttcatatggaaccaaaacagagcccacattgccaagtcaatcctaagccaaaagaacaaagctggagacatcatgctgcctgacttcaaactatactacaaggctacagtaaccaaaacagcatggtactggtaccaaaacagagatatagaccaatggaacagaacagagcctcggaaataataccacacatctacaacatctgatctttgacaaacctgacagaaacaagcaatgggggaaaggatccctatttaataatggtgctgggaaaactggtagccatatgtagaaagctgaaactggatcctttcttaacttatacaaaattattcagatgggtttaagacttaacattgactaaacataaaacttgagaaactaggcatacatcggactagcggggcagcttctgtttaaccaagcagggccaggccaatgcgaggtcttttaggatttgcgaaaaacccaggagcgcacaggaattgcacctcaaggtcctcgaataaaaacctctggggggcgtgcctgtatcttctgtcttaacgtcat

SEQ ID NO: 483975 - DNA, 944 bp, Homo sapiens
actacaggtgcacgccaccacacctggcaaattttgtatttttagtagagacagggtttcaccatgtggccaggatggtctcgatctcctgacctcatgatccacctgcctcagcctcccaaagtgctgggattacaggcatgagccaccgcgcccagcctcaaacacatctttattaatcaaaataggaaccattgcaatgaagacatttttgccaatgaaaaataagttgtttattcctgtagcatacacattcatgcttcaagattcgatgaactcttggaaagcattttctgcatcctgctggttgtggaaggattttccctgcaaaaagttgttaagatgattgaagaagtggtagtcggttgatgagaggtcaggtgaatatggcagatgaggcaaaagttcgtagcccaatttattccaacttttgaagcattggttgtgtgacatgtggttaggtgctgtcatggacaattgggctttttctgttgattaatgccagctgcaggtgttgtactattcggtgcaactcattgatttgctgagcatacttctcagatacaatggtttcaccgggattcagaaagatgtagtggatcagaccagcagagaccacaaacagctgaccatgacctttttttcgggtgcaggtttggctttgggcaagtgctttggagcttcttctcagaccagccactgagctggtcatggccagttatcatataaaatcccacttttcatggtacatcacaacttcaattgcgaaaattcttcctggtgtcgtgtcgaatagattcgaccccttgcaaaaagcccgctttaaatttcactccagcatgagcaacactaatgagctttcacctttcccttgttcaatgtgacaccgtgatgccccgtgatctctcgcctccggtcgaacggccccaatgtcacggcggccc

SEQ ID NO: 483976 - DNA, 1174 bp, Homo sapiens
  misc_feature (643)..(643): n is a, c, g, or t
  misc_feature (1125)..(1125): n is a, c, g, or t
gctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaaaaaccttcaacttgcctactccaaaatgtgggtcattttagtgttaaggggaagaatttccagggttatggccagtggagtgtacaagttattgtgggcagatttctcagcacactcttttcccactggtttaaggagtaagtgggattactggccattcactttcataatccagtaggatccagtgatccttacaagttagaaaacataatcttctggccttctcatgatccaantaaatggccttactcttcttgaaaatttaaccctatgatattttctggtgcctggaatattggtcatggtagataacaagacctcagtggccttccggttttccacattttcccttttcaaataggggtctaactcagcaactcgcttaaggtcagcagcctcccttgaagaccaaatttagaatacccattgacctagtttcccatgcgtgtttctggactctgagctacagagtcgtggtgaagctcacttctggggcttcatctggcaacatctttatccgaaggggtatggttgacactagcccaatgaattgcacttacagtggaccaatagggctgagctctctgagggctggcagtcctggaaccagttttccctgcctctcatcacctgaatgaggtcagcatgtctattcagcttcgttatttcaacgataatcacgctttcctgaatccaaactaatccatcaccggggggnaagggggctcaccattgtgttcccatttcaggctgatcagtgggcctcc

SEQ ID NO: 483977 - DNA, 897 bp, Homo sapiens
gaagagcttaaacagcgctgactgccttccagaagcaagggggccgagcaaagaggcagctgtcaaacaaggctgtctgtgcattttcctagggctttggatgggggctcagggcaggggcagcagttaaccctgctggcctgtcgagctccacttgctgcgcaatcatcaacgggcggtcagtgcggcaaaacgctggtactaacgccacgcacttcatgcagcccatgcagtatcgccctgcgaccactctgactgctacacactgaccactgcctctggcgcatgtctcatcacgcctggctcctgcggcgactaccgctggagccaccttacatcagcgctggccctgcgtgaacactgaccaccctccacgcacaggcccctgacgcttgctactacgacgacggcacgacgcacggacgctgctcacctgccccagcgctctcttcgccacgactgctacactccctcactctccacacctacaccaggtctcccaggctggtccaccggcgtctacaacaacacacaccaacaccaacacacacacaaacacacaacacacacacaacccacacaacacaacacacacgcacacacaaaaacaacacacaaccacaaccaaagaaaaagcagcgagcggacggcacacaccacagacgagaggaagataaagtcgagcaggcgagagaggcggcgccgcacagcacaagacgtacgctggtagtcgcgagaggccgacacattgatagacggaccagagaacgcgtgggccgggacacaaaagagtgagcgaagggagccgcgtacacacaactaaggcgacccacgagcgggcacacgcgccgcgggcagggagacaatcagcccaccacgatgcgcgacgaacggcag

SEQ ID NO: 483978 - DNA, 194 bp, Homo sapiens
ctccgaggattacacggtagatttataaaacttacccaagtacattataaaagaatgcatattaaactacttcaattgtcattcaggcaattacaatacagaaaaaaaagaataggtcaggcacagtagtggttcacatctgtaatcccagcactttgggaggctgagagaggagaatggaatgaacccaggag

SEQ ID NO: 483979 - DNA, 818 bp, Homo sapiens
  misc_feature (455)..(456): n is a, c, g, or t
  misc_feature (796)..(796): n is a, c, g, or t
gggggccaaggattttcgaaagggcactcgtcggtctcacagaccttactcggaacgagcccaaatcgttgggagttctgaaccaatcggcccttgtgaatgtgtcctaaggcttctactcacacatatagagagtgctctgcgtggagctgacacacattgtcccagacgagcaagacggggtgcacactggcacagcggtcctcgaaggactatacacacgtgaaaagacatgaccacagttccacgaagacaagaggcacggacgcgcagagttgcaaggatgcgtgcgcttactagccgtgcgtgacccttgattctagtgcaaatgcccgtcatagtgaagccaccccaagtagagcaggaaaggaaaacgagaacgaaaccagttaagagcaccaaggggagatatattcaatcttcttgcatgcacgactgtgctacacaacacttgnnctcagagcaagactcgacggcagcacgattcgcttaggcctaggagaatctcgtctgtgaaacgcaattgaaatgagtatttcgcgtcgggcgagcatgcacacacgttcacgtgaggctagtaactgtatcgataggccgtccactcactgcgatgagcatcagatcgatggagcatcggagcagtggctgctcgtggaatcgacccatgccgtaagtgacatactcattgttacagtaggggtgaaagggcggccacccagtgtattcacagagataagctgggaagtctttggaaatggttaactggtggggtgggataatccttttaaacttgtantaaccccctgtttcccacagag

SEQ ID NO: 483980 - DNA, 851 bp, Homo sapiens
ctccgagccactagtggacccgtttgcaccgtcccgggttgtgggtgtcctgggcttattgctgccacccacaacctctactcaatgaacgactgtgcccagagaagatcctgtcctgtgctctgcggtctcactgatatatcctggagtaacataccgctgcgagaccgaggccttcacggcccttcggcacgcttcctgtccattcttggcagtctgtgtttcggcatggacccgatccagtcgtgcgacgtgacgtgtgcggacgtgcatgtcctgtgcagcctcctagccctgtggcatgtggaggatgcctggcagctagtctgggcaggttggcgccgtgacgcggggtctcttctactcacctccaagctgatccgttcgcacccatgccattgccccagagaagaaaccaactattcctccaaagcacccacgcctgaaggccactgggtaggacgcgtggatggatggaccgacggatcaacatgccagcaaggacatgcaggtcactgactgacagatgggacgtacgaaagtatctgccgcggcagtcgctggtagcagagaggccgcatttctgtgtctgagcctcagcttgaactattgggagctaccggaaggcctaagtgagccgcgctagtcaggtcagcaatccgactcaaattcctcctcattcccagaagtccgtctgtagcacctgggcaagctgagggctcctgtggaatagggctggcaggagccatgctccaggaatcctgctcctgaacggtacaactgatggcagcgtagtatgtctggggttgggaccaagttccacgaaaagggggacccttcgtacctgtttc

SEQ ID NO: 483981 - DNA, 117 bp, Homo sapiens
ggtagacttagaggatcccgaccctcgtctcgtgttcggcgcgatggcgtcgcctcgattccggtcggctgcgccacggcgtccgcgccgcctgcgccttcggtgtcgggggcctcc

SEQ ID NO: 483982 - DNA, 725 bp, Homo sapiens
cgtctcggttgtatggagaagaaaaatgtattttgtgtcggcgtgttcagaataaggagaggagggatatgggtcgtaggcagtagaagtaggcgaagcgaagatgttattcatcatctcgtcttcagcaacaaaggagtccgatgggctggtgcgacatcctcatgtggtagaacacggcagttggactcaccgctacttctgctagcaccaaaaagggagcaagataatgtcatcgtaggagatccctcgcgcagcggctcgtagcatacagagatgagaatggggggcatgtgatttacaacatagatgatgtagagtgagatgcacacataacctgtctcctagtagtagaagtccgcctcgtgtatgacactacgcagcgtttcgtgtagcaattagggtagcgagaaaatggtttttctccccgcacactctctctcgtgtgcataatggagagcatatacactcgctaggtggcttatacgctttggatgtagatgcattatttctggcgagacatggcagatcatcttagagaatcaccacatgtgttgataaagaccgcacagtttgcaggatgctctgctgttaagatggataggtcgctccgcactatggttagagagagtattatatcatcaactgtgcctctgtccacagaagggggtccacctctacataaaagagagagtttggcacccgcgatgcgtaacataataaca

SEQ ID NO: 483983 - DNA, 217 bp, Homo sapiens
tccagtacccgagcatgcatgcctgcctgcaggacgacgtgtattcaccactgcgcagcatgcctccctgtacaagatccgtagacacgtgagcacagtgctgacctccaaatatcgttaagctggagcctggtcgacgtgtattcaccactgcggagcatgcctccctgtacaagttccgtcgacacgtgagcaccgtgctgacctccaaatatcg

SEQ ID NO: 483984 - DNA, 923 bp, Homo sapiens
catttgtcatttttcttccccaccgcccccagaattacttcacttcggagctcttaagaacattgtttaacccaccttccattggtacgagtttttaacaaaatcaccccctatttcgtatctatgtaggttgaattctcccaaatttgctcctgttcgtattcgctcctactaatctaatgactaatatctctttcttacgccccttcccaccactcttttttgccaccccacacaccgtaggcggttaatagccatacatcgtttgcccacaccgaccccacgtgttttctctcgtcttataacatttttctctcctattggcagcacgctcgtttgtctcaccctctctgtgacagattgcctttgacgccaacgagtggcgctctccacccggggcatacgtctattaacgaagatgcgctggccccgccactttagagggtgggggagtgccacactcgtgaagtatcgtctcttagactcacgcacacatggacgcacacgtcctttggcgctcgcacaaatactgacgtctgtgcccaatacttctctacgcgcacactctccaaatgcgtcgttttacacgagcatcatgtctagcgcgcagcgctcactacatatctaacactttccgcgcatgaacctcataacccccatcatcatcagaatcgtggggcaagaaattttatagatcataataacatttctccgcgactacattgagcaatgattctttaataatggagtatataccaccttttgtctacaaataacaatctcatgtatatcatgacttggtgattacacacgtctgacgaaacacataacgacacgctgcctcgtgaggctgactatctgtcttcttaattttggtgtcccccacaggctaacatgaaatcaccaaaaccgcccacaaaaca

SEQ ID NO: 483985 - DNA, 1338 bp, Homo sapiens
gccaccttctcctcctccgcgtgtcctctcccgtcctcgcctcatgtcgactatcaggtgaactattgaaccaggatggctgagccccgccaggagttcgacacgtgactggacagactcacgctgggacgtacgggttgggggaccaggacacagactcacggggggctaacccatgcaccaagacccacgagggtgacaccggaccgctggcctgacaccgctgaacgacagcaggcacttggcagcccacccccgagcctggacacacgcaagctcgcataggtccacgtagaccccaagctcagccatggtccagccacacagcaaagacagggactaggacagcgcatgacacaacaccagccacagggggctcgatggataacaaccgcaagactcgacaaaacacgcggcggacgcagcacacctccacggacacgcaggcgacgacgcccacacgaccaccaaggcattcgcagaccagaacaccaccggcccggcgatccagaagaccagacacacccagactcatggatggaaccgtcgccaaaaagtcaaggagggcatcaacagacggcaatacaagcgcggcaccccggactcacgaacggacaaaatacccagggcaagcacgacatccccgaaaacaacgaaacacgatgaccgacggacacaacacgcaaagccgaagaagccaccgaaagaaggaggagagacagatgcggaccagagaccgtcccgaaagcaccaggctacgaaccgagcagtacgcggccacacgagcaccggtacgggcacgatcagagcaccacacgttgggcgaagtggagcgacaccgggacgaaaatggacaacgacgaaccgaaagcagggagacacctgaagcacacccgacaaaacacacacaggaaagacaacagagccaagacccgaccaccgacccaagcgacacgacaaacaggcgactcacacggtgcgtcaagaggcaacaataccacacaaacaatatgacagaacggagacagcacagccgcaccacgcgcggcaaggcaagaaacaagaagcaagtacaccgacaaaacacccacaccctgcgcccccaacaccacggcgacagccagcgaggggcgcagcccgcgaccgcggggcggacacagggagagtgaggcggagacgcagactcgcggacaggccacgagcgcaggacacgcgcgggggggcgacggaggacacagccgccagggacgagtagcaaagcggacgggggaccacggcagcgagaacacggggagaggagaagagcgagagccagcggcgcgggcgaggacgggagaa

SEQ ID NO: 483986 - DNA, 823 bp, Homo sapiens
taggaatcatccatttaatttaatttggtacaggtgctcaagcagattctctctctctctcccctctcctgggcaggtcacagagataaataaaaaataaaatctacaaggaaaataattatataaaagcactcccgaggttcacactttactatccctagcgtgctcgagttaggcaccccctatgggggaatcagtgtaataccccccacccccatttcactcccactggtcgggggcagacggtactccagaagccgggacaggggtgagggcagcagtggcaaacagttaaaaataaagaccatggtacgtccgggaaccatcgggccacctgggcattacccatgtctgcctccccacaggagccctaccaggagccggtgtgcgaagcgggggctgtggaaaagctgccgtggtggcatgaaagcttgtgtgtgggggagggtgatctaagcacggtcatatgccacttctcaatcttctagaaagaaacccaaaaaagaaagcagagacgacctcgggaagaggagaaaaatcccaagtgttcccacgtgtttaccagggagtttttagggcaacagagaccatttagcagttagaaataatggggcatatcacttttaattcaacaaaagcttttgtagaccctataggttgaaacgggcaagggccttaaaaaattcaagggcaagaaattctaagaggacagtactacggagaagagagggtggtgaagatatgtgttgccagtgaaaagccaattgttgtaagagaaggccaaggaagggaaccccagtttgggaactgacgaaagcgaaca

SEQ ID NO: 483987 - DNA, 203 bp, Homo sapiens
tgaggtaacctggtacagcactcatgctgtgagacccgctgggctgagctccatggccccacagagctgactgagcactgtcttgtttttcataaatgtgttttttttttgagacagagttttgctcttgttgcccaggtggagtgcaatggtgcaactcgtggctcactgctacctccacctcccgggtttcaagcaatttc

SEQ ID NO: 483988 - DNA, 424 bp, Homo sapiens
ccctctatataaatgcgtaggggttttaggttaaatgtccttagaaagtatacttgaggacggtgacgggcggggtgtacggcgcttcagggccctgtgcaagctaaggcactgctactctacagatttactggctaaatccaccttcgaccgttaagtttcataagggctatcgtagttttctggggtatgaaaatgtagcccatttctgtgccatcctcatggtgctgccccttgacctaagcggtctttacgtggggttgcttgcgcttactttgtatccttcatcacgggtttgctgaagatggcggtatataggctgagcaagaggtggtgaggttgatcggggttgatcgattacagaacaggctcctctagagggatatgacgcaccgccgggtgctttgggtttcaagctgtggct

SEQ ID NO: 483989 - DNA, 84 bp, Homo sapiens
atgtcatgtttagatcttctagagctgttgtcatcctcacaatcacagatttttttctccaatcctcacagagacccaatgacc

SEQ ID NO: 483990 - DNA, 342 bp, Homo sapiens
acacaggtgtggttaaatacattctagagatagatgaggcagagtgcgagatcagtttgctgaatgttagatcgactcacattggtggagtctcagccttccgatgggctctgtggcttcactgcacgcatctaaaatgtcaccgtctccagtttctcgagttgctcaagacacgagatactctcatggatgcgacgtgtcgaactcgtcgaacgaccttgttttctccaggattcattctccacttttctctcgtccgtttgcaatatctgagaatacatagcaaggaggtaaagctgtcaccacagagcaaccttgggcgagccttggcccttatccgag

SEQ ID NO: 483991 - DNA, 692 bp, Homo sapiens
gttatcaagaatctgaaagtctaagataggaaaaaaaaaagtgggggggcattataaatctataaaatgtacttctatggcatgcctaatacgtcttatatgtatgtatgtgttgtgtacacgatgttttagtggctaaacaatatgtaaaatgagctctactgggcttaacagaagaacataaaaggtggcttagatcatgatactaaaaaagaaaaggctagtcaaaggctttttcaaatttatgtaagcttaagtaaaatctttaatgaaataaacgtaggcttgaaaattatgggtaaacgtagtattagaaatgtcttaagaatggccagcagtacattttgtttgcattatagttaatcaaacagttttatacttatccctgccaagataccagaaggtgtcaaaattcggcataggggttataaaactataaacccagcccaaaacagaatgatcttgcttgtgtaatttttacataaagtaagacatggatatgggtttaatgaaaacagctgcatcttgaatttagtaagattaccataagttctaagtcctgtggctttaggcagtttagtccacagacaataaggaggttggctcgggaaaggactgtcatggtcatgtgtgtcgaagctgaacttaaactaggttcctcccaaagttcattcgcgctatgcccaggatga

SEQ ID NO: 483992 - DNA, 1193 bp, Homo sapiens
  misc_feature (1154)..(1154): n is a, c, g, or t
taaaaatattcagaaccaagtttaatttggtagtcgttacacaggagggggcagtcagaagagtacagctcacccccagcaggtggaggggttaaatctcagggacaacggtggggcaggggggacagcacctccgaccctagtgggggtgtaccttcaagtagcaaggctgacagtgatgtctagaagggtctccacattctgccgtgagtttggccaaacccaggggctctatagggatggtggcaaaagaagtgacctaccgcaggggtgattatcaggggttttctaaaaataaagagcacggtattggcctttaaaataattcacatcaacaggaatataggggagaacatggagctgggcataacattgggcgtaaaaagcagggccaggcccacccaagggggccctcgtgtggggacgggtgcctgagcccgagcccctcggagcctctgggccacaggatgggctagcctgtagtgctggtagactacgtactggtacccaccccgagaaagggagtttgaacaattgtagagtagtctggtggcattggacatgtgcaggggtaaacatgggtgtgtagcaaagtgggtacagcagtgcctaacaggacgagagcgaacaaagcaggggctgatggggggccaggcatagaaccagggcaactaggggcgcagggactaaccctacccagggaacccccgaaggtgctttgcaccccgactcggcaagaacagatcggctggacagggtccaaaagtgatagcatgctgggatgcaaattacactaggagaacaacgtatacacataaaaacaaaagaatagagcccattcaggggttggacctgaagcagacaaggacaacaatagcaccccaagagcggccataactgtggaaaacgccggacaccaggggtaacagagccaccctaggcgcaggacaaaagtagtacctgcgaaaataaagaacgcagttacgagatatacgagagggagaacctcaaaaacctcgtcgcaacagtgtccccaaagacattgtcaggcacaaacagcgcaccccctactataacaggtgcgaaccaaaacgacggaacagtaaagcgccccgggagagaagaaaacacaacgataggtgggatgaccagtnaaagagttgtctgctgtgttgtatgctgtgaacacagca

SEQ ID NO: 483993 - DNA, 716 bp, Homo sapiens
cttggtggctcacgcatgtaatcccccagcactttgggaggccgagatgggcagatcacccgaggttagggattccagaccagcctggccaacatggtgaaaccccatctctacaaaaaatacaaaaattagccaggcatggtggctcatgcctgtaatcccagctacttgggaggctgagacaagagaatcacttgaacccaggaggcagaggttgcagtgagcagagatcgtgccattgcactccagcctgggcgacaagagtgaaactatgtctcaaaaaaaaaaaaaaaggaaaaaaaaggtccttatctttaagagatattttcggaaatattccctatggaaatatgctatctgaaattggctccagcggttatgtaccgaggactgtcccgacgtctggttgaaccactggttgaccatgagctgctattggcggacacatgaattgaggacgcacattgggatccttaatacgtctccatctccggtcggcaggttttaccattctccttgacgaaaatgttcaaacacacggcggggcgcaaaggtcacaggcctggaaaatcccagcactgtgggggagggcggaggcaagcgaaaaccaccttggacgggggggaccgttagaagcccgtcgtgggccaacatgggaaaacgctggtctgcccactaaaatctcaaaagacaacaacaaaacaaaacacacaatc

SEQ ID NO: 483994 - DNA, 194 bp, Homo sapiens
atcgtgctcggaccatccctgatattttggaataactcccagaagtggaaatataaggctgaaggcctggtgtggtggctgaagcctgtaatcccagcactttgggagaccgaggtgagcagatggcttgagcccaggagtttgggacaacatggtgaaacctcatctctacaaacagtacaacctgccggtgg

SEQ ID NO: 483995 - DNA, 247 bp, Homo sapiens
caagactgctacttcccatattatataagagctatatctaccctgtgcatgatcacgccctcctaattacatttttccttatctgcatcctagatcctgtatgccgtttaccgaacactcactacgaatataacgtcatactgagctctcacacgctcgggaaatagatacccgctcttcgtaactatcctgcccgccactcatccataattcactcatcgccctcccatccctacacatcactttc

SEQ ID NO: 483996 - DNA, 344 bp, Homo sapiens
  misc_feature (82)..(82): n is a, c, g, or t
gtgctcgcagtgcgccgatcagggcgtagtttgagtttgatgctcacctgtgatcagagtattgagtaagcgtataggctanaggtggctagaatatataggagccttaggttgaggttgaccagggggttgggtatgggaaggggggttcatagtagaagagcaatggtgaggggctctttggtgaagagttttatggcgtcagcgaagggttgtagtagccgtgtaggggcttacaaggttggggcctttgggtagttgtatatagcctagaatttttcgttcggtagcgcattaggtatgccattgcgattagtatgggtactatgaggagtaagaggtcg

SEQ ID NO: 483997 - DNA, 262 bp, Homo sapiens
gtatagtggagacgaatagtccatggtcggtttactatctactacaaagttcctccctgatacgaaaggacaagagaaataaggcctacttcacacacgcgccttcccccgtaaatgatatcatctcaagctatagtattatacccacacccacccaagaacagggtttgttaacatggcagagcccggtaatcgcataaaacttacaactttacagtcagaggttcaattcctcttcttatcaacatatcgcatggtcaac

SEQ ID NO: 483998 - DNA, 441 bp, Homo sapiens
agccaccatgggaagcacagtggtacagataaattatcactcggctgtaacacatcaaaaaaaggattttttactgtctagggataaatataagagtatagtagaaatatggctccagaatgtagaacgcaccgttaaggggatagctaagagaagaaggtatcggtgccggagtacggccagctaccagcgaatctttaaagcgcagtcgccgaacgaacgtgccctgggacccccttttcggaccctatccggcgggcatccctaccaaaaaaagagaagcccctgttccatggctggcgttatgccgtttccttattgttttttcagaatgagagcgattgactctgcagctgcgggatgtcacactcctttcccagaaattgaatatcccttctattatagtgacgacccaggctgtccaattccgtcatggtggct

SEQ ID NO: 483999 - DNA, 348 bp, Homo sapiens
tctaattcaccatgaataaaatttggaggaggcatgtccgcaacccttatatctctctctttttcactctcttcctcgcacccccatgactgaatgttggggggcaaggtggagagagctgggcaactactgtgagcaagtcccctagcccctggacagcctcctcccatgactgggtgaactgtttaatgagcttgtgcattccccacaaaaacatgagtgcccctctgtgtggcctctaaccctctgcacagcccttcttgatggtcctcaccaggtctctgagctggtgtgggaggccatcctggcgaccactgcccattccattcacccctcactgtacctgcc

SEQ ID NO: 484000 - DNA, 1000 bp, Homo sapiens
  misc_feature (57)..(57): n is a, c, g, or t
  misc_feature (99)..(99): n is a, c, g, or t
  misc_feature (115)..(115): n is a, c, g, or t
  misc_feature (118)..(118): n is a, c, g, or t
  misc_feature (866)..(866): n is a, c, g, or t
gcattgctgtctgcaaggagcccctagcccctggcagacatagctcttcagtccccntttctctctgctagatggatgttgatgcactggaggtctttnagcctgcccttgcatngcncctgctggaggaggagagagctctgctggcatgagccacagtttcttgactggaggccatcaaccctcttggttgaggccttgttctgagccctgacatgtgcttgggcactggtgggcctgggcttctgaggtggcctcctgccctgatcagggaccctccccgctttcctgggcctctcagttgaacaaagcagccaaacaaaggcagttttatatgaaagattagaagcctggaataatcaggctttttaaatgatgtaattccccctgtaatagcatagggattttggaagcagctgctggtggcttgggacatcagtggggccaagggttctctgtccctggttcaactgtgatttggctttcccgtgtctttcctggtgatgccttgtttggggttctgtgggtttgggtgggaagagggccatctgcctgaatgtaacctgctagctctccgaaggccctgcgggcctggcttgtgtgagcgtgtggacagtggtggcccgcgctgtgcctgctcgtgttgcctacatgtccctggctgttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttntgtccacttctggttgccaggagacagcaagcaaagccagcaggacatgaagttgctattaaatggacttcgtgatttttgttttgcactaaagtttttgtgatttaacaataaaatttctgtatacgccaaga

SEQ ID NO: 484001 - DNA, 872 bp, Homo sapiens
  misc_feature (1)..(1): n is a, c, g, or t
  misc_feature (66)..(66): n is a, c, g, or t
  misc_feature (70)..(70): n is a, c, g, or t
  misc_feature (72)..(72): n is a, c, g, or t
  misc_feature (78)..(79): n is a, c, g, or t
  misc_feature (130)..(130): n is a, c, g, or t
  misc_feature (156)..(156): n is a, c, g, or t
  misc_feature (170)..(170): n is a, c, g, or t
  misc_feature (172)..(172): n is a, c, g, or t
  misc_feature (181)..(181): n is a, c, g, or t
  misc_feature (183)..(183): n is a, c, g, or t
  misc_feature (195)..(195): n is a, c, g, or t
  misc_feature (198)..(198): n is a, c, g, or t
  misc_feature (205)..(205): n is a, c, g, or t
  misc_feature (212)..(212): n is a, c, g, or t
  misc_feature (226)..(226): n is a, c, g, or t
  misc_feature (238)..(238): n is a, c, g, or t
  misc_feature (246)..(246): n is a, c, g, or t
  misc_feature (249)..(249): n is a, c, g, or t
  misc_feature (251)..(254): n is a, c, g, or t
  misc_feature (258)..(258): n is a, c, g, or t
  misc_feature (266)..(266): n is a, c, g, or t
  misc_feature (293)..(293): n is a, c, g, or t
  misc_feature (307)..(307): n is a, c, g, or t
  misc_feature (313)..(314): n is a, c, g, or t
  misc_feature (320)..(320): n is a, c, g, or t
  misc_feature (333)..(333): n is a, c, g, or t
  misc_feature (335)..(336): n is a, c, g, or t
  misc_feature (342)..(345): n is a, c, g, or t
  misc_feature (347)..(351): n is a, c, g, or t
  misc_feature (353)..(353): n is a, c, g, or t
  misc_feature (355)..(355): n is a, c, g, or t
  misc_feature (358)..(358): n is a, c, g, or t
  misc_feature (360)..(360): n is a, c, g, or t
  misc_feature (362)..(364): n is a, c, g, or t
  misc_feature (366)..(368): n is a, c, g, or t
  misc_feature (371)..(375): n is a, c, g, or t
  misc_feature (379)..(380): n is a, c, g, or t
  misc_feature (382)..(383): n is a, c, g, or t
  misc_feature (399)..(399): n is a, c, g, or t
  misc_feature (404)..(405): n is a, c, g, or t
  misc_feature (408)..(409): n is a, c, g, or t
  misc_feature (738)..(738): n is a, c, g, or t
ntttttcaggccaagcacaaataacgtggatggcaagccaccataataaaaaagaggccgtcaccncgtngnttcacnnagcaaagcgcaggcccaaagccgcccaagcccaggatcaccgccaagaagnaaatcagaacccaaaagaaaacaggnaagcccaagatcantncaaaaaacnanaaaaaaaaaccnacntttagancaaacantacaacccgccaanaatcacccgggngaaatcanctnannnnaacnctaatacntatacccattttccaacaacttcctcntcccttcccaaatnactccnnccaacncttctctctcccncnntaaacnnnnannnnntntnatncngnnntnnnacnnnnnatcnntnntttccccttctctccntttcnntcnnaagagggccatctgcctgaatgtaacctgctagctctccgaaggccctgcgggcctggcttgtgtgagcgtgtggacagtggtggcccgcgctgtgcctgctcgtgttgcctacatgtccctggctgttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttntgtccacttctggttgccaggagacagcaagcaaagccagcaggacatgaagttgctattaaatggacttcgtgatttttgttttgcactaaagtttttgtgatttaacaataaaatttctgtatacgccaaga

SEQ ID NO: 484002 - DNA, 397 bp, Homo sapiens
ccgcttcatcctgcccattaggaactacaaggacgcgccaccattcccgctaattttttagagagacaggtttcaccatgtcgctcaggctggtctcgaactcctgcgttcaagcgatcggaccgtctcagcctcccaaagcgctgggattgcaggcgtgagccaccgcacccggcccctgagggaatgcttgaaattgctttcatgtaaaagcacctacacccaggccccccccacccacgaacagcttcgtggacagtttactcagactgagtcgaaggtaattttaaggtagtttcgggatattacccaagtatggcccagctggaaggtggacatcggggggagggctcataaacaccaaagttcaaccttctgcacctcacagatggagaaa

SEQ ID NO: 484003 - DNA, 80 bp, Homo sapiens
gtcacatgacatctgccacctctctccccgtacaccccccagcatgaattcttgggaactcaggtaaaatgctttcttgg

SEQ ID NO: 484004 - DNA, 203 bp, Homo sapiens
cccctttttcccctttttttcttttccgcggccggggcccggggggcccccttttttttgttttaaaaccccccccctttttttttttggccgccccccccccggggggttttttttccccgggcttttttttttgggggggcgcgaaaaaaacaccaaatacccccttttagtttttttagaccaagacaacatttgaaata

SEQ ID NO: 484005 - DNA, 772 bp, Homo sapiens
  misc_feature (183)..(184): n is a, c, g, or t
  misc_feature (188)..(189): n is a, c, g, or t
  misc_feature (191)..(192): n is a, c, g, or t
  misc_feature (196)..(196): n is a, c, g, or t
  misc_feature (198)..(198): n is a, c, g, or t
  misc_feature (205)..(205): n is a, c, g, or t
  misc_feature (352)..(352): n is a, c, g, or t
ggggactactcggacgagactatgagaaggtgccactgccctactcggtcttcgtcaacaccacggagtcctgacgaagtggaaaggcagttacaaggctacaagccctccggggagagccgccaggatgaatttctgactagcatccgggcaactccttcttaccaagtcagtgggcatagnntccnngnnttgntngtgtggnacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgntgcggcacccctacggctacactgggcctaggtgatggcagtccatgtggctgccaggccaaggcagtcacaggggccctgaccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggatccagaggaagaagggactctgttgccacacacgtgaacttgccctgtcccaatcccagaaacccaggaccaagctgtgcctgggctctcaaggacagtgaaccctggtccccccatcacactcacccttaagtgggtatgggagccaggcagggccagggcagctgggtggggccggggctggccttta

SEQ ID NO: 484006 - DNA, 150 bp, Homo sapiens
aaaagtagaatttttctagagatgattagaatattttatgtggcgacaaagtgagttacacctgtatttctagcttgatactggagcaaaagttaaaatggtctcaactctcgacacacgctatctctttggtttatttgtctgtttgtt

SEQ ID NO: 484007 - DNA, 294 bp, Homo sapiens
tctcctcaaaataatacagtaaaaccctaatcctcagtacctcaggatgtgatcttacttggaaataaggtacttccaagggtaatcaggttaaaatgaggtcattaggatgggccttaatccaatgactgatgtccttaaaacagaggacctttagacgcagacacacacacacacagggagaagatgtctactatggtttgtcctcaccaaaacccatgttgaaattgtattcccaatgtggcagtgtcgggaggtgaagtctcgtgggaggtgcttgggtcatgagggcat

SEQ ID NO: 484008 - DNA, 253 bp, Homo sapiens
  misc_feature (230)..(230): n is a, c, g, or t
tctagaggatcccacgcgggcaggatcgccagcatgcctgttggatactcgttgatcctgcgctgcaccgaaaacgtggcaatgcgcgagttcaggccgagcatgaaggcagtgatgctggtcggggtcagatccagatgacgcgcctgctcggcgctgacgcgctggctgcgtagctgaacgcccgaacgccagtccacatggatcgcctcgatggccggcagcgagancagcagcgacgagtccaccggcg

SEQ ID NO: 484009 - DNA, 808 bp, Homo sapiens
  misc_feature (183)..(184): n is a, c, g, or t
  misc_feature (188)..(189): n is a, c, g, or t
  misc_feature (191)..(192): n is a, c, g, or t
  misc_feature (196)..(196): n is a, c, g, or t
  misc_feature (198)..(198): n is a, c, g, or t
  misc_feature (205)..(205): n is a, c, g, or t
  misc_feature (352)..(352): n is a, c, g, or t
ggggactactcggacgagactatgagaaggtgccactgccctactcggtcttcgtcaacaccacggagtcctgacgaagtggaaaggcagttacaaggctacaagccctccggggagagccgccaggatgaatttctgactagcatccgggcaactccttcttaccaagtcagtgggcatagnntccnngnnttgntngtgtggnacgaaacctctaacaaagtgaggaactatcgcatttttgagaaggactctaagttctacctggagggcgaggtcctgtttgtgagtgtgggcagcatggtggagcactaccacacccacgtgctgcccagccaccagagcctgctgntgcggcacccctacggctacactgggcctaggtgatggcagtccatgtggctgccaggccaaggcagtcacaggggccctgaccccaggccacacaggcagtcacaggggccctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggatccagaggaagaagggactctgttgccacacacgtgaacttgccctgtcccaatcccagaaacccaggaccaagctgtgcctgggctctcaaggacagtgaaccctggtccccccatcacactcacccttaagtgggtatgggagccaggcagggccagggcagctgggtggggccggggctggccttta

SEQ ID NO: 484010 - DNA, 119 bp, Homo sapiens
gctactcctgtccagcatctcatctctccttccaacatctcattgctctttccaacatctcatctctccttccaacatctcatcgctccttccaaacatctcatccctctcttccaaca

SEQ ID NO: 484011 - DNA, 643 bp, Homo sapiens
ctgatatgcgtcaaactgctacatgagaaacctgagcatgttcttcccaggcactgactgccagagactcattgaagtggaccatgaacgcatacttcgcactttctatgagaagcgtatggccacagtagttgatgctgacgctctgggtgaacaatggaagggttatgtggtccgaatcagagatggtaactacacacacggacttcacgagacgctgggtgtcgtgacctgtctccgtgttcgtctgctactgagcaggggacttcactgaacacacctagacaactgcggacagatagagaaaatcagttcgcgggagcatcgcggatgcacatctgagcgttcacaacttgaccattgtgataaaggatagtacgatcatcactgactgactgatactaccgtgtctagctgcctgagctcgactcgagctagcagaatgcgcagactattcaatcacctatatgaagacgatgtcctgcagtatgctgaacgatagcccttaaagtctgtaggatataaaccgatgacccaaagtcccaatagttcacgacttcatgcttttcaaaagactgcatgacacaccggcggggtattagacctatcatagaccattgcagatgtcgactgggtgcttgct

SEQ ID NO: 484012 - DNA, 627 bp, Homo sapiens
attcattccaatcccgcgcctacacaagactttcaagaggacactgacagggagagcctactctattacatatctcttatgcttggatgcttaagcagctttataaatgacgtgtacggtacaatgaggaccattcatttgatatatataattgaggatttcatccagatcaactcatttgatatacgatataacatcacttttgaatggactatgcagagacatggagagtgcttgcggcatatattctacgagtatatggttagactattgcaggtatagttatacaagctaagatacaaccaatccgacattgaatggtgcaacatcatcttaggatgcatttatatgtgaggatactgggaccatggactcactcgcgtgagtgagactgcatgatgcattcgatgcagcagaccgtattatgaaactagtaaggacctagggaagtagacatatggaggtcttcaacacattagcgtatgccatcagggtaagacttgagctagcgattgaagatacgtgtgtacgtctcatatagtgatatgcagctgtgcacaaggataatgccgctccacttggacatgagaccttcatgtgcgaatggcatggtgactacaacttatg

SEQ ID NO: 484013 - DNA, 244 bp, Homo sapiens
  misc_feature (24)..(24): n is a, c, g, or t
  misc_feature (33)..(33): n is a, c, g, or t
  misc_feature (42)..(42): n is a, c, g, or t
  misc_feature (95)..(95): n is a, c, g, or t
  misc_feature (187)..(187): n is a, c, g, or t
  misc_feature (210)..(210): n is a, c, g, or t
  misc_feature (229)..(229): n is a, c, g, or t
gcccaggagcgcacgcaaatcgcnagtgatctnggacctganttgcgggccacgagggcaattcggggcggctgctgctcaggctcttcacggtntaccccagcaccaaggtctacttcccgcacctgagcgcctgccaggacgcgacgcagctgctgagccacgggcagcgcatgctggcggtctntgggcgcggcggtgcagcacgtngacaacctgcgcgccgctngagcccgctggcgta

SEQ ID NO: 484014 - DNA, 119 bp, Homo sapiens
attctgtggtctcacttgacacctggtcattattccatcgtccatgtcaccaacgtggtgaatggctgccgcacattgctccagaatgtgcacgaataaaagcagaattgttgcctgta

SEQ ID NO: 484015 - DNA, 693 bp, Homo sapiens
  misc_feature (255)..(255): n is a, c, g, or t
  misc_feature (290)..(290): n is a, c, g, or t
  misc_feature (305)..(305): n is a, c, g, or t
  misc_feature (351)..(351): n is a, c, g, or t
ggtgagggcgggcggagatgtagacccggtagtgttgtgccttgtggtgacaactggcggcagcgcgccggggcccgagacttagtctcggccgccatgggccagcgtccacgagagcctctacttcaatcccatgatgaccaatggggttgtgcacgccaatgtgttcggcatcaaggactgggtgacgccgtacaagatcgcggtgctgggtgctgctgaacgagatgagccgcacaggcgaggggcgccgtncagcctcatggaagcggcggaggctcaaccagctngctcctgcccctgcntgcaggggcccagatattacacctgtcaaaactttacaagttaatntgaagagtcttgtccacagctggcaaattcagtgcagatcagaatcaaacttgatggctgaaggcgagttgaaggatattggaacagtttctctgatgacctttcagattctttctctggaactgaaaccagaggttccacaaaacaagtgtagtagggtaggtaactgcgtcacatgatcttggcctacagataaggctttctgttcagcccaagtgtttaaaactgtacacgggccttcagcagtacttccagaaatggtgagaacaaagacagttggaggatgctgatatgggaactgacaggtagagatgaagggtgaaagacaagtggaaaaaggag

SEQ ID NO: 484016 - DNA, 1011 bp, Homo sapiens
cgcgtccgggcttaatgtgtactcggcgctaacatctcgtctatctggccgtggaggctattcagcgtactccaaagatacaggtttactcacgtcatccagcagagaatggaaggtcaaatttcctgaatgctatgtgtctgggtttcatccatccgactgttgaagattgacttactgaagaatggagagagaattgaaaaagtggagcattcagacttgtcattccagcaaggacgggtctttctatctctgtgtactacagtgaattcacccccactgaagaaagatgagatatgcctgccggggtgaaccagtgtgacttggtcacagcccaagatagttaacgtgggatcgagacatgtaagcgagcatcgaatggagatgccgcatatggattggatgaattccaaattctgcttgcgttgctctggaatattgatatgcttatacacgtatacgacttttatgcacaaaatgtagggttataatagggttaagcatgggcatgatcttctgttataattctatctttgagtgctgttctccatgtttgatgtatctgaggcaggtgctccaggggtagctctaggaggggctggaagttagaggtggggagcagagaagtctttattcaaataaagatgtggtcagaattgaactcttgaatctctgcgaatcatagcttgtgagatagctaagcggtgatagcttaactgccgattgacatagtcgcttaaattggggggactttagaaattattgaccggattttgggacattggtcacggctggaaccttggccctatggaccacattggttttactggtacacagcggggggggttacgggattttgtgtccacggagtatatttattctggaaaaacaaagaggggggtaaaacaggggcgaagacacacatgattagagacaagagttaaaaaaggcgaagatagaaagcaaattgagacctgtgttgcacaacacatgtgatagtgatttagatct

SEQ ID NO: 484017 - DNA, 213 bp, Homo sapiens
  misc_feature (34)..(34): n is a, c, g, or t
  misc_feature (87)..(87): n is a, c, g, or t
acacttcagcttcgttatgatgtaggatgtaatnttacccatcatctagttgacttatcacgagtagacacttatattatcgtaatngtactatgcctggttaaattaccatctttatttttaaattgtcccatgtgatcttagttcccttttttcttattgcctatgattaaatttggcattttaatgattccattctatcatataagcatt

SEQ ID NO: 484018 - DNA, 826 bp, Homo sapiens
  misc_feature (282)..(282): n is a, c, g, or t
tggctggctcacactttattaaaatgccccaggagccccaggggcccactatggaatgtaggtagaggggttccagggccccgccgtggagcaccgggaccatggggggccaccttccgggattgccaagaccgcggtctccttcagaggcgccaaccgtgttttctccaggaggtgtgggggccacgaggctgtggcttccgcgttgttgacccctgtgctttgtggaaaaaattacgttaaattattaacaaggtgtgctgtgggaggccgcctgtccgnaacccgctgttgcccgtgggtatccgggcgacgccgagccacgtgtcgcacaaccccttcccagcgggggtgttccaggaagcgcccagtgaaaagccccagcctgtgagagccataaggcgtccctattcagagaaaaacagcgaggggtaatctcgcgggagcggatctcccaagaggacacgcattgtcatccactctcaccaatcgaccttcaaactcacccaagaacatgatggggagacaagacagcaccacagagaaggcagtcgggagagaagcgggggagaaacaaaacgggggcaccacaccgtgacggggaagcaacgacgagacgaccaacaacacacccacaccacaaaggagagcgaagcgaaaccacaaagtatacgcgaaccaacaaaaagaacaagaaaagagcgaaaagaggaggaaagcaagagaacaaaaataacaagacgccacacgacagacgcgacaagaaaaaaacgcaaccaagaagaacaaaaaacagaacaaacaaagacgaaaacaaagaagaggg

SEQ ID NO: 484019 - DNA, 368 bp, Homo sapiens
ggcccgtcagagttgagaccctgttctcacacagtatagtactaaatccccagattggactcacgttggggatgataaaattacagtagttgagatagtctatggcatattttctaacatcccgattttcattctctccaactgccatgactagtcctaagtctgcactggcctctcaatgcattccgattaacttttatcagcaggcgtgctattttattaccgtattttggcccagtcgggctaaaaccacctggtatttccctttgggccccccagggggcccaattcaagcccgatataacctggccgggtccaccccgcaagggccaccggggattttatcgggggttccccgcaattcctcc

SEQ ID NO: 484020 - DNA, 810 bp, Homo sapiens
gggtgtgaactcatggtttccaacatataggtacatgtagaaatacggacttgaagaaaacaagggcagcagaaatagtctctataggaaaaatgtaaaggagtgatgacaggaagagtgagaacacttatatgatacaacgaaaggtcatatgataagaaaggcatgacatatgtaagcttgttcaggcatgagtgatgtgccatgtggccatgagtccagtgttcatgaatcaacaatatatatcagataacaggtgtgtcaaccagaaacacacataaaacaaggttatgtattaaacagtcgaacaaaaactatgtgacccagggcctcacgggaacctaaaccttgtattttccctaagagcaattactcagtatacagtgtcacgtgtgtgggtgcacactcggtgtagaaatgttaactattatggctgtaaagaatagaacaatacgatgtacatagttgcagagtatctcccccacatatttagcaatggcagagtgaaagagaatacctaatagtgggaaaacctggcagctgatcaaagtgaccatcatcagtaataggcacatcacccttctaggctgccagaataaggggtatgagaccgtagcatcacttctctgttattcagccggaaattcagatctgaatcaatatcggagagttgcacacaaactggaactttaaaatagggccgatttaaggttcgggagacacaggctcgtgggacccgcctccaacagtgagggcgggaagaaggcgggcccaggtgaacacagaccgacccgagggtgaaccaaacgg

SEQ ID NO: 484021 - DNA, 1312 bp, Homo sapiens
agtctttttcttttttggtctacatccctcttgttttcaacttctatgacgggaggaaagctacacgtttggtcagcctcttgtcttccaccctccttctgtgtcttacgttcttttctactttttgttgtgatcctgttctctcctcttatcttggggtcttgcctactttttcccgtcccttttctcacgttttgcgtggtactttcaatcccctcatttactcttgtggttctccctctggtgtcttgccctgcttttatccgtccgtggtctctgctctgtgtcccgtctggccttcttcattcctcttgttgggttttccctgctctgtcactctttgatgcgtctctctggggttgtttcttctgggtatatctcctgtttgcgattgctttcgccgtctttcaccttccatctctgctctgtggagccctttgtcatctcccctcagtgggttccccccttgtgatctgtcatgccccttctcgttgtgtgcctccttgcctcggtctgctctttttttcttgttaccaatcttgtgtcgcgtctctgctcccttttatcacggatgggtcctcatgctggcatcttttcgtcttgggcccctctattcattgaatcgttttgtatgtgtggctacactgcctagtgtgcacgcctccttttctctgtcttgtcctggtgtatgcctacgctgccttttgggagtttatctggttttttgctctaccatcgagctgtgatcgtgggtactacgttgtccccaatgtccacaagttctttttcatgggctatgagtctctgagcttatgcgtccttggtgtgacagccgtgtccgtcgtccatgctctctcttaaggcctctgcgtcccgtgtcctcgtcatcacttttacagccttgtgttgtcttcctggatgtcagctgtctctcgtaagaccacgacatggtttaacttagtagttcgcgggcctggcgcccatcgcgtcagcgttccgtcgtgttgtgtagtttcggcggcttgctaaaacgttgtggtttgttacctactactttggtggttgtcctcttttcggcaatagttggagcgagtgcacaagctctccatcggtggtccttgtgctgccaagagcgactcatagtaaccaggtatgggagatgcagctgccttattctgaatcccagaaattacttgggggtgattgtcacagagggagggacagaaagggtatctgctgaccaccagccatgctctacccagtgcccagtgtctccagtccatgctcaagaaacgtgccgctggtcacgggg

SEQ ID NO: 484022 - DNA, 295 bp, Homo sapiens
cagctgttcttcaagatcacgttactgcactccagcctgggctacagagcgagactccgtctcacgaaaaaataaataataaaagataaaaaaattaattcagagaatttgcctataagtttgtaaactttatgtaaaaattttctgtgtttacaagtaacatcaagtcgtagtaaagcctgtctcacaactagttactgtactatgtatttactgagtagtatgtaaaaaacagaatctgtcaatttaagtatatctttttttaatctatggtacatcaccttcttgaagaaca

SEQ ID NO: 484023 - DNA, 547 bp, Homo sapiens
gcggtccgaattgacgcgtctccttggtttgaatactagacattctctcaagacaacgcaggattgttgggtgtggtggctcacgcctgtaatcccagcactttgggaggccgaggcgggcggatcacaaggtcaggagattgagaccatcctggctaacacggtgaaaccccgtctctactaaaaatacaaaaagttagctgggtgtggtggcaggcgcctgtagtcccagctacttgggaggctgaggcaggagaatggcgtgaacccgggaggtcaaggctgcagtaagcagtgatggtgccactgccctcagcctgggcaacagaacaacatgcaatcttaaaaaaaaaaaatcctggccaggcacaggggcttatgactgtaatcccagcactttaggagacggaggcgggcagatcacgaggtcaggagattgagaccatcctggctaacacggtgaaaccccgtctctactaaaaatacaaaaaattagctgggtgtggtggcaggcgcctgtagtcccagctacttgggagggtgaggc

SEQ ID NO: 484024 - DNA, 161 bp, Homo sapiens
atgacgagcgagacgtcatcctgagacagtacatcagcacctcctgtgctcagcccagcctgcccctgcagctgtcagagtgtgaacatacctgctgtcgctgggtgtcttgtccacatggtgccctgatgccccatcacaatggaggctcacatgtgcta

SEQ ID NO: 484025 - DNA, 226 bp, Homo sapiens
ccgccgccgggctgataggtgcactgccgctgcgcgcactctgctgctcgctcacgccataaaacgtcttcatgtaacggcgatcgccaaacagcgcggcggattcaaacgccaggttatcgctctcatcctgccaaggcagtactgtcacggaggttagatattgcacgccttgtccgtcagttaggggcagtgtcgccttgccctctagcgaaagccatgaggt

SEQ ID NO: 484026 - DNA, 314 bp, Homo sapiens
taaactggggaccaccaagtggtaaagatgtatgtttttacctgacagttataccacaggtagactgtcaagttgaaaagagtgaatcaataactgtgtattggttttaaaaattaaataaatccttgataagagtggcttttttttttaaggagttagtccttgaccactagtttggatgccatctccatttgggggtgaccgtgttttcaccagcaggccgtgtaactctccagtgactaacgtggttgtaagtgcttaaaagggaataaaagtgggctttctcatacattaaaaaaaaaacaaaaacaagg

SEQ ID NO: 484027 - DNA, 338 bp, Homo sapiens
tagaggatcccgaaaacgacatagaggcaggacgttaagcccaggagttcaagaccaactggggcaacatggcgaaaccccgtctctactaaaaatacaaaaattagcggggtgtggggcacatgcctgtgtcccagctactcagaaggctgaggcaggagaatagcttgaacccgggaggcggaggttgcagcgagccgagatcgtgccactgcactccagtctggtgacagagcgagactccgtctcaaaaaacaaacaaaaacaaatggcaactgctattttattattcttctattctaagacaactattattattattctcctcctctatgtca

SEQ ID NO: 484028 - DNA, 100 bp, Homo sapiens
tttctcccttggccctcaacagcgagtacagtgccatgctcttgccaaaaggcccttgttgggcaagtacacgttggaaacacgtgtaagtgtagagtgt

SEQ ID NO: 484029 - DNA, 196 bp, Homo sapiens
ctagcaggatcctatcgccaacactgaaaacaggatgaaagcctgtttactgcaattccttttacccagtgtatcatgtctacctatcaacagaaaattacaaagcatacttaaaaggcagaaaatgcagtttgaagagactgaacaagcattagaaccagagtcagtcgtggcaggagtgttggggataacatca

SEQ ID NO: 484030 - DNA, 735 bp, Homo sapiens
  misc_feature (47)..(47): n is a, c, g, or t
  misc_feature (78)..(78): n is a, c, g, or t
  misc_feature (504)..(504): n is a, c, g, or t
  misc_feature (580)..(580): n is a, c, g, or t
  misc_feature (635)..(635): n is a, c, g, or t
  misc_feature (681)..(681): n is a, c, g, or t
  misc_feature (697)..(697): n is a, c, g, or t
  misc_feature (735)..(735): n is a, c, g, or t
gtaacacccacacattacttattaattacaaacgaatgaagtacttntacgatggagaaatatggcagatgccacctnaatcaagtgaccacacttagaattaccaataatggggcaaactgacattatgtggcttttgatggagtgcagtgggatgagcacaacatcacttatgtagtatttgccaaacatctttgacctgaatctaataaagagatattaatcagacacattcacattataagatctcctacctcaaatagcgtatcctctaaaaatgtcaatgatttaaaaaacaaaaaagggtatatgtgtgtagagggaatgttccagaccaaaggagaccaaaaagatatataacaagcaaatgcaatgcttgagctcagattggattatgaatcagaaaatgaacaaagagctataaaggacatgattggataattgggaaagtttaaacatggaatgtatattagataataggtctatcaatgttaaatttcttgngtatcatatggtattatggtaatatacaataatgccgtcatacctcggagttcaatgttcaagggcaggaagcatncagcatgggagaaagatgtaggctgggagactaagccagtgtagtcttttcaggntcttctgctggctttattctgacacactggcagcttgatagatggnggccacccggattganggtgggtctacctttccagtccactgactcaaatgtan

SEQ ID NO: 484031 - DNA, 681 bp, Homo sapiens
  misc_feature (47)..(47): n is a, c, g, or t
  misc_feature (78)..(78): n is a, c, g, or t
  misc_feature (450)..(450): n is a, c, g, or t
  misc_feature (526)..(526): n is a, c, g, or t
  misc_feature (581)..(581): n is a, c, g, or t
  misc_feature (627)..(627): n is a, c, g, or t
  misc_feature (643)..(643): n is a, c, g, or t
  misc_feature (681)..(681): n is a, c, g, or t
gtaacacccacacattacttattaattacaaacgaatgaagtacttntacgatggagaaatatggcagatgccacctnaatcaagtgaccacacttagaattaccaataatggggcaaactgacattatgtggcttttgatggagtgcagtgggatgagcacaacatcacttatgtagtatttgccaaacatctttgacctgaatctaataaagagatattaatcagacacattcacattataagatctcctacctcaaatagcgtatcctctaaaaatgtcaatgatttaaaaaacaaaaaagggtatatgtgtgtagagggaatgttccagaccaaaggagaccaaaaagatatataacaagcaaatgcaatgcttgagctcagattggattatgaatcagatggaatgtatattagataataggtctatcaatgttaaatttcttgngtatcatatggtattatggtaatatacaataatgccgtcatacctcggagttcaatgttcaagggcaggaagcatncagcatgggagaaagatgtaggctgggagactaagccagtgtagtcttttcaggntcttctgctggctttattctgacacactggcagcttgatagatggnggccacccggattganggtgggtctacctttccagtccactgactcaaatgtan

SEQ ID NO: 484032 - DNA, 159 bp, Homo sapiens
tactctatctctctaagtgaatcattcaatttatgcaagacctttcatcttcaaaatcccaagagagcttacaggtactttttttatataagtgttattatttattgaaaaagggttcaatttttgacaccaggggggaagaggaagggacaaaacaaa

SEQ ID NO: 484033 - DNA, 195 bp, Homo sapiens
gtaagtccaagagtccaaaagcttaagaacttggactcttggacttacaccagtggtttgccaggggctctcgggcctttggccacagactgaaggctgcactgtccggcttccctacttttgaggttttgggactcggactgatccaccactaccttccttgcccctcagcattaacaccaccgatcgtggaca

SEQ ID NO: 484034 - DNA, 190 bp, Homo sapiens
ttttgaagccccttggggcaagggggggggaaacttttttttttaacccccccttcttttttttttggccacgcggggtttttaaggggttttttaaaatttgtttttttttatttgccccttccgggtaacccccttttgaacggggaaagggggtttttttttttttttaaaaatggtttggggccca

SEQ ID NO: 484035 - DNA, 386 bp, Homo sapiens
taaagacagagtctcattctgtcacccaggctggagcccagtggcaggatctcagctcagtgcaatctccacctcctgggttcaagcgattctcatgtctcagcctcctgagtagctgggattacaggtgcccaccatcacgcctggctaatttttgtatttttagtagactgggttttgtcacgttggccaggctggtctcaaactcctgacctcaggtgatccatctgccttggcctcccaaagtgctgggactgcaggtgtgagccaccgcgcccggcctattgtgacatattgggatatttctttcttttttgggtgacagggtttcactctgttggaggctggagtacagtggcacaatttcgggttaccttcactttcac

SEQ ID NO: 484036 - DNA, 281 bp, Homo sapiens
cggtaacctaaaccgatgcaatggttgcataattcacttattccttaattagggacctgtatgaataggtccagcgaagagttcagctagtacgtcttacttttaaccagtgataattgacctgtcctgtcaagaggcgggcattgacacatcaagacgagaagaccctattgagcttctaatttattactgctaacagtatctatcaaagccacaggttctagactaccacatctgcattaaaaatttcggttggggcgacctcggagcatgaacctaag

SEQ ID NO: 484037 - DNA, 176 bp, Homo sapiens
  misc_feature (125)..(125): n is a, c, g, or t
ctccaggtgtgtgtatgttcagatgtatatgtattctatatttatcattacggagagagaggagaactcatggggaatggaagtactattctgctgaatgtcagaaccgctgtgcaagccagacncataatttgcccaagttttcagctggtttggacagattcaactcaaccgct

SEQ ID NO: 484038 - DNA, 347 bp, Homo sapiens
cagtcgagtctcactctgttgcccaggctggagtgcagtggcgtgatcttggctcgttgcaacctaagccccccggttccaagtgattctcctgcctcagcctcccgagtagctgggattacaagcgcgccaccacatccggctaatttttgcatttttagtaaagatgggatcttgccatgttggccaggctggtctcgaactcctgaccttaagtgatcacctgcctcggcctctcaaagtgctgggatcacaggcatgagccactgcacctggcctgcagggctgttttcaagataaggcagggaaacatgtcttggggttaatattttttaggttctcccctg

SEQ ID NO: 484039 - DNA, 104 bp, Homo sapiens
tctggatgcagtgtcctctctggatgcaagtgtcagaatttcaagcacaaccccaaaattacaccatcttcatatccaaggtaggtgacactttgcatccagag

SEQ ID NO: 484040 - DNA, 390 bp, Homo sapiens
  misc_feature (144)..(144): n is a, c, g, or t
cctccttttcccaggaatattccctgggcttttgaggccataaagccagccagtggatgggtaagaagaactaagggcaggcccctttatttgcccccggcttgaactggggaacgactgggactctgccaccaagcagtttgntgggactccagcccataagccctgtgtcccctcttcatagagtcctccattccagtcaagggtaagtcaaatgaactgaattttaactttttgcatgcttctatgtagaaaataatccaatgataatagatccttataatgaaacttcattaaggtttcattcaggggagcaattcctgtctttaaaaattaagtggaagaagaattcctttaatccactaccaagcaataataaaatggacctta

SEQ ID NO: 484041 - DNA, 183 bp, Homo sapiens
  misc_feature (79)..(79): n is a, c, g, or t
  misc_feature (173)..(173): n is a, c, g, or t
ttatgcttcccgtagccgtggcttttcattctgcacaagtcccaggtcccagctcccctcttatggtttctgtcataantgtgctttatctgatttgactccaaacaatcccgaaatgtcacctgcagatttctcgttgggaaccaatatgtacatgtttgcaattatgctantgagaattta

SEQ ID NO: 484042 - DNA, 458 bp, Homo sapiens
gtgatttatccccaacactcggagggctgaggacaactaatctcttgaacctaggaggtggaggttgcagtgagctgagattgtgccattgcattccagcctgggtgacagagggagactctgtctcaaaaaaaaaaaaagggaaaggaaaggaaaggaagaggaaattattcttcacggcaatttggggaggcagatacatattcattcctcatttagggagatggggaatgggttgctcagagagggcaaggagagctgcctgtgaggctcacacagcacctatagggggcaaaagagggatccccccccaggttttacaggcccccaggggttggagattggaagacctttcttatttcaattctataccccaagagttctgataggcacatttcctttcagagggggtggagagagatttggaaagagaccttaagacacgggtgagagccagg

SEQ ID NO: 484043 - DNA, 254 bp, Homo sapiens
aagctagggacatagaagagatgacatgtacaagagaagacacgagatgctggtggcaggcttgaggacagcaagtggttgtactcaactatgaagcgtttgtgatgcatatcctgtcggggatgacgggcccactgggagcgagacctcggtccgcatgggtgctgacctggctgcaggactcttcccaggtctccccagtattccgtgcctgtgcccctgtgtgatattattgtatctaggcctacctgttg

SEQ ID NO: 484044 - DNA, 201 bp, Homo sapiens
acgcaaagatccagtctgacaatatatcccaacatgcctcgggactttatagaaacagttctggcccaccataaacccatatatccatacaataaatacatatatgaaactctgcccggcttgctagaagacatcaaaaagctattagggggagtagagcctgaagtccttgaaagaggatcatgacgcgactgagagtgc

SEQ ID NO: 484045 - DNA, 1008 bp, Homo sapiens
aacagcggaatcccctgtctacctctctccttggtcctggaatagtgctaccgatcactaagtagccctaagacataataaaccttcaactgctcagtagtttttcttatgaaagtcaagtaaaaggacgtaagcaaaaaaaaaattattttttttttgcgtgaaggattccaaaaataaaattctctggggactgagaagaaaaagaataaaataaaaacgcaaaaatgcgccagctggattattaatgggagaaaaattcctcctccccgcgtgggctgggctaccccagccagttgtcaaccacggacaccgggacaaaccaaagacggcctctggagcacagaaaatgtctatcaaagcgcctaatcatgggagaaagaggcgaagggcaagattaattggaaagtctaacgccacctggaaaacactggtttttgggatttgcccttaagaaaagatacgctcccgcgatttcccaagctagaaaaagcgcagactttctgggaattgactggtgaagcacctccggaacctgcagggggcgcagatgaccgccgcgctcagaaagacccgagcgtgtgggggaaataccggccggttcagcaattgcttgaccgaggtgacccgtttcctgtccacgtgtgagggcgttaccaccgaggtgcgcatcggctgttgggccacctcggccattgttgaccagattcaacgccattgacctaccccggggggccacccccgctttgaagggcccgccgccgacgcgccgttagagattgcgttccgcaagagcccattgccagcgccggctctgtgttgccatccccgggggcggggccctcccggagcgcccctaatttgggcccagttgtatagtctccaggtttggcggcacaatgggcgggcctgagacatgctttcacccaaaggctgaccaagccggttccgatacaaaggacctgcgttaggatccatgctcccactatgcatggaatatccgcctac

SEQ ID NO: 484046 - DNA, 154 bp, Homo sapiens
gcaagtaaaacaactaggctgggcacggtggctcacacctgtaatcccagcactttgggaggcaggcaggtatatctcttgagccaggagacagacgttgcagtgggctgtgatcacaccccttcagcctggtgacatagcgagaccctgtctc

SEQ ID NO: 484047 - DNA, 171 bp, Homo sapiens
tattcgatcttagagcataccttacaagctttctcatgtgcaggctgatcggatctgactcagtgactgccgctctgctcgcaagtgctggatacggcatagcacaacttggcatagatgagcttatctgtcaagtctctctgtgtcagctgggctgggccgtggtcagtt

SEQ ID NO: 484048 - DNA, 426 bp, Homo sapiens
  misc_feature (60)..(60): n is a, c, g, or t
  misc_feature (163)..(163): n is a, c, g, or t
  misc_feature (210)..(210): n is a, c, g, or t
  misc_feature (288)..(288): n is a, c, g, or t
ttgactttaacatctgtacatggcattagaagtgtcatgcaaaagaaaccacagctggcntgcacagcaacacaagaccagaaaatggtagatgaatgaagaataaaggtgggtttattccttattataaagaaaaaaaatatttcttcagcagtcttaacanagacatcaagatacaaaattacaagtgttttgactcagccctggtcnccatctcctccaagagcagaggtaggagacagttgaagcaaacaaagcaattctggtaaaaaattacctagaaacccntacaaattttgattaaaattcttaaactttctataatttttgcttttttaaaaaattttaatatcaaaaaggcctgcttttagtgacatgctattcctacagaaaaataaccccaatacccccttctgtcgtcttctc

SEQ ID NO: 484049 - DNA, 1636 bp, Homo sapiens
  misc_feature (41)..(41): n is a, c, g, or t
taggggccaggaaaatggtttgaaccgggggagggcaagangtgttggcagtggagcgccgagaaatcggccgccattggcgactccagcccagtggacagagacgcaagggactccgtctcagaaaaaaaaaaaaaaaaaactccgaggggcaccaagtgcgcgggggcggcgagagagaaagagaggagtagaagagaaacggggcacacagtggtcctcatgaagcgtggtgccccgcgcgcaccccagagtctgttctctgtgtgagccacaaagggggggtgacaacatgcggcggggagctccccctaattaagggagaggcgccatctacactgttcgcagaaaagaagcacccggggggtgtacacccccgcggaacatttgaaagagggcaatcctcgggccaacacgcctccaacacaaccaacattcaccatggggcccacagacggaggagacgaacgacacgggcattctacaaagcgcgccccagcgggacgcgttaggcacgctaaccacaagggcacatactgcacacaaccgccgacggaacaaaccaccgggcgcacgcgaacaacaaacgcgaaaccacacactaacccccaacacgcccacccccgccccccaacccccgccaggccacagcacccccccagacccgttacaccccaggcaagcccccaaacacgaacagccacaagagagccacccagctagccaacacaaccccccaacaccgcaccaaccccgctagacacacacaagagcagaccagcaccacaacaaacggccgccagcatgactcctctacaccaagacacgcgctacactcccccagccccacacgcaaccccaccgcaccacccacacgcacgcacacgacaggacgcagcacccccactctcgcacccgccaccgcaccaacgcaacccccaaccaaccacacccacatcacacccaacacagggcaaacgcgacaagagcacagagcggccagagcagcgcaagcgcacaacacacccaccgaccccgcccagaccacaacaaacgacgcaacaacaatccacaagacacaacgagcaaccgacgacgagagaagcacacacttagctcgcaccgaggccgcaccccgccccgagggcccacacgcaccccccgcagcagacgcaccgcgactccgctacacaggacccgccacacccacatgcaacacacaagagcacgcccggagactcgacggcatacaacggatcggcggaactcgacacgacaagacgtaccaagcagggacgcacgacagagaaggagcgagaacgaagcgagaagaaagcacgcagaccgccacctcccgctgaatcgcccgcgacaccgcgttctccgatccatctccctcacgcccgcctagcatccgcgagtacccgagcactgcaagagcgacgacagcgtggacggagccgcgacgaccggacagcaacggatacgaacagcaaaccagcagcacagactggcactgactacctagcaaccgtagctgcgtcacgccgtacacgccaggacgccaagagcagcatggcgaagcgcacacgcagcgcagaccagacagcaaacaacaggcaaagcgaacggacac

SEQ ID NO: 484050 - DNA, 672 bp, Homo sapiens
atgtcagtagttgttttttgtgtgtgtccattttaagtgggatataattatgtattttgaactatgaatggagactatccgccccagcagttagtttcacactgatataccctttaaacccgaatcattgtctttattatcctggattacacaggtgttgaatggggaaatggggctatgtatattcagtaggatatactatgggaatgtatatatagtcattgctgttagagaaatgaaataaaatggggctgggctcgtgatccgcccgccttggcctacccaaggtggctgggattgacaacgcgtgagccaccgcacccggcctgaaaatattttctaaaaagattaaaaatatacataacgatgaaaaataatacaaatttaaaaaccaatacagtataacaactatttacatagtgcttacattgtattaggtgttataagcaatctagagactgatttagcaagtatacaggaggatgtgcctaggttatatgcaaatattgtgccattttatgatgcaggaacatgagcatctgcagatattggtatcggagggcgagtcctaggaaccaagcactccacgaatactgaggggtgacatcttcatgaactgtagatcattgtagtcacagactgtaaactgaaacgaatatagaaactaattag

SEQ ID NO: 484051 - DNA, 125 bp, Homo sapiens
cgctagcggctagtgaacgcttccctgtggcaccaatcaccacctaacttctcgtctcttctctcccttggcctctctcgccccaccccctccccataagctccgttcacttaatgccgctagcg

SEQ ID NO: 484052 - DNA, 229 bp, Homo sapiens
  misc_feature (103)..(103): n is a, c, g, or t
  misc_feature (117)..(117): n is a, c, g, or t
  misc_feature (167)..(167): n is a, c, g, or t
  misc_feature (223)..(223): n is a, c, g, or t
tactgtaaccagcaggatcactttctccccatatcctttatttcatggccatatttttctttgtaaatggcacctttttaagatgctatataaagaggcccanttcaaagttttaanttcagattatttgggctatttgagaacattctaagcagctgaactatggnttgaaataccctttttacatgcttgaataagtccaaacagcttggatttccttcgntttcag

SEQ ID NO: 484053 - DNA, 226 bp, Homo sapiens
aatgcccggtgtttttttttaaaatgatttcccggggggggggccccctttttcctggtggacctttaaggatttaaatgttttaaatttcccttggcccttttttgttttttttgtagggccccccgccctgttttaggggggttttcccggggttttggcttggacccaaggggtttttttttttttgttttttttgagaattttaaatttaagccctttttta

SEQ ID NO: 484054 - DNA, 316 bp, Homo sapiens
  misc_feature (110)..(110): n is a, c, g, or t
tcttcctcctcccctcgcccggcccctgcgccgcgctgtgcccgcggtcccgcccggcccacgggacacgcattccgcacattccgttcgcacacgattacccggcgcantccagcagcgcgctcctggacgctgcggattctactgggggcccctgagctgcacggggcgcacgagcgtgcgcgccgcacccgtggcaccttcctggtgcgcgacagcgccagcggaactgctttttcgcccttagcgtgaagatggcctcgggacccacgagcatccgcgtgcactttcaggccggccgctttcacctggatgg

SEQ ID NO: 484055 - DNA, 210 bp, Homo sapiens
atgggcacgagaagtttgttctgtgacattgtattgatagtacacccagtatcagaccgtatgtatgggctggagatgattcctttgagtcctaaagtggactactctctggtgtatacatgcactcctcaattagttctcagataattctgcctctaatagcagcagaaactacaggtaatcatctccgggcttacttgaatttctgtg

SEQ ID NO: 484056 - DNA, 525 bp, Homo sapiens
  misc_feature (26)..(26): n is a, c, g, or t
  misc_feature (38)..(38): n is a, c, g, or t
  misc_feature (381)..(382): n is a, c, g, or t
aagaaaaactcgggtgggcggagggngcttcataccancttaaaaaccaacaaagccctttgcaaaccccgggaattttacccccccctcaaaggggtttttttaaaaacttcccccccctaaaaaaagggggccaaaatttttccctgtatatatatattagggggggccccccccctgttttttttttgaaaacccggttaaaaacaccccaccccccaaaaaaaatttttcccctttttataagagcccccgggggaaaaatttttttttttaaaaaagggatccccccccccccaaaaaaaaaaaaaaaaaaaggtttcctcctcccccccccccccccctggttggggggtgtggtggaaaaaaaatattttaaanngggggggggggtgtttttttttttccccccccccaccccaccccccctttaatataggggggggggggcgaaaaaaaacttttttttttataaaaaaaaagagaggggggggggggggagcgcccctttcctttttttttttt

SEQ ID NO: 484057 - DNA, 978 bp, Homo sapiens
gtaggctgagctggggggatcaacttggaaccacaggacgcagagagtagcagtgagagtcatgatcacgaccactgcacttcagcctgggatgcacagaacaaagaaccctgtctcttttgctcaaaatttcttttcaacatcttcaacgatcttctacacatttcgtgtgcatgtcttcattgtgccgaaacgcgcgagacccatgtcgtcgaaaaacgagaaccaatcgaagaaaacacaccagaaggcgtcacagtgtcatcgttctgccctcgaggccatcgttgactccgagggtttgtcccacgcaaaagaaatgaggaaaccagatggtcaatcatatactatcatactatatgctgtgctgctgctgctgctcggcgctgctatactatataatgctgctgctgctgctgatactatactatcatagctgactactgctgctgctcctatacatactacctccgataaatcatgatccccccaccactacaataagcggacaaggagagaaaccatcaccaacactcaacacgcgcacccgggacaatacaacatgcaggcaacaacgatagggaacagcacatacagcgaacgctacgcacaacacacaatccctgccatgcgaccagacagaagacccggggaacgaatgcacccagaagaagaaaggacgcacacaagtacctaggataccaccaagggatcccatcgagacggcaaccacccaccacaaacagacgggacagcacaaccaaagcacacgagcacagcactcacggaacgcagcacagccccagcgcgcaacacaatggaaacacaagagacgaggtacgggagagcaccgactccagtcgaaccagcacccccacaacgggagaagacagcaacaaacgacggacgagaatagcgcacacccgtcaaacgccgacaacacgacgcgcccagacacagcaacggaatcgcgcacag

SEQ ID NO: 484058 - DNA, 149 bp, Homo sapiens
tgggagggggccttccagcatgtgggcaaagccttcaatcagggcaagattttcaagtgaaaattttttgccataacctaggtgcctgcacctgccctttagggagatgggggtccttaaagggaaattaacattggaaaaaaaaaaaa

SEQ ID NO: 484059 - DNA, 715 bp, Homo sapiens
  misc_feature (3)..(3): n is a, c, g, or t
  misc_feature (84)..(84): n is a, c, g, or t
  misc_feature (87)..(87): n is a, c, g, or t
  misc_feature (109)..(109): n is a, c, g, or t
  misc_feature (149)..(149): n is a, c, g, or t
  misc_feature (155)..(155): n is a, c, g, or t
  misc_feature (162)..(162): n is a, c, g, or t
  misc_feature (165)..(165): n is a, c, g, or t
  misc_feature (247)..(247): n is a, c, g, or t
  misc_feature (277)..(278): n is a, c, g, or t
  misc_feature (293)..(293): n is a, c, g, or t
  misc_feature (312)..(312): n is a, c, g, or t
  misc_feature (316)..(316): n is a, c, g, or t
  misc_feature (328)..(328): n is a, c, g, or t
  misc_feature (348)..(348): n is a, c, g, or t
  misc_feature (355)..(355): n is a, c, g, or t
  misc_feature (398)..(398): n is a, c, g, or t
  misc_feature (401)..(402): n is a, c, g, or t
  misc_feature (406)..(410): n is a, c, g, or t
  misc_feature (435)..(438): n is a, c, g, or t
  misc_feature (442)..(442): n is a, c, g, or t
  misc_feature (483)..(483): n is a, c, g, or t
  misc_feature (532)..(532): n is a, c, g, or t
  misc_feature (558)..(558): n is a, c, g, or t
  misc_feature (578)..(578): n is a, c, g, or t
  misc_feature (622)..(622): n is a, c, g, or t
  misc_feature (655)..(655): n is a, c, g, or t
  misc_feature (690)..(690): n is a, c, g, or t
acnttcagaaagaatgcattccctgtaaaaaaaaaaaaaaaatactagagagagggagaaagagagagaagaagagagagaganggngggagagcgagacagagcgagnaacgcaatctgaccgagcaggtcgtacgccgccgcctccncctccnctctgcnctncgctacccaggtgacccgaggagggactccgcctccgagcggctgaggaccccggtgcagaggagcctggctcgcagaattncagagtcgtcgcccctttttacaacctggnnccgttttattctgcnatacccagtttttggattnttgncttccccttctnctctttgctaaacgaccccnccaaganaatttttaaaaaaccttctcctttgctcacctttgcttcccanccnncccnnnnncccaccgaaagcaaatcattcaacnnnncccnaccctccgacggcaggagccccccgacctcccaggcggacngccctccctccccgcgcgcggcttccgggcccggcgagagggcgcgacncagccgaggccatagaggtgacagcngaccagccgcgctgggtganccaccaccaccccgccgtgctcaacgggcagcacccggacacgnaccacacgggcctcagccactcctacatggacncggcgcagtacccgctgccggagaggtggatgtgncttttacatcgacggtcaaggcaac

SEQ ID NO: 484060 - DNA, 333 bp, Homo sapiens
tcgcatcacattatagtctgttcgtgatgagtggagcggggtgggaggacaggctttggtgccggcgtgcaggatgggctagcccagcgccacttcctggagactgtctggtggaagacaccgcggagcagggcctggtagctggggacacggaacaggtggctctcgccgtagcccacgtcgtactcggccgtcttgccggtgaccaggacgcgaatgtggggctcattcacctggcggcccacgagcaccacgaagatctcgatgcctgcccgctgagttacctgcacggccttctcgatggcagcgggcgtggcgcactgcgagttgaca

SEQ ID NO: 484061 - DNA, 762 bp, Homo sapiens
ttttttattttttttggaaaaagtcatggaggccagggggtgggcttgaaaccagcttgggggggtctcaggatccctatccttttttggtctaaatttaatgtatacgggttcttcgaatgtgtgtgtagggggggggggcaatccataatcagtcactccaggttaatgaggagggtctcttctacactaattaagtgacttttcgcttcgaagcgaaggcttctcaaatcatgaaacatttattaattattaacgggctgtcagaagacaatgaatggagcctcacagatgaatcagggatgagttccatggtgggggtcatggctatcgggggtaatgtccgagataacggtcgggggcaatcccgggataaggccggaacaaatgtggttggtgggagaagaaaatgtttcagtatttcaccgccggatcgcaattatggatcagtgcaaaaggggataatgatggcagtaaggtcagggccttaaggtgtggtaccctggagaatcagggggaaactcatgggatatggaagcctccctaatagatgggcgaaaatacaggctcccttaatggatcagggcacatagtgggacatgtgagacgcacacaaccggtaaagaacagttgtcagggagtcagacacgacggcacacacgttgcatcgagtctcggctcaatacacaaagggccaagtccagggccccccaacggggtggaacaagcaaagaatgaatcccaagggggtccaaagccctg

SEQ ID NO: 484062 - DNA, 141 bp, Homo sapiens
tctgtttcacgacgtggtcgcttcgattccagtgactcatgatcactggggatgggcctggatgatacggttcattactagctctcctttcttgagcgcctgtcattaccctgtgtgtgtgttttctgaaagcgaggaagg

SEQ ID NO: 484063 - DNA, 165 bp, Homo sapiens
ctggaggagtcccaggagtgcgtagatatagaactttgatttagatggaatcatggaaattacatagaagctagcagcctaagccaaagccatgaggttcatgtgaagttacagttacacaaataagaaacaaatggtacatccaaaagcataaggaaatattct

SEQ ID NO: 484064 - DNA, 150 bp, Homo sapiens
acgaatgactaaaatgagacagaacaagaccacatgagcatcatgagaaccctgatgactgagacctccatcatgaccggggacttgaagagaggtactctgattcccgctgccacatttggaacagtatgacggctgcagcagaggcca

SEQ ID NO: 484065 - DNA, 303 bp, Homo sapiens
ggtgagtcttgagaggaaatcgtgagtcactgcacacagcttcttcgtcagtatcgtggtggtgcagtgggccgattggtcatctgtaagacaggagggattccggtcttccagcaggggatgaagaacaagatcttgatatttggcctctttgaagagacaggcctggctgctttcctttcctaatggcctgggggctgggtggagaaggaaaactactattaggcccccgtcctgcacgccgtggagcatcagggcacacaatctggaaggaaaccacgcaggcagggcgccgaactcgag

SEQ ID NO: 484066 - DNA, 314 bp, Homo sapiens
tgatgcccccttgatgcccatcacctacatcaggaggatccccatcagcctctggagcgagcccccacaccatgtatgtccagcgtcttcctgccatctccaggcctcacacggagatgatgaccatccctcatgacacgggtttgccttttacaccatcactacctttttaagggatccaccggcaccctgaggagcccatgccacatgtgtccattggtttccctgccatctccagggatctcccaagatgaagtttatcccttgtagcctctgtctatctttgcatgccccttccacattctcgacggatc

SEQ ID NO: 484067 - DNA, 757 bp, Homo sapiens
cgggagctgccgacggacggagcgcccccgcccccgcccggacgcccgaccgaacgcgaggatgcaccttctccaaaagccacaacgcactgaagctggctacaacggcgagcgacgagtgccccgagcctgagacgcccacaagcaaccacaacactggaccaaggatgctgaccccacgaaacatgtacgcggacgctgcgacgccaagacgcacgccagagacggctcccaacgacgtggaccgaccgtcatccagaacaggcgtgcacaacccccgggacacccgacacatcaatgaaccgacgcggctgcaggtggccgcgccgacgcaggacgtcctaccgaacgctcgtcaacgcctcgtcaaacgaaccccaatcatcgaacgaaccgcgcaccggacgcgcatacaaagcccaagccgagcgagcacccaagcacccgacacctccaagccccgaacaaccgtggaagcgcgcagcgagaaacgcaccatgggaacaccacccaaccagatacagctgcactcgagccactacggacgagcatgtacgccaaccgggcgccacgagagcacaaagcaagcatgagaccaaagcactggaccatccgcacgcccacgaggaaagtgaccaaagccaccagagcggaaaaacaccgagacccgaccacccactccgaaagcacccgcagccgacacgcaccgcaaaagccccaaggcaaccacaccaacgccaaacagtgacaaccacct

SEQ ID NO: 484068 - DNA, 685 bp, Homo sapiens
tggttggtgtgtgggtttcggctgaagtactagatggggagggggactagtctagatgagactgtatccccgtgacaatggccgccggagatattcaaagcaccaacccactgtatgctaacacagcatgtctggatgaacagctgagaggatggcgagaagtgatattgcttagtgatagagtcctactatgcgaacgaggctggtttgaactggcatgatgacagataactgttggctcgaacttgtgatctaaaatctacatgcataatcactctcccacataactggtactacaacccagaccagcacagccagctagatttttgcagagacagcagctaaatatgttgtgcacaatgaattgacaattgaacatcatgagaaatgtcatcaaatattttcataacttactttaactatgcttacagcaatcattatgttcgaaacttttcttctcagttaatgaatactattcttatcagaacttcatgaccatctaagactcaattgctcaacattgattatctttccatctaatcaaaatcttgtcttcaatcattctattatgacttttttaaagatttttctggacctcatctccaaattttattgagacaatcgcattttccaaacgattttctccagctcttcatcatacgattcatcctctctctttccctct

SEQ ID NO: 484069 - DNA, 162 bp, Homo sapiens
cgggcacattgtttacctggacagtaccggggcgtcggggcttcgtgtgctcgtaagctggctcccactgaggcaagaccggaagtaatacttactaacttccaagcttcgtctactgacgcccgatacgctgagtgtggtttgcggatcctgggccttccc

SEQ ID NO: 484070 - DNA, 260 bp, Homo sapiens
gagaccggggtttcagcctgtcggctcggccggtctctcctgacctcagggtgatcagcccacctcggcctcacaaagtgctgggattacaggcgtgcgccaccttgcccagcccacatcatacagtatgaactgaacacttgccaccaccagcctctgctgtacgcacacacatatatcactgaacccgtctgacaactacaagttcatctttcttttttacacacacaccaaaacaacaacaaaaaaccacaaaaaaa

SEQ ID NO: 484071 - DNA, 159 bp, Homo sapiens
tgtgatcctcactttacgtatgtatcatccctaatgagacaaagtctccagtgtgatgatggacaaccccctggttcatgcaccagctgcgctgcaattgtgtgtgctggatgtggcatcctgcatctgcatgtgaaatggcttcccctaacctggatc

SEQ ID NO: 484072 - DNA, 126 bp, Homo sapiens
gagctcggtaccccttcgcgccatatcggcggctatttcaaaaaaagaagttctttaccagttgttgtagaaagtatgatattaccaacagcgtctagcttttattcgatattccgatgtgggcgg

SEQ ID NO: 484073 - DNA, 244 bp, Homo sapiens
cctgtgctgcggtcgctctcgacggtttcctatggacaatgcgctacgcgcacagctcatcatgccgcggctacgtggggaagccagccaggctctcatcgagggcttagtgtgaccattgacggacagactgggcagttagcctggggacagtggtttctgcattccccttcgaccaggctagacgtcacttacattccgcgttagccgcattgtgtccattagggatacccgacgcttcgaa

SEQ ID NO: 484074 - DNA, 138 bp, Homo sapiens
  misc_feature (13)..(13): n is a, c, g, or t
gtggcgcatctgntgagtcccatctactcggaagaatgaggcagcagaaccgcttgagcctaggaggtggaggttgcagtaagatgagatcatgctgctgtactctagcctgggaatgagagtgaaactcttatctca

SEQ ID NO: 484075 - DNA, 165 bp, Homo sapiens
  misc_feature (139)..(139): n is a, c, g, or t
cttatcaacgttgctgctgctgcgatacataagctgtttcactgacccgtctcccatactctgaccatctcggagccccaggcttcagctctctccttcactcctgcccttgcctctctcttcttagccgtgtgtttcnccttctccctaggcgctcgtaggcag

SEQ ID NO: 484076 - DNA, 141 bp, Homo sapiens
gcctcggaccacgtatatgtacattcatatactaaatattgtcatgactgtgtagggctgctattgggatcagttaagtaaattcttttgtatatacccgatcaagacctttctgttctggaaaaaaaaatgatcatgtag

SEQ ID NO: 484077 - DNA, 127 bp, Homo sapiens
tgctcgagaggtacgcttatgcactttcagtcacgcgcgcggggaagcaagcaaggcggctcgggttcaccgtgaagcagtcagttgtggctttggttaagtatcaacatttcagagaggcaggact

SEQ ID NO: 484078 - DNA, 647 bp, Homo sapiens
acggcagagtcgacgtggggcggacgcggcggacgtgggtgagggcgcggcgtaaaagacgggacgcggggtgcccggcgcgtgtgggggtcccggcgccgccccacggcaccaagaaggcctggccagggtacctccgcggacccgggggtggggggcgcgggccgggccgatgggcccgggaccccagcggccggagcggcgccgtcccgcgtgcgtgtcactggtggcgcggctgagctacgccgtgggccacttcctcaacgactgtgcgcgtcatgtggttcacctacctgctgctctacctgcactcggtgctgcgcctacagctcccgcgggcggggctgctgctgctgctgggcaggtggcgacgggctgtgcacaccgctcgtgggctacgaggcgaccgcgccgccagctgctgcgcccgctacggcccgcgcaaggccctggcacctggtcggcaccgtctgcgtctgctgtccttccccttcatcttcagcccctgcctgggctgtggggcggcacgcccgagtgggctgcctcctctataacggcccgtcatcgtgatcttccagtatgggtgggcctccacacagatttcccacctcagcctcatccggagctcgtcacaactgaccatgagc

SEQ ID NO: 484079 - DNA, 487 bp, Homo sapiens
ccagctatagtttgtataatttacatctattcgcagacagaggttcctagtcagcattacctggtttggcttcagcattatcatttgaactttagaaggaattattacttcaatagaagattgttttacagtgctactatgtcgtattgtgactgtctgctgcatgcacaaatctgtccagtatacttaacttattttcatgtagatcacataatcgtcgttgatatagatcctgagaggcagataattcagcatttcataaaaagataatggtatcacagcaacatttggatactacagtgctatggagaataccaccattatagtggctggtgaactctaccattatgtagggctgcacttttcccccgcgtgtacaaggctaccgcgtagagcaggtgaagctatgtgggtccacaacaatgtagtttttagtagatgtcaagaggtatctaagctcaaatcacagtgtagtaactatattata

SEQ ID NO: 484080 - DNA, 133 bp, Homo sapiens
atcatcttccttatgctcatcctccttatgctcatccctccttatgctcatccctcctttcgtgcagccaccgggtcacacgattaacccaagtcaatagaagccggcgtaaagagtgttggggatcctctag

SEQ ID NO: 484081 - DNA, 1408 bp, Homo sapiens
  misc_feature (142)..(142): n is a, c, g, or t
  misc_feature (217)..(217): n is a, c, g, or t
  misc_feature (334)..(334): n is a, c, g, or t
  misc_feature (521)..(521): n is a, c, g, or t
tcgtctaggtcgaggctgggtttgaattcggccgaggccaattttgcaactgacgggcgcggaggaggaggttcccggaatgccacgcgcagctgtgagcagctggcgacctgcagctggatgtgcccggagctgcctgcgngggctggcagaggcgagggaggttgcgggtaggaagggcggactgcgcgcgccccctgcgtcccgcgcacctcgngggccggtccatgctccctgactggctgcgggcttcagcatctggggccagtgtttggggctgtgctggggtccatgggctgcagtgtggtgctggcctgatgcgccgggccggagngctgaggccgcgctgcgggggctgggacagcactggcatctccagagcagggcccggggcagcaaggggaggcgccgcgatgccatgacgaaaatatcttcctgttcgtgcccaacctcatcggttatgcccggattgtcttcgccatcatttctttctacttcatgccctgctgccccctcacggnctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctaccttgttccatttctctgaggggacctttagattggctctgtgggactgtccgggatgggcctctgggtcactgcccccatcgcctttgctgaaagtcgctcatcagcgtcatccacctgatcacggccgccccgaaactatggctagccctggacgcaggaagaccgcgccaagaagaagtgacagctggagcccccgggtcctgggccagcccaaactgaacctgagaagtatatgactgatgccaaaacagaatccaccaaacccacatgacaaggagggtccacagatctcaacaacactaccctcaatgtgtagaatctaccatgctgggatgcggggtatagactactcattagcgtgacggtcaagttactcatgggaatcctgcaggacccgggaactcaaagtcaagtaggaatctgcgtggaagacaccatcatcaaaggaaggagatcatgaattagcaaggaacagagaaggcacaacacagacagaagaacatggaaacaaatgaaaggaatct

SEQ ID NO: 484082 - DNA, 1274 bp, Homo sapiens
  misc_feature (142)..(142): n is a, c, g, or t
  misc_feature (217)..(217): n is a, c, g, or t
  misc_feature (334)..(334): n is a, c, g, or t
tcgtctaggtcgaggctgggtttgaattcggccgaggccaattttgcaactgacgggcgcggaggaggaggttcccggaatgccacgcgcagctgtgagcagctggcgacctgcagctggatgtgcccggagctgcctgcgngggctggcagaggcgagggaggttgcgggtaggaagggcggactgcgcgcgccccctgcgtcccgcgcacctcgngggccggtccatgctccctgactggctgcgggcttcagcatctggggccagtgtttggggctgtgctggggtccatgggctgcagtgtggtgctggcctgatgcgccgggccggagngctgaggccgcgctgcgggggctgggacagcactggcatctccagagcagggcccggggcagcaaggggaggcgccgcgatgccatgacgaaaatatcttcctgttcgtgcccaacctcatcgggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctaccttgttccatttctctgaggggacctttagattggctctgtgggactgtccgggatgggcctctgggtcactgcccccatcgcctttgctgaaagtcgctcatcagcgtcatccacctgatcacggccgccccgaaactatggctagccctggacgcaggaagaccgcgccaagaagaagtgacagctggagcccccgggtcctgggccagcccaaactgaacctgagaagtatatgactgatgccaaaacagaatccaccaaacccacatgacaaggagggtccacagatctcaacaacactaccctcaatgtgtagaatctaccatgctgggatgcggggtatagactactcattagcgtgacggtcaagttactcatgggaatcctgcaggacccgggaactcaaagtcaagtaggaatctgcgtggaagacaccatcatcaaaggaaggagatcatgaattagcaaggaacagagaaggcacaacacagacagaagaacatggaaacaaatgaaaggaatct

SEQ ID NO: 484083 - DNA, 186 bp, Homo sapiens
ttccgaattctctaatggatggattttcattgaggacgttcatgggtttaagttaattagtctcacttaatcaccgaatctgaatgaatgtgaatagatgattcactggataaatatttgggatctggatattaatcatcgattctcttaaccacttgagtatttactacttggataggagcttta

SEQ ID NO: 484084 - DNA, 1324 bp, Homo sapiens
  misc_feature (142)..(142): n is a, c, g, or t
  misc_feature (217)..(217): n is a, c, g, or t
  misc_feature (334)..(334): n is a, c, g, or t
tcgtctaggtcgaggctgggtttgaattcggccgaggccaattttgcaactgacgggcgcggaggaggaggttcccggaatgccacgcgcagctgtgagcagctggcgacctgcagctggatgtgcccggagctgcctgcgngggctggcagaggcgagggaggttgcgggtaggaagggcggactgcgcgcgccccctgcgtcccgcgcacctcgngggccggtccatgctccctgactggctgcgggcttcagcatctggggccagtgtttggggctgtgctggggtccatgggctgcagtgtggtgctggcctgatgcgccgggccggagngctgaggccgcgctgcgggggctgggacagcactggcatctccagagcagggcccggggcagcaaggggaggcgccgcgatgccatgacgaaaatatcttcctgttcgtgcccaacctcatcggcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctaccttgttccatttctctgaggggacctttagattggctctgtgggactgtccgggatgggcctctgggtcactgcccccatcgcctttgctgaaagtcgctcatcagcgtcatccacctgatcacggccgccccgaaactatggctagccctggacgcaggaagaccgcgccaagaagaagtgacagctggagcccccgggtcctgggccagcccaaactgaacctgagaagtatatgactgatgccaaaacagaatccaccaaacccacatgacaaggagggtccacagatctcaacaacactaccctcaatgtgtagaatctaccatgctgggatgcggggtatagactactcattagcgtgacggtcaagttactcatgggaatcctgcaggacccgggaactcaaagtcaagtaggaatctgcgtggaagacaccatcatcaaaggaaggagatcatgaattagcaaggaacagagaaggcacaacacagacagaagaacatggaaacaaatgaaaggaatct

SEQ ID NO: 484085 - DNA, 787 bp, Homo sapiens
gaagtgtgtcattgctctccaagagaaggatgtggatggcctggaccgcacagcgtggtgcaattcgaggccgggcagcccgggtcgttcacgtagtcacctcagagatggacaactatgagccaggagtctacacagagcagggttctgggtagaggctcactacagctgcatctcgcaagcatcaagtctatgctccgggcgttttactgagcaagtagaagcagccgtggatagaccctcagctcggagcctgcccagtcccatggatgagaatgagtttatcgagtgtgttcccggctggtatatgatggctatcgcgggacatcagggaaagcagtgctgatgataaaggacgcctgaggagttggatgactctgagtttgagacagaagatgtgatgtcagacgcaggacgagcgtccagacgagaagacgatcagctgatagactgggcatgagtgcccgggcgatcatggctcagcttccccaggatgcaatagaagcgagagatctgcgggacaggtggccagtttccaggaagaaaagagcaggcggtggatgctgaagtgtctcaaatgggacggacagtggcaaggactgtcattgtgtctgggcaggcagatgtgcatgattatgagggagatgacagactttacccggaggtaaaggtgcattgaaggatacatcggatgtgatcagagatgcaagaaaatgatggggcaggggtcaggatggtggaagttgggcggaccatggtgacattggccgatgggttggcagaagga

SEQ ID NO: 484086 - DNA, 102 bp, Homo sapiens
tggctggcagcagtacagcccaggtaatttgcttgagcctaaagggtgtcagtgtcagtccgagtgaaagtgaagagaggctgggacgaggggtgcagggga

SEQ ID NO: 484087 - DNA, 575 bp, Homo sapiens
ggcccggggcgcgtgctcacgcctgtaatcccagctctcagggaggctaagaggcgggaggatagcttggagcccaggagctcgagacctgcctgggaatatagcgagacccgttcctccagaaagaggaaacaaacgcgacaagataaatccacatgacacaccaagggcgcgataataagaccgggaacactaaagcaagaacagaacagatgtgggcgggcgcgcttgcggcgctgaaaagaaaagttttatgaaacaccaccattgggggggggacgggcgggcccccaggcgtgttagatttatcgtggcaccatgggcggcgacaaaaactgctgctgctcgcaagaagagaacagatcctggtcgcaacaacacacgtgtgcggggggggattcttcccacacaaaattaaaaaaaggcggccggggggaaacgcgcgggacggtggtggaaacacaacgaccccagaaagaggactgccgggaaggcaacaaaaggcgggaactacacgaaggggggtgccccaaggaccgcgccgaatgaaaaattaagcccgcgcggggaggccg

SEQ ID NO: 484088 - DNA, 106 bp, Homo sapiens
gatagacgcttgttggtgaattggcaaggccttcagtttatttccactattttcaagacaatagattagatttgcggtgcatctagctctagattcaaggctgctt

SEQ ID NO: 484089 - DNA, 369 bp, Homo sapiens
  misc_feature (365)..(365): n is a, c, g, or t
  misc_feature (369)..(369): n is a, c, g, or t
gaatgacacgtgacgggtggataggcagtgccaatgagacccgccgtggtcactactcagaggagcccggggcatctggtgcgaccagtgtggcttccactcgggtgggctgaggctacagcggggcctgggcagggctgagtgtcccccgttgaacacagggcccccgcggcagcggctggacctgcgcaagccccattgtctcaacatgtccaaaaacccagggctcccagaagggaaagaccacagagtggaaagcagaatggctcaggacctgcccagagcctcgccaacaccggacaacagcagagaaaagcctcaggacctgcccagagcctcgccaatgctggacaacagcagagaanagcn

SEQ ID NO: 484090 - DNA, 231 bp, Homo sapiens
ctgagtggcatataactcctaagatccttggaatctacaaaatgacaccactttggaaaggccaaagattttaggagttatatgccactccagcgctggagtggcatataactcactgcagccttgaacttctgggctcaagcaaacctcccacctaagtcccccaagtagcgaggactacaggcacatgccaccatgccatgcctgctaattttttaaattatgtttaat

SEQ ID NO: 484091 - DNA, 433 bp, Homo sapiens
gtgttagagacctgtgtagtgagtgagtgaagaagtatgagctaactctgggtaggtgatcctcactagctctgagtagtgggataaaggagtcatccattcaggtttttgtagagatggggtcttgtctgtgttcaggttggtctcgaatcagggctgaagtgatcactaagtctccaaagcctgggattataaatgggagctcggaattcagcgtccttattgtgttcatggggatagcgtctgataggcagtgagagatagggattctctgtgtatgcctaataaggttcctctgtaagtcaattacttgtagcctttctccattgtttctctgaacagtttttagaagttgctggtatcttccagagtcaaaactggcaaactacggcctgtgggccagatacagcctgaaacctgtttttctacaacc

SEQ ID NO: 484092 - DNA, 431 bp, Homo sapiens
  misc_feature (126)..(126): n is a, c, g, or t
  misc_feature (128)..(128): n is a, c, g, or t
  misc_feature (148)..(148): n is a, c, g, or t
  misc_feature (156)..(156): n is a, c, g, or t
  misc_feature (181)..(181): n is a, c, g, or t
  misc_feature (222)..(223): n is a, c, g, or t
  misc_feature (225)..(225): n is a, c, g, or t
  misc_feature (329)..(329): n is a, c, g, or t
gttgactcagttgacttttgagtatctactacataaaaagcccattactattaagaaactcaagacaaacatgatttttacctttaatagcctaagatttcttgtgggccaaggaattaattattncnatcagaaatggaggccttanctcatttnggcaaagattagtgctagttattgnaggtttactaataaatgatctgttaagggatttagtttttnntngatatgttgttttggtgttgaaactaaggtataattataatagtatttcacgagctctgttcggctagccatcaattagaagttagagagtttgtcctaacagntaagctataccctcacattttaaacatgcatagtgacaatgacaaaacaaattcaaattttactaatgtaaagctgtatatgtgattgtcaaacactttttt

SEQ ID NO: 484093 - DNA, 107 bp, Homo sapiens
tttggagatcctgagtcaccctcaagtgaggattactggggcagtgaatcatagaccgggctgtacgataaagcaacgtgttgcagagaccatgtgctatgcctaca

SEQ ID NO: 484094 - DNA, 261 bp, Homo sapiens
agaggactcccgggagccttaaccctgacaacaaagtggtattggagtgttatagggttacagagaataccttcaattatcaattataggtttaaatttaccctggcttttaaaggaatagggcacacttttttttaactacttgtatatttctctgtctttgacattgtctctctctccggtttgcctctggctctcactctttctcttttttttttttctgtctctcgctcttctagcgtcaagggctcccgggtccag

SEQ ID NO: 484095 - DNA, 154 bp, Homo sapiens
gatggccggtccgctacacttcgtccacttatgatcttaagaagtgtttggtcgctcggcgtgtgcagcaacaacttcgtccactgggacatgcaacaacttcgtcactctgatctaatccagaagcagaccgtctgggtcctcggcgtgtgca

SEQ ID NO: 484096 - DNA, 154 bp, Homo sapiens
gttggtaaaatgctattaaatggtattgcatactacagaaaaatctttcttaacagcaagattgatcggttggtaaatgttattttattattaatcattctggagacttaacatagctccccagccttcagcaactactaccttatcagacagc

SEQ ID NO: 484097 - DNA, 599 bp, Homo sapiens
gcatgtgacggctgaaaaaaaaagaagagacctggcaagacgacgcaccatgaatgcgcaatcaccggcgcgcgccgcaggcacgacactgcagcactacacacacaaaaatggcaaacaagcacaaggagaacacacagaacaacaaggaacaaaatcaaaacaacacatgacagataccaactgaacaagagacacctaagaaagcaagaaccaaccggacaaataccagaaccagatcacacactcgacacggcacacaagaataacaagcaaagcaaaaaaccgaataagcgaaaaacagagtaacaacaaaactagaacacaaacagacgaaaaagacctagacgacaactcacacccacacagcgagccccacacagatatataaacacatacactcgaatatatgaagataaatgaatcaggagatgaaaaaactataaaataacagtagacaacaaatgtatctacaccaatgaaagcacatgagactaagaacggcacaatacgctaacaacaacaatcaaattaacctaccccagcgcgtgaagcacgtaccctccgaacaaaagggccctcatatcaacagtagacaa

SEQ ID NO: 484098 - DNA, 153 bp, Homo sapiens
ggataatgcccgcggggccactgtcgccactgccaccacgtctactgccacctccacaaacagcggctccaacatcgcagggcgcatatcagctggttgcagcctgcaggtgctagtgctcccatgcaccaacacctaacgcaggtcttcagc

SEQ ID NO: 484099 - DNA, 319 bp, Homo sapiens
  misc_feature (183)..(183): n is a, c, g, or t
tgtgggatgtggtctcagtggtggcatcgaagaagtgaagctgggagtactgtgtgaggtgctctctgtggtggtgatcacagaagtgaagctcagaggactgtgtgaggtggactccgtggtggtgatcaaagaagtgaagctgggaggactgtgtgagggggtttcggtggtagcgattgnagaagtgaagctgggaggactgtgtgagttggtctcggtggtggagatcgaaaaagtgaaggctggaggactgagtgaggtggtctcggtggtggtcatcaacgaagtgaagctgggagtactactgaggtgtaag

SEQ ID NO: 484100 - DNA, 654 bp, Homo sapiens
taaaagtacgttcggcatttaatttctggcgggcaacactttggcccaccagcaaaaacacagcccgaggaagggacccaataacctttacaaaacgcaaacggctgccggcggtgagggcccagggtcttccagggagaggacaggcatcttcctttcccaccaggaaggattgagcccggagcctctgctatgtgcaaggcggtgtgcaagcaccggttgcagcttttggctctctctctttctcttgggggctgggctgggtgtgcgtccgggtgctacatgcttgggcctgtgaggctgagctagagaaatgtagatgtcagatgtgccagtaccatccgtgcgcctcccaagcatgcccccattcactcacgtcggcatctcgacccgttcaatttacagcacaacgaagaagccaccgctaagcggtggtctggggggaagcccggtaggcagtggctcggaacccgggaacgtgtctcaggcctcgggggggctgggccaggcaggggggtgagctagcctgaaggctgcccgggttctggctgcagcgcactctggtccaaggtcttcattctcctccgggcagagggagcccttggtcgtaagacgagccgctgctggcatgggacgtgatgcgcgtggccaggc

SEQ ID NO: 484101 - DNA, 240 bp, Homo sapiens
agtttagaaggatcccggcagagagacatgcttgttcctctggactggaaagatgaattactctcgggaatcttctctgtcagcctgtacatctaaaggcatgaagcactcaattgggcaattaacattagaggtcgctctctgatggcatctctgagaatactggatagaggactggccagaagtcccttcgcgactaggatcacccccaggtctgcggcagttgttacagcgccagcc

SEQ ID NO: 484102 - DNA, 487 bp, Homo sapiens
  misc_feature (16)..(18): n is a, c, g, or t
  misc_feature (24)..(24): n is a, c, g, or t
  misc_feature (138)..(138): n is a, c, g, or t
  misc_feature (142)..(143): n is a, c, g, or t
  misc_feature (461)..(461): n is a, c, g, or t
  misc_feature (486)..(486): n is a, c, g, or t
gcttcatttacctttnnnctcgcnctcacctctctgttcttacatatcccaaataaaataccagtgcttacatgtgccgtgttggtgtgctgcacccatttactcgtcatttacattaggtatttctcctaatgctancccnnccccatccccccacctcatgacaggccccggtgaatgatgttccccgccgtgtgtccaagtgttctcattgttcaattcccacctatgagtgagaacatgcagtgtttggttttctgtccttgtgatagtttgcttagaatgatggtttccagcttcatccatgtccctacaaaggacatgaactcatcaatttttatggctgcatagtattccgtggtgtatatgtgccacattttcttaatccagtctatccattggatgggacatttggggttggtacatatggtaacaaaccctgcacattgtgcacggtgtancccaggaacttaaagtataataaant

SEQ ID NO: 484103 - DNA, 464 bp, Homo sapiens
agcaggcttcagggacttgagcatctgcagattttggtatctatatgggtaactggaaccaatcccccacagacgctgagggatgactgtaattattttattaaaaagggagaaaaaaactgtattaatataaactagtaattatgagatcagatgccattcttccattgagaataactttttgcaatgaagacagaatctgctttatcttactctgaaatctgttactgctggctggttagggtaatgtgttgaggaatcacaacaaagctcagagatgaagtatgctgtgtggattcaccatgtctataatgggaaaaagaaagtggtggtatctgtgttgagaatatgctaaccttgtttttatagattttcccttaatctcataactatttcctaaaatttactttctgtcatggtgggttcaaatacacaacgtacacaatgacaaaaactcctctgtg

SEQ ID NO: 484104 - DNA, 138 bp, Homo sapiens
ggtacccaagacctgaaactgaagaagaagaaggtctgagaatcactgaggttcttcccacctggcagaagcaggaagcaggaagcggcagaagcaggaagcagaagaagaggtggagacagaggcagaagcaggaag

SEQ ID NO: 484105 - DNA, 237 bp, Homo sapiens
tgctctagaggatccttgaacacaaaagcggacagagcacagcaatgccgggatccgagccgcgccttgaaactacaccacaggtcacggccacgcctggatccttaacccactgagcaaggccagggatcgaacccaccacctcatggttcctaagtcggattcgttaaagcacttgtgccactgacagtgaaccctgtatacacttgtattttaaacacatcctatttccagtta

SEQ ID NO: 484106 - DNA, 111 bp, Homo sapiens
  misc_feature (61)..(61): n is a, c, g, or t
gaggatttggtgtccctttgttaaagaacaaatcttgcttatgtaagtgtgatttgttagnttctaacgtaatttcataatataagagtcacagccagacaaagggaaaca

SEQ ID NO: 484107 - DNA, 1122 bp, Homo sapiens
tgttgctaaagcaagggcaagtgatgtgggtcacactagcgttcctcccagtacagcagccacagagcttcctctgtttagtcagagaacctggtggcagaagcgtattactgtgactgagtctgaggccttggttatgctgtattccttggtctgacactcagagatagtctgtcctctcaaaaaaattccagctcaagaggtggagccagagttcaaaatcgccagccctcttacgctgtcatagctgactgccatgttcaaaacgtggttcctggaaactgacttctttacatcaaccacacctatatgaacagaatcccttcttagctctaagccaagaatcagtaaactgtggcccatgggccaaatctggcctgccacctatgcctgtactgcctgccgatgaagaatggtttttacatttttccatggctgggaagaaaagatgacaaagatagtaagtacactgtatatggcccacgacacctaaaatatttactgtgtcccattacaggacaagtttgcctgctcttataaatcactgaacctggagctgttcacactgaaccgaatctacttagggattggcccctggggacattgtgttgggtgaggcctcccttttcactaatggtgggtctttgatcttacaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgtattttgtggaactgtatctgttgtcatttttaaaaaggggggaaaagataacatccaagtctgattagaactgcccatcagtttttcttgtaaatttttagaagacctcacagaactttacagtttatttttctcggccaacacattaaaaccattcttggatttcaa

SEQ ID NO: 484108 - DNA, 386 bp, Homo sapiens
  misc_feature (386)..(386): n is a, c, g, or t
gttgttgagaaatctgaggcgcgaagcacagacaggcaagcctgtgaccttgaaagacgtgtttggggcctacagcatggatgtgatcactatcacataatttggagtgagacattgactctctcaacaattcacaagacaccctttgtggaaaacaccaagaagcttttaagaattgattttttggatccattctttctctcaataacaggctttccattcctcataccaattcttgagagtattaaatatctgtgtgtttccaagagaagttaccaattttttaagaaaatctgtaaaaaggatgaaaggtcgccttgaagatacacgcaccgagtggatttccttcagctgatgaatgactcttagaattcttatcttttttn

SEQ ID NO: 484109 - DNA, 1951 bp, Homo sapiens
  misc_feature (458)..(458): n is a, c, g, or t
ctgctagcactaatgtatgggttcagtacgtatggcacacagaatggggagtgtgtttgcctacagtgtctctctggatcctctttgtttatattgaagcagccattagatttaaagatctcaaaaactttcatgtagacctttgtcgtccatttgctgctcactgtattgggtaccctgtggtaactttggggtttggcttcaaaagttacgtaagctacaaaatgcggttaaggaagcaaaaagaagtacaaaaagagaacgagttttacatgcaacttcttcaacaagctctccctccagagcaacagatgctacagaagcaagaaaaagaggccgaggaagcagccaaaggattacctgatatggattcttcgatccttatacaccacaatggaggtatcccagccaacaaaaaactctccacaactttgccagagatagaataccgagaaaangggaaagaaaaggacaaggatgccaaaaaacacaaccttggaataaataacaacaatattctacaacctgtagactctaaaatacaagagattgagtatatggaaaaccatatcaatagtaaaagattaaataatgatcttgtgggaagtacagaaaatctcttgaaagaggactcatgcactgcttcctcaaaaaattacaaaaatgccagtggagttgtgaactcttcacctcgaagtcatagcgccacaaatgggagcattccttcctcatctagtaaaaatgagaagaagcagaaatgcactagcaagagcccaagtacacacaaggacttaatggaaaactgtattcctaataaccagctaagcaaaccagacgcactggtcaggctggaacaagacattaaaaagttaaaggctgacctgcaagccagcagacaagtggaacaagagctccgcagtcagatcagctccctttcgagcaccgagcgagggatccgctcagaaatgggccagcttcggcaggagaacgagctgctgcagaacaagttacataatgctgtgcaaatgaagcaaaaagacaagcagaatatcagccagttggagaaaaagctaaaagctgagcaggaagcccgaagttttgtagagaaacagttaatggaagagaaaaagaggaagaagttagaagaagccactgctgcccgggctgttgcgtttgctgctgcatctaggggagaatgcaccgaaaccttacggaatcggatcagagaactagaagcagagggcaagaagctcacgatggacatgaaggtgaaagaagaccaaatcagagaactagaactaaaagtccaggagcttcggaaatataaggaaaatgagaaggacactgaggtgttaatgtcagccctctcagccatgcaagacaaaacacagcacctggagaacagcttaagtgcagagacgagaatcaagctggacctgttctccgcactgggcgatgcaaagcggcagctcgagattgcccaaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgtattttgtggaactgtatctgttgtcatttttaaaaaggggggaaaagataacatccaagtctgattagaactgcccatcagtttttcttgtaaatttttagaagacctcacagaactttacagtttatttttctcggccaacacattaaaaccattcttggatttcaa

SEQ ID NO: 484110 - DNA, 245 bp, Homo sapiens
ggtcttagggagaacacagctcaaaggtggcatgggggcccaggggcacaggcatgtggaccttgtgaaagagacgacccggaagatgcttccagctgtggaagtgatttcacttttcccacttgaccagttgtccgctaaagcttcagtgctttactaggcattagatcactaaaatgcctattcgttcttgaacaggggtactttactgtttcccagattccttaattttacagcctttatta

SEQ ID NO: 484111 - DNA, 1772 bp, Homo sapiens
  misc_feature (279)..(279): n is a, c, g, or t
ctgctagcactaatgtatgggttcagtacgtatggcacacagaatggggagtgtgtttgcctacagtgtctctctggatcctctttgtttatattgaagcagccattagatttaaagatctcaaaaactttcatgtagacctttgtcgtccatttgctgctcactgcagccaaaggattacctgatatggattcttcgatccttatacaccacaatggaggtatcccagccaacaaaaaactctccacaactttgccagagatagaataccgagaaaangggaaagaaaaggacaaggatgccaaaaaacacaaccttggaataaataacaacaatattctacaacctgtagactctaaaatacaagagattgagtatatggaaaaccatatcaatagtaaaagattaaataatgatcttgtgggaagtacagaaaatctcttgaaagaggactcatgcactgcttcctcaaaaaattacaaaaatgccagtggagttgtgaactcttcacctcgaagtcatagcgccacaaatgggagcattccttcctcatctagtaaaaatgagaagaagcagaaatgcactagcaagagcccaagtacacacaaggacttaatggaaaactgtattcctaataaccagctaagcaaaccagacgcactggtcaggctggaacaagacattaaaaagttaaaggctgacctgcaagccagcagacaagtggaacaagagctccgcagtcagatcagctccctttcgagcaccgagcgagggatccgctcagaaatgggccagcttcggcaggagaacgagctgctgcagaacaagttacataatgctgtgcaaatgaagcaaaaagacaagcagaatatcagccagttggagaaaaagctaaaagctgagcaggaagcccgaagttttgtagagaaacagttaatggaagagaaaaagaggaagaagttagaagaagccactgctgcccgggctgttgcgtttgctgctgcatctaggggagaatgcaccgaaaccttacggaatcggatcagagaactagaagcagagggcaagaagctcacgatggacatgaaggtgaaagaagaccaaatcagagaactagaactaaaagtccaggagcttcggaaatataaggaaaatgagaaggacactgaggtgttaatgtcagccctctcagccatgcaagacaaaacacagcacctggagaacagcttaagtgcagagacgagaatcaagctggacctgttctccgcactgggcgatgcaaagcggcagctcgagattgcccaaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgtattttgtggaactgtatctgttgtcatttttaaaaaggggggaaaagataacatccaagtctgattagaactgcccatcagtttttcttgtaaatttttagaagacctcacagaactttacagtttatttttctcggccaacacattaaaaccattcttggatttcaa

SEQ ID NO: 484112 - DNA, 483 bp, Homo sapiens
  misc_feature (41)..(41): n is a, c, g, or t
  misc_feature (43)..(43): n is a, c, g, or t
  misc_feature (330)..(330): n is a, c, g, or t
  misc_feature (394)..(394): n is a, c, g, or t
  misc_feature (412)..(412): n is a, c, g, or t
  misc_feature (466)..(466): n is a, c, g, or t
  misc_feature (471)..(471): n is a, c, g, or t
ggatgggggagggatggtttcggcacgaagctattcaaccnangatcatgaggcattagattcatcaggcattagattctcataaggagtgcacaacctagatccctcgcatgtgcagttcacaacagggttcgcactcccatgagactctaatgctgctgctgacctgacgggaggcagagctcaggcagtaatgcaagctctggggagcagctgtaaatacagatgaagctgtgctcacttcacccaccgcttcaccccctggctgtgtggcctggttcctaaccagtgccatggactggtactggtctgtggcctgggggtgggganccctgttttaagcagttttaagaattattcttttttagaatatctacctctactgggataagancatgtttctttactgtgnaggcacacagtaggtgctcagtaaatgcttgttgcaaggaatgaattgaccggncgggngccggttggttt

SEQ ID NO: 484113 - DNA, 1864 bp, Homo sapiens
  misc_feature (75)..(75): n is a, c, g, or t
  misc_feature (371)..(371): n is a, c, g, or t
ttccataaatggatggatgattttcctaaatgtagagtttccccaaatgtatttggattttccttcctatttttnccctacatccttcctagtaaacctatgaggatttgccttccttgattagccgtataatgagtgtgcaaactaatgtgaatttcttaagtgtagataatagtttgttgaattaatctgtgttgttaaacaactaaatattccggtgggggctttttgtttgttggtttgtttttggtattgtagcagccaaaggattacctgatatggattcttcgatccttatacaccacaatggaggtatcccagccaacaaaaaactctccacaactttgccagagatagaataccgagaaaangggaaagaaaaggacaaggatgccaaaaaacacaaccttggaataaataacaacaatattctacaacctgtagactctaaaatacaagagattgagtatatggaaaaccatatcaatagtaaaagattaaataatgatcttgtgggaagtacagaaaatctcttgaaagaggactcatgcactgcttcctcaaaaaattacaaaaatgccagtggagttgtgaactcttcacctcgaagtcatagcgccacaaatgggagcattccttcctcatctagtaaaaatgagaagaagcagaaatgcactagcaagagcccaagtacacacaaggacttaatggaaaactgtattcctaataaccagctaagcaaaccagacgcactggtcaggctggaacaagacattaaaaagttaaaggctgacctgcaagccagcagacaagtggaacaagagctccgcagtcagatcagctccctttcgagcaccgagcgagggatccgctcagaaatgggccagcttcggcaggagaacgagctgctgcagaacaagttacataatgctgtgcaaatgaagcaaaaagacaagcagaatatcagccagttggagaaaaagctaaaagctgagcaggaagcccgaagttttgtagagaaacagttaatggaagagaaaaagaggaagaagttagaagaagccactgctgcccgggctgttgcgtttgctgctgcatctaggggagaatgcaccgaaaccttacggaatcggatcagagaactagaagcagagggcaagaagctcacgatggacatgaaggtgaaagaagaccaaatcagagaactagaactaaaagtccaggagcttcggaaatataaggaaaatgagaaggacactgaggtgttaatgtcagccctctcagccatgcaagacaaaacacagcacctggagaacagcttaagtgcagagacgagaatcaagctggacctgttctccgcactgggcgatgcaaagcggcagctcgagattgcccaaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgtattttgtggaactgtatctgttgtcatttttaaaaaggggggaaaagataacatccaagtctgattagaactgcccatcagtttttcttgtaaatttttagaagacctcacagaactttacagtttatttttctcggccaacacattaaaaccattcttggatttcaa

SEQ ID NO: 484114 - DNA, 341 bp, Homo sapiens
ggtatatgaaggtgaacgactcttggtgactaggggagcttcttatgtttgcgaggttagaatgggagacccgccgctttggtggtggagatggtgatgctctatcgtctaggagagtttaggaggtgaagccgttcttctctttggaggtggagaaggagagtatctcctctgtattggaggagagtatcttctaggagaaggtgagcgccgacgtgggggaggagaaggagtccttcgtcgtttttttggtgtgggagtcctgcgccgtcgagaagagaggggcgggagaaggagaccgtcgccttctggctgggtggtgaggatggacttctcctccg

SEQ ID NO: 484115 - DNA, 1268 bp, Homo sapiens
ctgctagcactaatgtatgggttcagtacgtatggcacacagaatggggagtgtgtttgcctacagtgtctctctggatcctctttgtttatattgaagcagccattagatttaaagatctcaaaaactttcatgtagacctttgtcgtccatttgctgctcactctggaacaagacattaaaaagttaaaggctgacctgcaagccagcagacaagtggaacaagagctccgcagtcagatcagctccctttcgagcaccgagcgagggatccgctcagaaatgggccagcttcggcaggagaacgagctgctgcagaacaagttacataatgctgtgcaaatgaagcaaaaagacaagcagaatatcagccagttggagaaaaagctaaaagctgagcaggaagcccgaagttttgtagagaaacagttaatggaagagaaaaagaggaagaagttagaagaagccactgctgcccgggctgttgcgtttgctgctgcatctaggggagaatgcaccgaaaccttacggaatcggatcagagaactagaagcagagggcaagaagctcacgatggacatgaaggtgaaagaagaccaaatcagagaactagaactaaaagtccaggagcttcggaaatataaggaaaatgagaaggacactgaggtgttaatgtcagccctctcagccatgcaagacaaaacacagcacctggagaacagcttaagtgcagagacgagaatcaagctggacctgttctccgcactgggcgatgcaaagcggcagctcgagattgcccaaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgtattttgtggaactgtatctgttgtcatttttaaaaaggggggaaaagataacatccaagtctgattagaactgcccatcagtttttcttgtaaatttttagaagacctcacagaactttacagtttatttttctcggccaacacattaaaaccattcttggatttcaa

SEQ ID NO: 484116 - DNA, 377 bp, Homo sapiens
ggtccttcatcatggcagccctcaggaatggatacaggcccttccctgcctgcctggtggagcagcctccaaggggagcctttgctagcaggaaaaggcattgcatggagctcagacccgcctcagaggaacttttttcagcctcctctttccgcccacccggccaaaatacaagcaagggaacgtgtggcattcgggcttccatgagctgaagacaaagcctacatggggaaaagtgcaaaacccggagaatgggagaaaaatggagccccgccctgatgctgttgtgaaacatttcaatcaaactgcccctgaaggccgccctatccctgcatttttcatttacatgagccaataaactttttccttttagtcca

SEQ ID NO: 484117 - DNA, 2029 bp, Homo sapiens
  misc_feature (458)..(458): n is a, c, g, or t
  misc_feature (1993)..(1993): n is a, c, g, or t
ctgctagcactaatgtatgggttcagtacgtatggcacacagaatggggagtgtgtttgcctacagtgtctctctggatcctctttgtttatattgaagcagccattagatttaaagatctcaaaaactttcatgtagacctttgtcgtccatttgctgctcactgtattgggtaccctgtggtaactttggggtttggcttcaaaagttacgtaagctacaaaatgcggttaaggaagcaaaaagaagtacaaaaagagaacgagttttacatgcaacttcttcaacaagctctccctccagagcaacagatgctacagaagcaagaaaaagaggccgaggaagcagccaaaggattacctgatatggattcttcgatccttatacaccacaatggaggtatcccagccaacaaaaaactctccacaactttgccagagatagaataccgagaaaangggaaagaaaaggacaaggatgccaaaaaacacaaccttggaataaataacaacaatattctacaacctgtagactctaaaatacaagagattgagtatatggaaaaccatatcaatagtaaaagattaaataatgatcttgtgggaagtacagaaaatctcttgaaagaggactcatgcactgcttcctcaaaaaattacaaaaatgccagtggagttgtgaactcttcacctcgaagtcatagcgccacaaatgggagcattccttcctcatctagtaaaaatgagaagaagcagaaatgcactagcaagagcccaagtacacacaaggacttaatggaaaactgtattcctaataaccagctaagcaaaccagacgcactggtcaggctggaacaagacattaaaaagttaaaggctgacctgcaagccagcagacaagtggaacaagagctccgcagtcagatcagctccctttcgagcaccgagcgagggatccgctcagaaatgggccagcttcggcaggagaacgagctgctgcagaacaagttacataatgctgtgcaaatgaagcaaaaagacaagcagaatatcagccagttggagaaaaagctaaaagctgagcaggaagcccgaagttttgtagagaaacagttaatggaagagaaaaagaggaagaagttagaagaagccactgctgcccgggctgttgcgtttgctgctgcatctaggggagaatgcaccgaaaccttacggaatcggatcagagaactagaagcagagggcaagaagctcacgatggacatgaaggtgaaagaagaccaaatcagagaactagaactaaaagtccaggagcttcggaaatataaggaaaatgagaaggacactgaggtgttaatgtcagccctctcagccatgcaagacaaaacacagcacctggagaacagcttaagtgcagagacgagaatcaagctggacctgttctccgcactgggcgatgcaaagcggcagctcgagattgcccaaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgtattttgtggaactgtatctgttgtcatttttaaaaaggggggaaaagataacatccaagtctgattagaactgcccatcagtttttcttgtaaatttttagaagacctcacagaactttacagtttatttttctcggccaacacattaaaaccattcttggatttcaagtagccaactttgccttttatgtattcttacatagtttcctnttgaagaaaaaaaaagcagagtttttgtttttcaaa

SEQ ID NO: 484118 - DNA, 491 bp, Homo sapiens
  misc_feature (412)..(412): n is a, c, g, or t
gcacgagtaccagtcctttacaaactctttggaaaagtaggagggcatacttaactcattctataaggccagtattatgctgataccaaaactagacaaagacatgacaagaaaggaaaattacaggccattatcatgaatatagaaacaagaatcttcaaccaaatgctagccagttgaatccagcaacaacgtataaaaaggattatacaggccgggagtggtggctcacacctgtaatcccagcactttcggaggccgaggcgggtggatcacgaagtcaggagatggagaccagcctggccaacatggtgaaaccccatctctactagagatgcaaaaattggctgggtgtggtggcatgcgcctatggtcccagctgctcgggaggctgaggcaggggaagtgctanaacccaggaggcggtgttggcagtgagccgagatcacgccactgcactccagcctgggtgacagagagagactgtctca

SEQ ID NO: 484119 - DNA, 2014 bp, Homo sapiens
  misc_feature (458)..(458): n is a, c, g, or t
  misc_feature (1317)..(1317): n is a, c, g, or t
ctgctagcactaatgtatgggttcagtacgtatggcacacagaatggggagtgtgtttgcctacagtgtctctctggatcctctttgtttatattgaagcagccattagatttaaagatctcaaaaactttcatgtagacctttgtcgtccatttgctgctcactgtattgggtaccctgtggtaactttggggtttggcttcaaaagttacgtaagctacaaaatgcggttaaggaagcaaaaagaagtacaaaaagagaacgagttttacatgcaacttcttcaacaagctctccctccagagcaacagatgctacagaagcaagaaaaagaggccgaggaagcagccaaaggattacctgatatggattcttcgatccttatacaccacaatggaggtatcccagccaacaaaaaactctccacaactttgccagagatagaataccgagaaaangggaaagaaaaggacaaggatgccaaaaaacacaaccttggaataaataacaacaatattctacaacctgtagactctaaaatacaagagattgagtatatggaaaaccatatcaatagtaaaagattaaataatgatcttgtgggaagtacagaaaatctcttgaaagaggactcatgcactgcttcctcaaaaaattacaaaaatgccagtggagttgtgaactcttcacctcgaagtcatagcgccacaaatgggagcattccttcctcatctagtaaaaatgagaagaagcagaaatgcactagcaagagcccaagtacacacaaggacttaatggaaaactgtattcctaataaccagctaagcaaaccagacgcactggtcaggctggaacaagacattaaaaagttaaaggctgacctgcaagccagcagacaagtggaacaagagctccgcagtcagatcagctccctttcgagcaccgagcgagggatccgctcagaaatgggccagcttcggcaggagaacgagctgctgcagaacaagttacataatgctgtgcaaatgaagcaaaaagacaagcagaatatcagccagttggagaaaaagctaaaagctgagcaggaagcccgaagttttgtagagaaacagttaatggaagagaaaaagaggaagaagttagaagaagccactgctgcccgggctgttgcgtttgctgctgcatctaggggagaatgcaccgaaaccttacggaatcggatcagagaactagaagcagagggcaagaagctcacgatggacatgaaggtgaaagaagaccaaatcagagaactagaactaaaagtccaggctaatntatagacatcgatgccaaaactaccttgtagcattggctgttgatgatatggataggagcttcggaaatataaggaaaatgagaaggacactgaggtgttaatgtcagccctctcagccatgcaagacaaaacacagcacctggagaacagcttaagtgcagagacgagaatcaagctggacctgttctccgcactgggcgatgcaaagcggcagctcgagattgcccaaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgtattttgtggaactgtatctgttgtcatttttaaaaaggggggaaaagataacatccaagtctgattagaactgcccatcagtttttcttgtaaatttttagaagacctcacagaactttacagtttatttttctcggccaacacattaaaaccattcttggatttcaa

SEQ ID NO: 484120 - DNA, 2355 bp, Homo sapiens
  misc_feature (458)..(458): n is a, c, g, or t
ctgctagcactaatgtatgggttcagtacgtatggcacacagaatggggagtgtgtttgcctacagtgtctctctggatcctctttgtttatattgaagcagccattagatttaaagatctcaaaaactttcatgtagacctttgtcgtccatttgctgctcactgtattgggtaccctgtggtaactttggggtttggcttcaaaagttacgtaagctacaaaatgcggttaaggaagcaaaaagaagtacaaaaagagaacgagttttacatgcaacttcttcaacaagctctccctccagagcaacagatgctacagaagcaagaaaaagaggccgaggaagcagccaaaggattacctgatatggattcttcgatccttatacaccacaatggaggtatcccagccaacaaaaaactctccacaactttgccagagatagaataccgagaaaangggaaagaaaaggacaaggatgccaaaaaacacaaccttggaataaataacaacaatattctacaacctgtagactctaaaatacaagagattgagtatatggaaaaccatatcaatagtaaaagattaaataatgatcttgtgggaagtacagaaaatctcttgaaagaggactcatgcactgcttcctcaaaaaattacaaaaatgccagtggagttgtgaactcttcacctcgaagtcatagcgccacaaatgggagcattccttcctcatctagtaaaaatgagaagaagcagaaatgcactagcaagagcccaagtacacacaaggacttaatggaaaactgtattcctaataaccagctaagcaaaccagacgcactggtcaggctggaacaagacattaaaaagttaaaggctgacctgcaagccagcagacaagtggaacaagagctccgcagtcagatcagctccctttcgagcaccgagcgagggatccgctcagaaatgggccagcttcggcaggagaacgagctgctgcagaacaagttacataatgctgtgcaaatgaagcaaaaagacaagcagaatatcagccagttggagaaaaagctaaaagctgagcaggaagcccgaagttttgtagagaaacagttaatggaagagaaaaagaggaagaagttagaagaagccactgctgcccgggctgttgcgtttgctgctgcatctaggggagaatgcaccgaaaccttacggaatcggatcagagaactagaagcagagggcaagaagctcacgatggacatgaaggtgaaagaagaccaaatcagagaactagaactaaaagtcccagccctctcagccatgcaagacaaaacacagcacctggagaacagcttaagtgcagagacgagaatcaagctggacctgttctccgcactgggcgatgcaaagcggcagctcgagattgcccaaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgtattttgtggaactgtatctgttgtcatttttaaaaaggggggaaaagataacatccaagtctgattagaactgcccatcagtttttcttgtaaatttttagaagacctcacagaactttacagtttatttttctcggccaacacattaaaaccattcttggatttcaagaaaaaaaaaaaaaaactctatctattatcaccactatctaataaatacccactcctatcaaacagaacctctaattatcctcgggggatttacacaaaaaaactatatggcgatatgtgcaaatcgccataagggggcttataaaattcgggcggggttacaacaggggttggtaaaccctgggcacactaatatagggtggaaacaacccctttcgcggggggaatataagaaagctcccatgtgtctttcaaaaatggccccttagtgggaggaatatgcgggatatttttgaaatatcgcaaattgtgtaaaaacttttttcaacaagggggaggtgcaacctttataaaatactaccgtaggggggcgttctctttacacaggcctcttggggctctcccaggggaacctctttgggggccctgtgaccccacactttggggtggagtac

SEQ ID NO: 484121 - DNA, 375 bp, Homo sapiens
gggacatacacacccatgggaaatgagatgaaaaaaagcagtaatatgaggaagtagatagagtatttagaaaaagaaatacacagggccaagcacagtggctcacgtctgtaatccccagcactttgagaggcccaaggtgaggggattgcttgggctcaggagtttgaggccagcctaggcaatgtagtgagaccccacctctacaaaagattaaaaacttagttgggcttggtagtatgtacctgtagtttaagaaacttgggaggctgagctgaggcaggaggattgtttgagcccgggtggtcagggctgcagtgggccatgattgtgccagagtactccagcctgggtgatagagtgagactctgtctc

SEQ ID NO: 484122 - DNA, 401 bp, Homo sapiens
  misc_feature (219)..(219): n is a, c, g, or t
tgctcctgctggcactttgcttttgtggccttggcatttagggcacaggctggacacaggaatgggggggcctccaaagggtctttccgtcctcatgctcctcagtgtccacacttcaaggccaaggatagttttttcctttgacatgggggccataacaggtgatcccttatacctggcaaagaatgggggcctctccctttttaggtcctcaatccngcctgacttttggtccttttggcagggacctgggtggggaacgttttggtgctgatggtgctgggacctatatgtatatttatataaatttggggttttgtttaccccctcccctggtcaaagcctgagtgggtgctgggtgctgtgttttgtctgtaaataaactcctttcatgcctttta

SEQ ID NO: 484123 - DNA, 361 bp, Homo sapiens
  misc_feature (135)..(135): n is a, c, g, or t
  misc_feature (360)..(361): n is a, c, g, or t
attaaattccaagccaattttccttgttccgagttccaaaaacgggtccataaagccagccagagataaccttgccaaccatccaacaatgccatttggcccccggaactgcctaatgaacatacagtgcagtgncttgttcaagaagttttgcaaaggagaagaggaagatgaggagtgtagtgaccagccattagaagttgacaacaaccaagtgggagcaatcatcaaagctcatccttttacaactacacgagaaggtgccgaagagctcaccattgaccattctatggtcatttggcatttgaagcaaactggaaaggtgaaaaagctcgataagtggatgcctcatgagctgann

SEQ ID NO: 484124 - DNA, 938 bp, Homo sapiens
tatcttgtgggtgtgagagagtaggagcgtgtggacgagagagcgggagaaagggtctaccggtgtctgccgcggaggggttcgtgttttagagcgcccgctggtgttgggccctttgagttgctatcgctgggaccttgtagtgtccagaactgtcccatggcaggggttcggatctttccttgggctgcagccctctgagaagggttttaccagccccagggtcccgtccagtggttcagcatcggagacagcccgattagggtcacacgctagattcgccgggagtgccactggggcttgaaggattctacattctctggccgaagattccggatccccgcagagttaccgagaatcgaccttgaccggtctggtaccctgaattcctatgcaatgcggaaggccttagaagaagccggtttccagatgccctgtccactccccccagtcatcgttgctcggtttgcacgatgacccgctcatcactcgattttgataagtttgttcggtgtttggttcggctggaaacgctattccagatatttaagcacgctggatcccgagaatactgggacacatagagctcgacccttatgctgctcttgttttcccacccaccctattctccagtcccaaatgcacgcctggctccctctttctcatgagctttgacttgagtgtagctcacaggttaaaactaaggagtggctgcacggatcactgcttagtaaaatgaactcctgattagccaaagcaccagggagaacctgtttatataaaggaaatccttcagctgtaaattccagattgggttttgggaagatccctcattcttagaatggatctaccttcaaatactttaacccaattaattttctctactccctcccccttttaaattaaacccatactagtaaacaaaaattaaaaaaaaa

SEQ ID NO: 484125 - DNA, 157 bp, Homo sapiens
actctgaggatcccccacattactagtacgccatacatgtgaaccactatcacgaaaaaaactctacctctctatctaatctccctacaatctccttattatacattcacagctacatacctgtcatattttatatcttcttcgaaaccacacttat

SEQ ID NO: 484126 - DNA, 290 bp, Homo sapiens
cctatctgcaccacaggtctgcccgtgtcacggcgcgtgccggctctcagcgtgcctttgctcctcttctgactcctgccaggcaccctaagtgctcagttttgctactcaccccttcggcctggctgagctctgctgctggcctggcgactactggttcatctgaactgcttcctcttgccctgtctactgctgtctgccaggtctgtgctgccttgggatggaataaacattctcaggcctgtttgttctgcctgtcttctatctttgtggacctggtttgcattcgg

SEQ ID NO: 484127 - DNA, 792 bp, Homo sapiens
agacagcactgctggagtgaaggagtagctcgaggtgaagctggatgggggatccagtggagcaggagttgacggacagtccgttcacatcgctgtgtttccttgtaaacatttttctttctgcagagaggaagatatgtttgtgctcgcggtttatataaagacactggtttttatttaagtgtattttaaagaatctagtcatttacccttgtgtggagtatacagattgccatcttgctctttaggcaagaactataggaaccaattaagcaaagcaaccacaagaaagggagaagaggtgcctgtgggagattttgcacgacctattgtgggtataggtattttcgttcctgggggaagaaattcagtctaccctgtctcagctgtactttagttgggcctgtcatcttgatgaccagaatgaaagcttgctctgcctcctgccagccagaattggtggcgggacttggggatacgagcgtgaaggtggggaagttgcacagcagaaaacagaattgaagttgggaaactctagagtctgggcaaaatgttaggttaggtctcttagcaagaaattaacatcccattaccgacaagaaaaggtgaaggtggcacctttattggaatagttggagatgatgataatcctaattatttaagagtatatatataaacggcatatatatagcggagttctaaagattggcgactccggggtgttgtgactgtacttaggaccttgtcgttctcctgcatccaggtggcctgcttcaatctcctaattaaagg

SEQ ID NO: 484128 - DNA, 597 bp, Homo sapiens
tgcgagaaccctcactatgattagtacagtataggaaaactggcacaatgatccaatcacctcccaccaggtccctccctccacatgtggggattacaattagggatgagatttgggtggggacacagagccaaaccatataattccaccccgatgcctcctaaatctcatatccttttcacatttcaaaaccaatcatgactcctcaacagtcccccaaagtcttaactcattccagcattaactcaaaagaccacagtctaaagtcttttctgagacaaagtcccttccacctatgagcttgtaaaataaaaaacaagttagttacttccaagatacaatggtggtacaggcattgggtaaacgttcctgttccaaacgggtgaaatggggcgaaacaaaatggccacaggccctatgcaagtctgaaactcagccaagcaatcattaagtcttaaagctccaaaatctcctttgacttcatgtctcacatcacattcagagcatgctgatgcaaggggtgtgctcccacagaccttggcagctgcattcccgaggctatgcagggtacagccctcgcagctgcttcatgcgctg

SEQ ID NO: 484129 - DNA, 466 bp, Homo sapiens
gggacccatgtttgaaggcagtgagaacaaagtcataatgttgagaatctctgggacacagctaaagcagtgtttagagaaaaatttatagcactaaatgcccacaggaggaagcgggaaagatctaaaattgacaccctaacattacaattacaggacctagagaagtaagagcaaacaacttcgaaagcgggaaatatctaaaattgacacctaacgttacaattacaagacctagagaagtaagagcaaacaacttcaaaagctagcagatgacaaaaaataactaagatcagagcagaactgtgaaggagatagagacatcaaaaacccttcaaaaaatcaatgaatccaggagctggttttttggaaagattaacaaaatagactgctatccagactaataaagaagaaaagagagaagaatcaaatagacacaataaaaaaatgataaaggtgatatcac

SEQ ID NO: 484130 - DNA, 1394 bp, Homo sapiens
  misc_feature (911)..(911): n is a, c, g, or t
tctttaaaaaaccccccattttagggggtccaaattttttcacaactggaaattagtggtccccaaagatctggtgtcttaatgtgtgtccacaatctataccaaaatgtatgattacaaaatctccccaggcaggcacaggcaggggacaagggcccaccgttctcccaacgtctctgggtggtgcgtcggtgtgtcctctgccgaacccccgagttcacccacgcggtgcccacctgtgtgtgctcccccttcaacaccctgtgggggttgagaggaggcgccatgtgccccccaagcgagagggaacaaatataacaaaacagatatttttaaaacagagtaagagagctcttacacgagggcgagagagctgtgttcccatatacacatattgaggacagagtgtgtgtcatacacttttgtgtgcgtgggggtactcaactctatcccactctcactctaactattctccacagaaagtgtgttcacagcgtgtgtgagagtcctcccccaaaaagagtgtgtctctttctacactcctcctcacgccataaaaaaagaagagacaccccccgtttttgtctcacacacctttttttattagcagaacacatttatgagcgcccccccccaagaatattatcatcccgcccgaagagaagaagaagctgtggcttttcttctcggagaaaagaaccttcttataacaacagagacgtgcggcgtggggggtcttcctacgcacacgcacacggagtgtggctggcgtgacgagcgacccgcgggggggagagacacaccccctctccgggggggggggcccccccgaaggggtgtgttcctcccccgggctcccactcctcccggggggtgtcatcaacttctacttatacagcgcttgtggtggnccaagagacgaccgctgattttgtgtcctcccccccggtggttggtgtggaccccccccccgcagaaaggaggatgttcgttgttgggctcggcgtcccccctcaacgtcgctgttgttgttgaacgacgacggtgccggacggggtgttggtgcgtcttctctctcttgagggcggccacccccctcctttgttgtggcggcctccccttggatgggggggcactgttgttgttactcacacccctccttcttctggttggagaagaaggcggccggccggtgttcccccccgttgttggtgggcccccccccggcgtggggccaccactatttatggtggttcttccacttgttctgctaccacgaaacccccccgtcgttgggtgttgtgtcttccccccacccccgccgagcgatccgctgttggtgtcttgtttggtgtatgcgccataaccccccgctgtgtggtggccccgcgtct

SEQ ID NO: 484131 - DNA, 332 bp, Homo sapiens
cttttggtgtctttgctgatgagggtttcgccacgttggccaggctggtctcaaactcctgacctcaggtgatccacctgcctcggcttcccaagtagctgagattacaggcatgagccactgcgcctggctaactttttttttttttttttgaaaaaaaagttttcttttgcccccaagcttggagggggggggagaaattttgtttaattgaaacctcggcttccagggttggggggattttccggctttaccctccaaagaagcgggaataaaggggccccaccaccacacccggttatggttggttttttaagcaaaaacccaaaagg

SEQ ID NO: 484132 - DNA, 693 bp, Homo sapiens
  misc_feature (161)..(161): n is a, c, g, or t
  misc_feature (291)..(292): n is a, c, g, or t
  misc_feature (571)..(571): n is a, c, g, or t
cgcaaacggggggcggttggggacggccaacaccacccaggacatgtaccttgccatcaactgataacacctgatgcccggtgttcattaagactgccgaaaacagagtctcagagactgcacaaaattctcgatctatgatcactgtgcagaatgggctnggcttaacggagcctgcatgcacatgttcattaccaggatcacgaccgaaggggatgacttgacacgcaataagggcacaatctgtgccgtccatatactgcgacacatatgagagaacaacttcatgcnntgatctgccattacgatcagtatgctctaccgactactgagtgcctgaatcggcaccatcgtcgatgacggcaaacctcatgatggcatgactcataatgtagtcaaactctgtgagctctttgatcggcatagcagatacactaaactcatgtcaatgcctcaagagatcaagggagcgccggcagaacatagttgctacatgcataatagaatataacgtcctgtgcaagagactacttatgcttgcaactgaaacttatttgcttccctgcctagnattgcggaaggtgacttatgacttaagagctaacactatctttccgtgggcaggcaccatcccatttagctctagagatactcgtaggggccggccccaacccaattatgccttctggtctt

SEQ ID NO: 484133 - DNA, 231 bp, Homo sapiens
gaataggaacagctccggtctacagctcccagcgtgagcaccgcagaagacgggtgatttctgcatttccatctgcagaggcagaatgtctttgcccaaatctttccttcactcttcactgaagtcttctccaactatttcctgtaaatcctcttcggaggctcaaggagaaggttgtaaccatccgtaggtggttaaaaagcctggcctcagggtctccacctctcctat

SEQ ID NO: 484134 - DNA, 329 bp, Homo sapiens
ccatatctctttcatatattttttttttttaagagggagttttactctgtcgccaaggctagactccaggggctcaatccgggctcactgcaaattccacctcccggcttcaagcgattttaaggcctcagcctcttgagtggctggttttccgggctcacaccaccaagcccgctatttttttttttttaatgagaacaaggcttaccccatttgggccagaagggccccttcccccggccctgggaaactgccccctttggcttcccagggggcggggatttcggggttggacccccaattcgggccccaagttaacttttttaaca

SEQ ID NO: 484135 - DNA, 167 bp, Homo sapiens
agcggggcgtcagctccgcagcccgcgcccagcacatccccctttcgcaacgcgtgcgccgcccggagcaaagtgcggcttaactttgaggctggccttgacgcgctgtcccttgccaataaatgcagatcatcaggaggaacgcaggaggaaggagacagttaaac

SEQ ID NO: 484136 - DNA, 714 bp, Homo sapiens
  misc_feature (120)..(120): n is a, c, g, or t
tgagcccaccacgtctattataaaggagaaaattttgctatgcaactctttgggggacgaacaaacctcctgataacacaagagtagggagagagaaggtggtttccccccccctccggngtgcactttatcccaccgcgctgttattttttggtcggagggcgacgacaatttaatgggttctcccccccattggccccggcacacttgttggcgagaagtcctatggattgtttaattgctgtggacccccgctgtggcgcgccccccctttggaaaaggtttttgtccgtgtgagaagtagcgcgaccctgctgtattggtacgcccaccccagggagatatagagagggttagaagagagtgtctctctcggtataaaacagagaagagggcgccccttacaagagggtctcccctgagacacattgctaattaatcttgtgcgagatacacgcgagatgataggcgcgttaatacattctctcgaaacccactgtctgtacaggtctatatattcaggccccttcatctaaaacgggcgccaatcaatgcgtgccgcagaccggtttgcaaaaaaagaggtaggtggggcgacttccatcaccagcggccaaaaacgctgctcaccgcggagaaaaaaagcggcaccaccgccaaggcttgcacccaacagacaccaggagcacaggcggtccccgccctgtcgaagaa

SEQ ID NO: 484137 - DNA, 128 bp, Homo sapiens
gcttcgcacattgttttgcacagcgttcatcaggcagctgtttccttggcagggccagccgtggcaggcacagcccacagccatgtggtttgcgcacgcagctgcttgcgccacagcaggtgggcatc

SEQ ID NO: 484138 - DNA, 485 bp, Homo sapiens
  misc_feature (403)..(403): n is a, c, g, or t
tgtgatctggctcagctattcacaccgagtgtgacacctgttcctcctcctctcggtgtagaatagctgagccaggactcagagtgaccgagtgtgacgccctgtcctcctcctctcggtgtgaatagctgagccaggactcagagtgaccgagtgtgacgccctgtcctcctcctctcggtgtgaatagctgagccaggactcagagtgaccgagtgtgacgccctgtcctcctcctctcggtgtgaatagctgagccaggactcagagtgcccgagtgtgataccgtttctgtcttcctcctctcagtgccatggcttggggtggatactgcttcacactccttcagggtggcccagacacagtaggtttcatttacctttttttttttcttttctctggnggctgctgctgttgctcttcaacatgtggttcctcctggcccacttgcatcttctcttcctccttagcattctgatctgttt

SEQ ID NO: 484139 - DNA, 190 bp, Homo sapiens
gccttaataggttccaccgcgttgcggccgccgttgctgggtctcctaggatcggcagtcgagtccagtgactcccaccgcacccccagtaagtcacacggccggccggcgaccgcgggccaggcgagggggtctggcgagggcccctggagaacggtggcatttcctcgcagggcggtggaaacgctct

SEQ ID NO: 484140 - DNA, 121 bp, Homo sapiens
gggcatactgcaccagacttcagataggctctcaaatggttggcaagagtgatgctgatgtgaaggtatggaacatttatggtgtattggcaacagggcaggcacggtcataaatacttaa

SEQ ID NO: 484141 - DNA, 934 bp, Homo sapiens
gtactctcgatgttgaatgggagccagctgattaggagagttaatgagagctacaatagacttgttttaaaagaataggacaaggcaaacactaactcgacaagtattcaacaagaatgtccttagataaccttagaatatatcactttatacagcattgtattttaagatacaaaaattggagatagttctcaagcatctttccagtcctgcttgtgaatcttagcccaagataggttcaataatggattttaagtcctcctaggcgttggagtgcaacttaacaaaccagcccaatccaggacttggtatcagctagagaagaaaactagggaaagctgctggttttataaccattaatggtctgctacttttaactttgatttttcgatggattgtttaagaagtaatttcaagtgtagtgagacaatttaggcaaatcataacatattttgatcagagactgtgcacaaagggcactttataggtagcttcattctccacaggttctatacataagatcatgaggtgttacgagaatatggtccaggaatccgcacagtgtggaatttacgatcacctaaagcaatatgactttaagaaaatctgttacctcccatcatcttcctttcccattctgttaacattggtggtgatcagatcacatgagtgccttgatagatactttctatcatagagctgcttggtagaatctcctagtcgggtaccagaaatacttatggccctaaggaattgctttggcaatttcgacacccaatacctttgagcttcatcgccaagaggacctcaacgaacttcaggcttactcgcgctgccacggcaacaacttgcccaagctaacctaaccctgtgccgacgacgccaagacactcggagcacaccttcgaaccacagcccgccccactttctcctg

SEQ ID NO: 484142 - DNA, 518 bp, Homo sapiens
  misc_feature (102)..(102): n is a, c, g, or t
cgttatctgattgtgtctacaatggtgctggttccctatgcccctcccctcttcaactgtggtctacattgcatgtgtgaggaggggagattcagtgtggtngggggacttgagtgtggctagtgactccccatgcagtgaggtgtctctctcttcctcttgtgctcttgcttgtggctggttgtgtccagtggtcttactccttggagggcatgtgggccatgaggtccagcaccctgttgctgtagccgaaattcgttgtcatagcaggaaatgagcttgaacaaagtggtcgtttgagggcaattgcagccccagcatcaaaggtggaggagtgggttgtcgtgttgaggtcgagaggagagcacctggtgctcagtgtagcccgggatgcccttgcggtggccctccgatgcctgcttcagccaccttcttgatgccatcatatcgtggcaggttaggctaagacggcaggtcaggtccaccactgacaccgtcgggatgtggggcacggaagg

SEQ ID NO: 484143 - DNA, 249 bp, Homo sapiens
ccctcctgtagtcgctttgcctattaatgttcctttgggtctgtgaggttctgtaaactgtgctagggctgacaatgttttggacaacttaactccctggcgaaaaaacagggtggggcccttcagcccctccaacaaaattttttaaattgccagttgcaaaattgtggagggtttttacattgatcttttgctaaagcaattagcattatgttttgcatgtatgacttaataaatccctgaatcata

SEQ ID NO: 484144 - DNA, 344 bp, Homo sapiens
agactggctggtgagccctcaacactccccgtagtacttatttcccctcacagtaattgtcaccatttgacacatatattttattgcaggaaaagatggacactaaaatatatgtgtcaaggccgggcgtggtggctcatgcctgtaaccctagcactttgggaggccgaggtcaggagttcgagaccagcctgggtaacatggcgaaaccccgtctctactaacaatacaaaaattagccagaaatagcttgaacctgggaggctaaggttgcagtgagccgagattgtgccactgtactccatcctgggcaacagagcaagacactgtctcaaaaagtaaca

SEQ ID NO: 484145 - DNA, 408 bp, Homo sapiens
gtacgaggccatgcaggagaggcgggaggctgagaacatggctcagagggtcaggctgctggaggcatgggggaggctcatctccactgggacccccacagctgcttctaacacaggattttgtggctgcttcaggctgtcgcttttttttggtatctcctaatcgcaaaagagcatccagcaacaaccaggattccaagcgccgtggccacaccgacttcaaccttggacttttccacctgtttacaggcgggacttgccatatctcagctgggtgacaaagtgctcacagttcctgctcacaatactgtacttcatcttctgaccaaccatctccttcgcagaactgatgatcacctccacgggccgtggttggtactcatggtccaagctgttgttgacccgata

SEQ ID NO: 484146 - DNA, 554 bp, Homo sapiens
  misc_feature (306)..(306): n is a, c, g, or t
  misc_feature (435)..(436): n is a, c, g, or t
cggctatccacggcgcttggagcaccaagcccagcctcttaggaaactgaggtccaagggacaaaaagaatctgcagtctcttgccggcctgtgtccccgtggccagagtccagcaccctcttcctcgaagcaaccagaagtggaaatgaaagtgctccgttaactgtagactacatgccaccgaagggtcattcctgacagtggcttctccccattatctctttattgccggaggcttcatctcgcccccctgaagctacagtccaccctgaggtcataaacttctgctcagcacccatggcaantaatgcagaggtcaccatcagaggattataactgcagatgggaaaccgggatgagaggggagttctttaaaatcctgtcttgttttcctgcaaataatgcctcttacataaaatctgcgaagaaagatnnatgcagcaaagagacttgccttagaatctcagactagattgctttttccatatagactccacttagtgatttttgttctttattttttttttaaacaaaaacctatttctgaaaatac

SEQ ID NO: 484147 - DNA, 1006 bp, Homo sapiens
  misc_feature (567)..(567): n is a, c, g, or t
gcccaaagaggccatgtccgtggagccagtgcggagctcaccgtgctggctgctcaagcgccatgcttgcctaaccggctgcagagtgagtgccggaatgatcagtgcccccagagccctggctgccccagtggacttccagcttgctgactcagcaggtgatccaggtgctgcctatgacatctgccaatggctgccaagcagctgtgtcaccatcaccacccggagagaagaaggcagtgaccgtctctcccacatacgccgtcacctgcatccctaggacctcactggccataggagctgggccactactcagagcattaagtctcccagccccgaacaagagccatcttggcaccaaagttgcccttacgttgcttgccaacatgttcccctggacaagccatggttgcaccatggggattgccacgaaacactcgttgtctgaagcacacacttaaacggaattgtggcgcagagttcgcgcgagaggtggccagagcaagttgacagtgtaggcctcgcaaacagattgatacccattgaccacgccgttcgccaaccgtnccctcgataagtaaagtacggccagttcctgtcccgcacggccgaatctcacgtaaaggtaggccccacaacagcggtgctacccctgggcacaaaaggggtcactacaaagagttttccaaccaagggagccccaggtcgagccacgacgccttaagagaggagcatcgccccatttcgagtgcaacagcagtcaggggcgcagcccatatatacgagttcacgacgaagtaaccataactagtcacgctaggcattggtaggtgagcggaggctatgtcctgacaatcacgcacggaagttagcggattttggctgatttcgcacacaaagcaccacccgcgcgacatgtaggactgcccaccagagagaatcttaagagggcacccgacattaaccttggaccacacgaacacttagacagttacaggagccagtg

SEQ ID NO: 484148 - DNA, 130 bp, Homo sapiens
aagggggcgttttccggggggggattttaaattatgttgaaacaaggcccccccaaaaaaaatgtgtatactcataataggtcaaaaagtgtatccgctacaataaagttatgattaaaaataaaaaaaa

SEQ ID NO: 484149 - DNA, 304 bp, Homo sapiens
gacattgaaagcgccaccatcgcgcaacggcttccgcttccgcgtgccttacggcacgctcctgtgcgtgtccgacaaaccgctgcacggcgagatcaagctgcccggcatggccaaccacttctaccgcgagcgggtggaccagcacctgcgcatcggcatccgcgccgtggagatcctgcgccagcagcgcatggaccggctgcacagtcgcaagctgcgcagcttcgcggaagtggcgttccagtagtcagtcgggcgtgaccttggcgcggcggatcacctcgccccacttcctcgtctc

SEQ ID NO: 484150 - DNA, 589 bp, Homo sapiens
gttctgtgcttggtttattttacttaacataatgacctccaattccatccatgttgctgccaatgacaggatttcattcattcttatggctgaataatacattttctttagcctttcatctattgatgggcacttaggttgattccatgttttggctatcgtgaatactgctgcaataaacatgggagtgcaggtatctttttgatacattgatttctttccttttggagatatatatatacccagtagtggaactgctggagcatagttctgtttttagttttttgaggaacctctgtagtcttccacagtggctgtaccaatttacattcccaacagtgtaccaggcagggctctcctttttccacatccttactagcattcattctttcttcttgataaaagtaatgaattggggggagatgttatctcattgattttgatttccaattttctgattagggatgttgaacattttttgatggtatctgtccggccatttggggattttcttttgaaaactaccctattaagaacttttgggccttttttaagttgggaacggccctttttgctaattggttgggca

SEQ ID NO: 484151 - DNA, 411 bp, Homo sapiens
tccaagattgcggaccagccattgtcatcaccatggagccgtctttgttgaggggtccacctcccatcagagtgaggagatgaggcactgatctgttcattagcaatccggccagactccatgcccagaggaacattgcactgaaagttctctagtggctcttggtggaccaggtagtaacgcgcagagaagccatccttggccaccgccatgtccgtgtgaaaggtcagggagaggatccccgtcgatgaacgaagttcagagggtgttttggtcccacagtacttgccaatcagggggccaacatgtggaatgccatcccagatgtccagccaatcgtacttgcagtccccctctcccacctgcaaagggtcatgctccaggtcaaagatcaggaactgcaggatgatc

SEQ ID NO: 484152 - DNA, 870 bp, Homo sapiens
tggatggcggcccgaacaatttggccgcgggagggaggtaacacctgggagaggtgccccgcgccgagcccggtgtccccaataagttgtcgctcgaagatcacaaagggcccacgtcagggaggacgcaacccggggaacaatagaaccggcgaccaggattcgccaaaacgcgcggggtcatcaccccctccgagcgtcaacttttgggcgacaacaaaatcccggtgcgtgacgacgtcgtgaaaacacgcatgggccatggcgggccacccccgtgggcgaggccgccgtctttctcgtagggcgctcatggcaagactctctggggcaatatagtgcgttcatgtctgacccactataatgaaggcgaagggcgctcacacacacactactagaaatcagtcggcagcgacacacagctgggccacagcccagtacacaatacggggaaacccccccgcgcgtctcacaaattctaggagtttctttgaaagcaacaaggtattttatatggcccacctccctccccccgtcatgagcatccgtggaagacccaggaaataaccgcacgccactcctgttcttgttacccaacaaagctgtccatcgctggtatatgatcctaaaggtgtctctccccggcgggttgaggtacactctgaagatctttcacacaatctctacttaagcataacgtggagaagggagtatgagaccccgatgtgctcgagtcatcctacgtggtgtctcgccctccacgtctgttaaggagaagccccgacgtggctggccaaggtatggtccgacccccgcggtgcaacaaagcagatcaaatcccctctcccgtggggaaaccgccccacaaac

SEQ ID NO: 484153 - DNA, 125 bp, Homo sapiens
  misc_feature (2)..(2): n is a, c, g, or t
  misc_feature (122)..(122): n is a, c, g, or t
tngctgtgttactttattatattcctagtgtcactgacactagtttaaaaacagcctgcacaagaagcacagaactactccctcttcatctccatattttcatacatttcttgtggtttcanaat

SEQ ID NO: 484154 - DNA, 198 bp, Homo sapiens
acccatgagctggaagcccctccccacttcgagttgtcctgcctttgctttgagttgccctgcctctccagaccaagccaatgttcattttttacatatgctgattgacgtctcatgtcttctaaaatgcataagatcaaactgtgccctgaccaccttggccacttctcaggaccttcctgagggctgtatcacggg

SEQ ID NO: 484155 - DNA, 702 bp, Homo sapiens
ggctacacagtgaaccggagtctctactaaaactacaaaaaatagagccgggtatggtggcgggcacctgtagtcccagctactcgggaggctaaggcaggagaatggcgcgaacccgggagacggagcctgcagtgagctgagatcacaccactgcactccagcctggacaacaagagtgaaactgtctcaaaaaaaaaaaaagaaacagaaaaagtcaatttacccacgcttaaccactagtttcactaaatgtctgtttggctatccctaattatagaatattccctgcacttagtatatctgtcccatagtaacaaagatgtctaacacatttgattatacccaaccagcaccctatgactctatgttaagtatacctacatttaataatttccaaggccttcttaacaaggtgtccttacacaaactgtatgacatgacagttcatgccaagataacttggagtcgccttttttacttggggttggttccccttactcttataagggtatgggaatcagttcctttatcaaaaggggtggtaatgtcccagaagcctgccgaaccgtcagcaagcatactctaaggtttggacagatctccaaatgacgtgtccaaaagctctctgtcttgcattcccagaagttcagtctctaatttgcccaaaatatcaggggacctctaaatcaccgcagctga

SEQ ID NO: 484156 - DNA, 409 bp, Homo sapiens
  misc_feature (80)..(80): n is a, c, g, or t
cccggtgtttatcgattgccacagaaaggatgccctctctcacaactcctattcaacacagtataggaagttctggccanggagatcaggcaagagaaagaaataaaggtattcaaataggaagagaggaagtcaaatagtctctgtttgcagatgtcatgattgtacatttagaaaaccccatcgtttcagccccgaatccccttaagctgataagcaacttcagcaaagtctcaggatacaagatcaatgtgcaaaaatcacaagcattcctatacaccaataatagacaaacaaagagccaaaccatgagtgaattcccattcacaattgcaactaagagaataaaatacctaggaatacaactgacaagagatgtgaaggtggcatcgataaacaccgggtaccg

SEQ ID NO: 484157 - DNA, 317 bp, Homo sapiens
cgtgagtacaagtgaaactccatctcaaaaaaaaaaagaaaaaagaaaaacattttctttttccccttttgcagataagaaactgaggctcaaagaggtttagagacttactgaacccatttcagctagttagacttaatcagattttaacccaggttctgtttgacaaaggctaattttctgcctctgggtttccttcgctttggtctggagggcagcccccaaagggcggggattgaccatgatctcttcccaaaggtgtgggctctcccagcaggtacgaggttcgtcccgacccaccatccctaccttccatg

SEQ ID NO: 484158 - DNA, 314 bp, Homo sapiens
  misc_feature (191)..(191): n is a, c, g, or t
tacagagtgaatggttgaagaaatagttaaataaagtacagactccaagctcagcttgtactggctctaagctggggctcacagaggccactgctacatcagctccaggctgcagggccaccacctggccatactggcttcctccctgacgcagcacagctgtgcctgggacacagagtcgctctcaagtnactgggcagctagccaagctgcactccccactctcctcacttgatctctgtgacaatgtctatcgaggctctgggccgtggtatgccagcgatctggcctcatgcaccacggtgcctcgccct

SEQ ID NO: 484159 - DNA, 127 bp, Homo sapiens
cccccccctgggtttcccaaaagggggggttaaaaccccttttgcccccaattggttttttggccaattttattttggggggggggaaaaatttttttttaaaaccgggggttttttcccggtccca

SEQ ID NO: 484160 - DNA, 336 bp, Homo sapiens
ggatggacagggtctggtgaggggcatagtgggttgtgcctatagtcctagctactcagaaggcaggaggattgcttgtgcccaggagtttgaaaccagcctgggcaacacagtgagactcgcatcccctctaccaacaacacaaacaaaaaaaaacaaaatgaaatccccacaaaaacttatcaggtttggtggtgcccacctgtggtcccagctacttgggaggctgaggcaggagtaccgtttgggtccaggggttcaaggctacagtgacctgtgagctgtgatggcgccactgcattccagcctgggcaacagagtgagactctgcctctg

SEQ ID NO: 484161 - DNA, 134 bp, Homo sapiens
aatagttggaacgacggttgttgagcggttatcgacggacttacttactacctgacttaatgaactacgtacgtacggtactttaccacgacactctggttgactgacacggggtctgacatgtactgtactca

SEQ ID NO: 484162 - DNA, 1033 bp, Homo sapiens
  misc_feature (179)..(179): n is a, c, g, or t
  misc_feature (873)..(873): n is a, c, g, or t
taagacaacagaattcttaataaatttgaatagcgacgtattcccggtggtagtcattttaaggctcgaccacatcatcaggtcttggccaccgaggcatagtgtaaaaacagtcccggtcagtgggccaacctccctgcagccaagtaggtacatcctgtgtccctgtacattctcantagaagtggcccgtggttttccccgaggggtgacatcgatagccaaagtgtttatacgtggtttctcatgtgccctttatagtggccttggacagatttccccttcccaccagtttgaaaagtgtattggaggctcactcgggggcccctcgagactctcggagagagcagtgtgaacttgtgagggcccagagggaaccctcgagagaacgcttttcctttccccaacccccccgagagggtcatcttctcccgagaccgtggtgtgtgtccccggatttcccaattattaggcttttgggccagagaaacgcattgcgaaataagacttttgcttcgagaagccccaggcaactctccgtggggctcctcggggagctcaggaggaagcggagaccggggggacacacaactttccttgtgatcagtgtaaccaggcggtgtgtttgtgtatccccccgactctctgtgggcgatgttggggcaaacaaagagcccccgatacgaggaaagtcccttgacaagtgggaaaagtttccaacgttggccatgtgtttgtctgtgcacccccctatttggggaatgagaccctgatggcccaacaggtggtttatttaaaatagagcccatataccccctattagaggcatcccctgggggcccaaaaattcccagagggaaccctccttctggnaagcggaacttttggcccggaaactaaaaatcgggggcgcccacccaacgaaaggtctgggacagagtctctgggtgaagacacctttggacaaccaaacaccaaaaaagaacagaaaaacggggcttcaaaacgccctttaaagagaacccagggagaa

SEQ ID NO: 484163 - DNA, 833 bp, Homo sapiens
  misc_feature (572)..(572): n is a, c, g, or t
  misc_feature (597)..(597): n is a, c, g, or t
  misc_feature (631)..(631): n is a, c, g, or t
  misc_feature (683)..(683): n is a, c, g, or t
gagggtgagagcgcgcgcttgcggacgcggggattaaacggttgcaggcgtagcagagtggtcgttgtcttctaggtctcagccggtcgtcgcgagttcgcccgctcgctctgaggctcctgaagccgaaaccagctagactttcctccttcccgcctgccttgtagcggcgttgttgccactccgccaccatgttcgaggcgcgcctggtccagggctccatcctcaagaaggtgtgggaggcacctcaaggacctcatcaacgaggcctgctgggatataagctccagcggtgtaaaccttgcagagcatggactcgtcccacgtctcttgtggtgcagctcaccctgcgggtctgagggcttcgaacctaccggtggaccgaaacctgccatgggtgtgaacctcaccagtatggtccaaaatactaaaatgcgccggcaatgacagatatcattacactaagggcgaaagataacgcggatacctgtgggggcaagtatttgaagcaccaaaccaggagaaaggttccagactatgcaatgacgttgactggattagatgttggaccnactttggaattccagaacaggagtncaggtgtgtagtaaagatggctctggtgaattgnccgttatatgccgaaatctccagccacttttggagatggctgtcgtatattncctcggtgcacacgcggcgcgcgactctccgggcacgtggaactctcgactgcgaccttactggtccccgacattttgtgctcaaacgggaacggtccataagatgaggaccgtacacaattgctcgggccgcacttttgaagcccactt

SEQ ID NO: 484164 - DNA, 930 bp, Homo sapiens
gagctctgggagaggagcccagacactgggattccgaggtgtctctccatatcactgatctgcactgagacatcagatggactcgccatggaattctgggctgaggactggagttgttgcctcgtctgcatcttctctaaacagtgtgtccagtgctgaaaatgcaactatgtgcacgtctgggaggaggcttggtccatgccttggtggtggtcccctgatgacttcatccatgatgctagccctctgaactccccgcgtcgaggtaaccgacgttatattaatgactggggtccggctcaggcaccaggggaaaggggctgcaagtgagatcgctacgtttgttgaaaacggtggccgaatatcggtagcatacgcatgactccgtgaaggggcccggtctcagcatctccacagacatttccaagaacacggtgtagtcgttcagatgaggcaggacttgagacctgatgacacggctgttgatgtgctgtgcgagagactcctagaaacctatggccagtgactactacggtctcgacgctctgggtgccaggggaccacggtcatcgtctcctcagcatccccgaccatgccccaaggtctgtcccgctgagcctcgaggactgctcttaggtcagaagcgagctcacgtgccacttgacggcctgggagatgcctctggtgccaacttcacctggacgccctcagtggggaagaccgctgtccacgcccgcctgaagcgtgacctctggtggtgtacagcgtggtccctgtcctgcctggtgtgccggctgagcctgtggggactctcctgcctgtgcccccgattggaaaccccttcgccctcaaatcgagtcggcggggcactggccggcgggggctacacgggatccgcgttcccattgtcctgggcccaattcccccggc

SEQ ID NO: 484165 - DNA, 154 bp, Homo sapiens
aggttgtactctcggagtggccgcctccaataaagcaatgtagcttggagccttggaggtctgaatctcaaatttgccctgtttcacgaatgaaggaattgtggcctcaggaaccacgagcgcatggtgtagcaccagtacaacctgccggtgg

SEQ ID NO: 484166 - DNA, 135 bp, Homo sapiens
tctgatgaagagtgcttgatagagagtgggcctaagtggcgctctagctgatgcctgttctactgcccagaaggctgggggatacatttgcaaatgtaatggtggccgcggtgccatccgagaatttgcagagca

SEQ ID NO: 484167 - DNA, 293 bp, Homo sapiens
tgagtgtagatattgtgtaagaaacaaacaggaggggtggcaggccagtggtcatgctgtaatccagcatatagggaggccgagacaggtggataacctgaggtcaggagtacgagaccagtctggtcgacatggtgaaactctgtctctactacaaaatgcaaaattagccaggcctggtggcacatgcctgtgatcccagttactcgggaggctgaggtaggagaatcgcttgaacttgggatgtggaggttataggtgggctgagattgtgctgttgtactccagccagg

SEQ ID NO: 484168 - DNA, 355 bp, Homo sapiens
gacgatgagtctcgacaccatgacagagttcatgctcggcgcgatcgagccacacaaagcatgatactcaaagtaatagagagctcgacacgaagacccagacgcctagctcttcacgcagacgacgagaggaggcatccaagaatagtctctccaggtgccggatgactgcagcaggcatacgaccagaaacctgcccagagcattttatccgccgcccgactctgaagcagatgacgcccacggctgtcactcaagtgcactgaaaaagcgcgatgaagctgcccagctcccaggtgagcctcgcgtttatcgcacacgccaatctgtacatcctgtgcgtcgactaacacta

SEQ ID NO: 484169 - DNA, 201 bp, Homo sapiens
cctagcacaacccctgcttctatacccagcacaacctctgccccaacaaccagcacaacctctgctcccacaacgagcacaacttctgcccctacaaccagcacaacctccactccacagaccaccacatcctctgcccctacaagcagcacaacctcggctcctaccaccagcacaactctctgcccctacaaccaggtg

SEQ ID NO: 484170 - DNA, 181 bp, Homo sapiens
  misc_feature (93)..(93): n is a, c, g, or t
aggatccctggctcatgtgatctcaagctgtgggacgaggtctgaggcacagaagcagattcaccacccaccaagtgcagagacaccgtgcanaacccatcaagagagatgacatgatgcctgcaagcatcatgagagacgaaagcccgactgtcatcagcctggcaggctgtccctcaaa

SEQ ID NO: 484171 - DNA, 218 bp, Homo sapiens
cgcacagccatgtggtttgtctccccattctcaacatttacaatttaatggtgaagtaattccagcttaatctgagataacaggatgccctaaatttttctatttctctaaagctcagttctttctgatatcgtccattttatgccatgctaccagtatatactaatagtttatatagcctattgaaaccttttctgttgacccatttgtgtgtgtgt

SEQ ID NO: 484172 - DNA, 294 bp, Homo sapiens
ctgctagaggatccccgaaccgggtcctttctccaactcaacaactattctataatttggataactccctggagcctcaaagacaccgggcgggagggtctggttctatccccttccaccctcagggggatgataatctcacagacacctccggagggtctggctcactctcctttccacccttcagctccaccctcgaggggatgataatctcaaagacacctcccagggggtgtctgctcactcccctttccacccgtcaggggagtgataatctgaagaaactaaggaggg

SEQ ID NO: 484173 - DNA, 159 bp, Homo sapiens
cttttaaaaaattttttctgtggtccaataaaaaagccgctggccaaaatgcctaaaatagtttgtgggttcataggggggattttttggttttttttcaaaatcaaagattgggttttgaaactaggggtttttaatcaaagttggctttataggggg

SEQ ID NO: 484174 - DNA, 163 bp, Homo sapiens
  misc_feature (6)..(6): n is a, c, g, or t
  misc_feature (13)..(13): n is a, c, g, or t
  misc_feature (53)..(53): n is a, c, g, or t
  misc_feature (114)..(114): n is a, c, g, or t
tagttncttcttngtaaatatcctattggtggggtaagatttactatatcttnagtttaaattctgctgtgtagactctggcagcagcctctatggtgacgaaacaagcttttntttttttttttttttttttttttccttaaaaccgggaaaatgggggttt

SEQ ID NO: 484175 - DNA, 1581 bp, Homo sapiens
  misc_feature (165)..(165): n is a, c, g, or t
  misc_feature (171)..(171): n is a, c, g, or t
  misc_feature (202)..(202): n is a, c, g, or t
  misc_feature (205)..(205): n is a, c, g, or t
  misc_feature (334)..(334): n is a, c, g, or t
  misc_feature (536)..(536): n is a, c, g, or t
  misc_feature (1166)..(1166): n is a, c, g, or t
  misc_feature (1316)..(1316): n is a, c, g, or t
  misc_feature (1581)..(1581): n is a, c, g, or t
gacaggatgtcggtgatccatgtatcgccttgaataggctcagaagagtgcgagtacatacgcgtagagagagcagtcattgagtcgagagcattcgatcggtctaatatagcgagcgatcagcatgcattgtcggcgcggcgacaaggtgctcgagccgagccntcagcntagcggccctagtcgtagagtgcctattcanaanactgtctgtgctggggccaatctgtatcataaccagaacaccaatatgtaagaaaaagttatcgcatgagacgtgtatgcgccttcgcgtcgaggactgggagtagaacgcgagcctacacctctccantacgctcagtggcgcctcgcgcgttacctctagcgtattcacagagcgtcgcacacacgactcgcaaggcccagttcgtatacctgggtggcggtgaatccagccgactgtaggagttaattcgtcctcgttcgctcgggaaaaatatccccgaagaccgcagggcacaagggtaccgtaatcgcgttggagcactcatgcntatatctggagtgggctcgctcataatgggggcacgcgagcccaagttatcgcaaaatctctgtaaccttccaattataaagaaaccaaatgtgaattataccagaagggcggaggaaccttgggtcttgtcggcatgtccgcccttgggaacttgttgcgtcgctcctagattccgcgttgggaaattgtcggtttcaggcgggtaagaccggtcgccgatttggcgttctgggggcaattgcacagccattttttgtcgcaaaatgggacttcttgttggggtgaaattctcgtcccccatggaggccacaacttggcggggggccagcaggacaaactcggcggggtatggacgaagacccagatttgaccgccccaagtttgtcccaatggggttgccgctttctttaagcacaccgaaacccttgggttggaggtggagtgtggcaagacaacaagacaacgggtcaaaaaatttgagcgtaccgaggggttgcgctaaaggaaaccatcaccacgcactgatggcaccgtcgtccccaagtccattggtgaagaacacccaaggaccgcttctaagctggaggagcgcgacaggtacacggcgacagcaatttacattgggacngcgcgcgacaaggacatagtggtattctaccgacggtgggcgaaaacaggattccgaagagacccaacccccttttgaaccaccattctaaaatgcagcaaagccaaaatatatgggagtggcctacatacccaaaagggcacccacagnaaagcgagcgaagctttaacgctctagttgttttctgtaggaggagccccaacaactaatattcctaacgggggtatcctggggacacatacggtggttcggcatcaacaatccgattcgggtcctaggggcatttggggccccaacattgtctcaggccttcaccaacataaatgggtgcgcctgtatcgagacgttgtcgcccaacattgggtgcactctggggggaacacaccttacaaaggcgcacggttcaacacgggcn

SEQ ID NO: 484176 - DNA, 331 bp, Homo sapiens
  misc_feature (73)..(73): n is a, c, g, or t
  misc_feature (199)..(199): n is a, c, g, or t
atctagaggatccggggtcttgcgaatagcgattcgccgattttacagagagctgatggtccatttgacaggntgctgattggtgcgtttacaatccctgagctagacacagagtgctgattgggtatttacaatcctctagctagacgtaaaagttctccaagtccccactagattaactagacacagagcagcgatnggtgcatttacaaaccttaagctagacacagggtgctgattggtgcatttacaaaccttgagctagacacagaggggatcggtgtatttacaatcctttagctagacataaaagttctgcaaggaacccagg

SEQ ID NO: 484177 - DNA, 383 bp, Homo sapiens
tactacaccggaggatcacaagatatgaaaatgtgtaatctagccctagatctgaagtacagaagtcaggatggatagagaggtagacatgccaagatgtaggttctgcttctctgagattgtctgtcagcttttcccacagtatcaccccacctttctccattatacaggatggatttagcacttccagacattataaccagatagcctattgctagagaacaaagcaccttctcttcctatatgtacctcttgggaacaagggaacctttccccaaagcccctcaacacacttaggctgacatctccttgaccagaactgtctcaaatttacatagcctcacatgaagcatctgggaccaccaggatagggtgtataggcc

SEQ ID NO: 484178 - DNA, 669 bp, Homo sapiens
  misc_feature (42)..(43): n is a, c, g, or t
  misc_feature (603)..(603): n is a, c, g, or t
  misc_feature (629)..(629): n is a, c, g, or t
  misc_feature (631)..(631): n is a, c, g, or t
  misc_feature (654)..(654): n is a, c, g, or t
  misc_feature (665)..(665): n is a, c, g, or t
tttggggccccagaagatttttcccgggcgcggacttttttnnccccccccaaagggccgctcaccaagtttttttataaaggggggggggccgcccaaaaaaatttttttaaaaaaaaaaaaaagggaaaaaaaagggtttgggggggggggaaaaaccccccccctgtgtgagagacccccccccccccctagagaaaaagagccccctttttaaaaaaaatgctccccaaaaaaaaaaaaaaaaagttttttttttttggggggagatcttctttttggaggggggccccccaaaaaaaaagggcccccccccccccttttttttttttgggggaaccccccccccttttgttttttctcttaaaaaaaaaaccccccctttaaaaataatttttccccggcgccccccccaaagggggggtaccccccccacagccgggcgcaaaaaggggggccccccctcccctggtcgggggggggggggtaatctcccccccccccccctttctctctttaaaaaaacaccctttgggggaagagaaaaacccaaaaattctttatatttagggccacgggtaaacttgttaagcccctttaccnctggagaaaagccccgccctatcagnantgtcaaaccttcatgtaaatagnccagaattcancaga

SEQ ID NO: 484179 - DNA, 154 bp, Homo sapiens
aacagactaagagagatgccacagtatttccgttactctagtttcactagccctgtgtaacctctcatctgccgaatccttggttatttccttactccaaggatgacatactattctatgtggacagatcctttacctgggactcattctcacc

SEQ ID NO: 484180 - DNA, 246 bp, Homo sapiens
atgctcccgtactctggacggttgtgtcgcctctggccgtggcaggcgatcctatgtgtctcgcggacctcccggtgacgctgcctgcctcccctgactgcaccatagtgcccgggacgtacggcgtccccacagctatggaccgcgcaggggctcgtgaacatgtttgtcaagattgactaatcatccatcgcacggtgtaccgacgctcgaacttcgattaatcatggctcactagctattttc

SEQ ID NO: 484181 - DNA, 294 bp, Homo sapiens
ggcttgatctcggctcactgcagcgtccgcctcctgggttcaagcggttctcccacctcagcctcccgagaagctggtactataggtgtgcaccaccacacacggctaatttttgcgtttttaatagagatggagtttcaccatgttgaccaggcgggtctcagaactgctgacttcaagtgatccgcccaccttggcctcccaaagtgctgggattccaggcatgagccacctcatccagccaagaaaatttgttctctaatagtaacagggcatatgtatatcttggtgatt

SEQ ID NO: 484182 - DNA, 144 bp, Homo sapiens
ggaaagtggtggaccttaaaaaatgaagtaggtataggtctttaattcggatctttttaggtctcaagactgctggctttcagactgtgtgtgtgtgtcctgtggttctgtttttctgaacaatatggatattaatatagtatc

SEQ ID NO: 484183 - DNA, 333 bp, Homo sapiens
tctaagggcctttaaaaaggacactggctgggtgtgcgtgcacgcctgtaatcccaacactttgggagccgaggcggcggatcacctgaggtcaggagttcgagaccagcctggccaacatggagaaaccccgtctctactgaaaatacaaaattagccagttgtggtgcacatgcctgtaattcctgctactggggaggctgagacagaagaatcacttgaaccagggaggcggaggttgcagtgagccaagatcgcatcattgcatttcagcctggacaacaagagcgaaactccatcaaataaataaacactaatagccagaaaaaaaaa

SEQ ID NO: 484184 - DNA, 313 bp, Homo sapiens
cctagttcttcactcttgtttatcacaggctggctgtgcagtggtgcaatgtgggcttactgcagccttgacctccaggacaagtgatctcccacctcagcctccggacatacgctgggactacagctcaacaagcgcccctcatgaaagtacgactcttggaaatgaaccttgttgggagtaaagctgaaccttcacctctcctttccatgattctactccattcatacggcctcagcactgacatgatgtgccttgcagccatcgtcgtggatcctctacgatgtctgacctgcagtgcctgccatgcttg

SEQ ID NO: 484185 - DNA, 518 bp, Homo sapiens
  misc_feature (24)..(24): n is a, c, g, or t
  misc_feature (93)..(93): n is a, c, g, or t
ctgggcccccaagggggtttgggntttttttggggaaaaaaaaggccctggggcgggcccttttcaaaaaattggggcgggcttttttttaangggcccccggtttttttttccttttccccacaccagggaaaatttttaagggggggggggggccaaatgggggggggggggcccccccctgggaaaactttcaagggtccccaaagggaaaaagggtgcccctttccgggggatccccttttttttaagcccaaggggggttcccccccctgggtttgggggggttttccccccccccccccaggggccccgtttttttttttggcccaaaaaaaaagggggcgggggccccccctgggtttggggttcaaccaacgtttttttaaaccccccccggggttgggttggcctaaaggggggttttttcgggggtccccacctttaaaaaaaaggtttttttttggggtgggggggtttttttaacccttttcctgccccttaaattttttaaggga

SEQ ID NO: 484186 - DNA, 150 bp, Homo sapiens
gatcgaagaatcacaaagaaatcgatagcctcatcatccgccaccatcatagccagcatcaccctccttaacctctacttctacctacgcctaatctactccagcctccaatcacacatactctcccgatatcataacaagcgtaaaaga

SEQ ID NO: 484187 - DNA, 252 bp, Homo sapiens
ggcacgagagcaaactgtgatgtgttttttcagatctatgagtgaaagcaattgtcgacactgttgtaaggttgtgtgctgcataactttatgaggtgctgattacacccatagtcattgtaggttgatttattaaaataattgacaggctgaggcaggagaatcgcttgagcccaggaggtggaggttgcagtgtactgagatccaccaccgcactccagcctgggcatctgagtgagactacatctcaaa

SEQ ID NO: 484188 - DNA, 185 bp, Homo sapiens
gagtgttgtgtggtcgcgtctcggaacccggtagcgcttcagcatggctgaccacctgaccttaagagcagattgcagattcaaagaagctttttcactatttgcaaagatggtgatggacctataaccaacaaaggattgggaacctgtaatgagagctcttgggacagaatcccaacagagca

SEQ ID NO: 484189 - DNA, 378 bp, Homo sapiens
gatacagggtgcaagcctttcattcatgccaaggggtttccatggagaacgagaggcttccaaaaatggcaaccagtgattttgacttttcctctccttggtctatttctctgtccccttcagcacactaaggcagaggctcacagagatcaagctcagtatctcaccagtagctgctacctccggtgcacaagctagcagagttggtgtccattcgacaaacacagagggtttctgtgttatgtatatcctacaccttaggcagccagtactaagacaaacacgatccggcccctcaaattacagagcggagacccaacccagatatatcagaacgataagcctacatgaaagacatacgaaggtgatctgactact

SEQ ID NO: 484190 - DNA, 1114 bp, Homo sapiens
  misc_feature (281)..(281): n is a, c, g, or t
taagcgctgacgcatgcgcatagctaaccgcacccggttcagactcgcctttcttggccagaggcgccggttggactcacggtcggggcatgatggtggtagggtacgggcgaccatcgcctgtgcgcgtcgtccgtcccatccttgttcccgtgacgtgcatcgtttgcgtggcgatgcacgatgtacatgccgttcagcttgtgccctccacctgagctggctcaccatcctagggcggcctgcgttggtatcgggtactctctacggtgattcatcgncgtcacatgtcgctgtcgaataaggtcgtggcagaattctttgctcatctctgggcgaaacgggacttccaaggccaacaggactctgtgccctgtaggacttacgtcctggtgcacgtaccatgatttggccatctcctctttgcaactccgttgggccttcacttccagccccgaacgtcttggtgatcaccacagctcttgacttatcagtccctgcgtcacactggggtttggggtcctggttagcttacatttcaaacgaacgaattcttcgcttcgcaacacacgtggtaacccatgggccagccaggctgtcacgaggtccgttcgacgagccgagtcccaaagggtccaccagggccacaggaggcaaaggaaagcagcacaagctggacccctgcaagtgtttcaacttcagagagggctttgaaaagtttccttctgtgggttacaacgcactatcactcagactcgacccacgcacgtctatagcacatatcaacacaaaacacgcgggcgtgcgcggccgcgcactcttctgagacaggtgtatccacccctctctcggatgcgcgcgcccccaacacggccatctacgccggtctcttaccccccggagccgcctatgctctgggctcaccactcacaagtcgggttggtacccctcccctcaatcttgcgtctaccacgcggcgcacatcgcattagactagctggcccacagcggaccttcatggaccctactaccgaccgactgtgtcaacaaagtgctcaccacttcatacactgtggtgtctaccacatcctgggctcctacctttgttgggaga

SEQ ID NO: 484191 - DNA, 891 bp, Homo sapiens
tggaaacttaaaaacccctcaaaaacggtttattatacaagtgagtttggattcacaaggggcttatcggtaggatttcggggtagcgagcgcgggccccggggcccccaaatcttttgggactcgcagctgacagagggtcacgctcacccagcggggtccgggtcatacttgggattggagggatggtctttggatctccttcttgggaagcctcatccaaatattcctgggtaataaggcccaccagggcttgggagatggtgactggacgggatacgcataaatctgggcgccactgtgaccaccacccttaacagggacagggatgtctacaccaagaaaatctgacctcttgccgaaaagcaagaatctgggctccaagcagtctggtacctggtagctgggcgcggatacaatacatctcccagggggccgccctgttacaccttgatggagaccattggccgcgtttggcagtggccgccacagttggtcgctgtctatctagtgcgtaccgaaaacctgcaccgacggcagcggcacccctgggacgggacagggccaccagagcggggacatagacaacctcacccgacgggtgtcacaggcggagagggaccgacgagtggaggagcaaaaccccagggatacgacacgcccgaagaaaggcgcgggagtaccccacaatagaaggtccgggaaagggaactaccagagggccttggggacacgggtgggacccccccgaagaggtcggcactcgaaagcaagcacccaatggccggcgcgaagggggcccaccgatagcgaaccccagggggggggcgcgcggctgtcgaaggcagcgcatcgagaagtacaaagctaaaaccagagaacgcagagcga

SEQ ID NO: 484192 - DNA, 314 bp, Homo sapiens
ccagcagtgtaggtcgactcagtgagaacggaaagacagtagctgggtcttagtttcttgatggggggtaattataggagggcatacaagtcgatataagatgtggaacagggaggtaaactagttgggataagaacttggaactgttccttgtggatccccatgtctggtcatcacgatgtggatgtacattacttaaaattattacatgctgcatcttgtcagccgggagactgtgcatacaacatgagaggtgatgacacactaataatgggaagcacaatgacgggctgatggcccctgaggctgtgtgt

SEQ ID NO: 484193 - DNA, 254 bp, Homo sapiens
cggggggggaaaccttttttttgggttttgggggggggggcccccccccccccggggggcccttttttttttttggggggggggtttttttttttaagggccccaaaatgggtaaaccctgggggggggggggtttttcccctttttttttttggggggtttcccctcccgggggggggggtttcttccttttttttggcccccctttgccccctgggttttggggggggtttggcttttttttttttccccca

SEQ ID NO: 484194 - DNA, 912 bp, Homo sapiens
gccccggcatgcttggtgccccctgggaccccagggtcctcagtgtgcaacctggagaggcctgggcctgtgggagaaaggggccctgttggccctcgagggttcccagtgcctcaaagtgctcaaagtggcagctttggaactggacgggccgacgaaggacatgccatgtgcccataaagggtgacatagtggccccctagggccatgaacgtggccccctggggtctccatgtggcccctcagtggcctcatgggaaaacctgggaacttggcagggacagacacgggttcaccagtgccatgcggtgggtgccatgtggtgcctacagggtgaaccatgtggatccagggtccccctgtgtctcccgtgtggcctccagtgtccaccatggaaggccaagaagcttctacttgacggacgggcttgtgcgcagaagccaactggtcacgacagtgaatggccggagtgggccgccaagagccaagattcgcaggccccccagcaaaagtccttcaccttacaatgacaagcttgtgagtccatctgaattccatattgaggcggggcattcccacaagggacttgagcccatgcaggccttctgaggcatccccgcaatagtgaacttgatgcccatagtgacaagcgaggcctccttccctcacgaccacgacaatggtcgcaaccatttgcaacagcacgagtgcaattgcacgacaacaattgcacagcattagcactgccacaattgcacgacattacaccattgcattgcaacacaataccacaggccataccatgcattgcacacaacatcattgcaacggcacactacattgcacaagattacaccgtgcacgacatacacagcgcaacacattgcagtgcaccaccatacacattgcaca

SEQ ID NO: 484195 - DNA, 102 bp, Homo sapiens
aagggtcggggcggcaggtgccggcggcggcccggcagctggggaccgcggagggggggggcacgggtcgccacgcggagggagggtgccggggcgaccgcg

SEQ ID NO: 484196 - DNA, 403 bp, Homo sapiens
ttctgcgtgtaagattggcactaatccagtttgtgaagactgcactagagtttcagtcacaggcttcattcttctggtcatcgctgcttcccgcgcttatagaattctgatcatcatcttctatatcagaagaagatgaggatgtaatgtcagcttgcttccttttagtgcttgttcttagggagtttctctttttctccttgacaatgactgccttctttttagatgaagttctttgcttcttctttttattatcttcagaactttcctcagcatcagatgatgatgagccactttgtatttccttagtatttctctttgaacttaaatttcttctttccctcaattctattctattcagtctcttatcagaagagttacaaccatcttctttcatggaata

SEQ ID NO: 484197 - DNA, 966 bp, Homo sapiens
  misc_feature (21)..(21): n is a, c, g, or t
  misc_feature (78)..(78): n is a, c, g, or t
  misc_feature (84)..(85): n is a, c, g, or t
  misc_feature (102)..(103): n is a, c, g, or t
  misc_feature (121)..(121): n is a, c, g, or t
  misc_feature (153)..(153): n is a, c, g, or t
  misc_feature (217)..(217): n is a, c, g, or t
  misc_feature (225)..(225): n is a, c, g, or t
  misc_feature (227)..(227): n is a, c, g, or t
  misc_feature (283)..(284): n is a, c, g, or t
  misc_feature (297)..(297): n is a, c, g, or t
  misc_feature (307)..(307): n is a, c, g, or t
  misc_feature (364)..(364): n is a, c, g, or t
  misc_feature (382)..(382): n is a, c, g, or t
  misc_feature (391)..(391): n is a, c, g, or t
  misc_feature (402)..(402): n is a, c, g, or t
  misc_feature (405)..(405): n is a, c, g, or t
  misc_feature (408)..(408): n is a, c, g, or t
  misc_feature (415)..(415): n is a, c, g, or t
  misc_feature (465)..(465): n is a, c, g, or t
  misc_feature (467)..(467): n is a, c, g, or t
  misc_feature (489)..(490): n is a, c, g, or t
  misc_feature (494)..(494): n is a, c, g, or t
  misc_feature (498)..(498): n is a, c, g, or t
  misc_feature (537)..(537): n is a, c, g, or t
  misc_feature (783)..(783): n is a, c, g, or t
  misc_feature (833)..(833): n is a, c, g, or t
  misc_feature (873)..(873): n is a, c, g, or t
  misc_feature (924)..(924): n is a, c, g, or t
cgaattccgggatggggaagnaatggggggaagggagcggcggggagaacaaaatcgccgccgccgcccttcagcgantggggnnggctggaggcgcgaatnnctaagcggctggaagaanttctggcagtaagtgagcaaggagagggtggngcgtacgaactcacgggaggaggtggatgagggggccagcaccctgacgcggctgccgattgangtacagcnanatattttgtcctttctttcacctcatgatctgtgtaagttgggaagtacaaataannattggaatgaaantgtaagagancaaattatgtggagataatttttgttgagggatcttccttcttggtcttctgttgantggaagtctcttccaganctagaaatnttaaaaaagcntanatntgaggtnactgatggggcattttttgactaaatggcagtatatagaatgtgctgtcnanaaaaaagaagagcttaaaaatnnagcngtcntatgtatggagctgtaacttcttttttacactccctgancattcagaatgaaccacgatttgctatgtttggaccaggtttggagagaattgaatacctctttggtgttgagcttgatgtcttcagaggaactttgcccaacagctggtttgcctcagaggcagattgatggtattggatcaggagtcaattttcagttgaacaaccaacataaattcaacattctaatcttatattcaactaccagaaaggaaagagatagagcaagggaagagcatacaagtncagttaacaagatgttcagtcgacacaatgaaggtgatgatcaacaaggnagccggtacagtgtgatttcacagattcaaaaagtgtgtnaagttgtagatgggttcatctatgttgcaaatgctgcagctcataaaagtncaggatacagaggctgaaactctgactgggtttttgaatggc

SEQ ID NO: 484198 - DNA, 260 bp, Homo sapiens
  misc_feature (119)..(119): n is a, c, g, or t
caggaacctattttcccaaatcaaatttccctggtaagttaaaaaaaacttcccttggaaaccccctgttgacatctggttgaaagaaatgtgggccagaggacacacctagagatgcntggaatcgggtgtccagaaaggacacaaaactgccctgtggcaatgacataatttttgccaactttggtttcatatctatcgccaaagtattatagagaggactcccggcgagactaccaaaacagctatgaccatgatta

SEQ ID NO: 484199 - DNA, 110 bp, Homo sapiens
tgcactattactgtcatttaccgaattgttatttccatcttgatttaatttttaacttaaacattaatcaagagaagattgcttaatttccatttatttttatatgtttt

SEQ ID NO: 484200 - DNA, 215 bp, Homo sapiens
ttatagagaccgtatcattataaagaaactgtaggctcattctactgtatccacactccctcacaatcttcagggacatacaataaatccactttcttctcctacaaatgatatatagcacatctggcaaggagtagtccctttactccttcttcttatctttttttctttatcttttacttttataattctatgggagaaggcggcacaagctg

SEQ ID NO: 484201 - DNA, 158 bp, Homo sapiens
  misc_feature (128)..(128): n is a, c, g, or t
attttggtttctaatacaatttttcaatcaaacggacaaggactccttggagaaatggttgattttacaactagggcagacataagccagttgaccatgattcattatatagtaccaaaaagtaaggnaggttttaattaattaattaaggagttaaa

SEQ ID NO: 484202 - DNA, 506 bp, Homo sapiens
cattggagcaccactcatggctctcagccttgcaagggcagccattaaagggtcggcgtcttgtgtaaaataactaatctgagaagcagacacccagtaggcgcgaggctactgcgtcccatagaagaggcttgtatgtatgagctctttgctccctccctcccactaacttaaaagaattgctctccatctcgtttggcaaagttccttcgcccttagtcttatttgggtgaccccctccaaggtatttctagtccatttgcatccaatctgacatctagacggagagcggtctcatatgctatggtggtaaacgtggactagtatttatgtgtagagaacagtggctgtatgtcaggaaaagtgtgccaaaacaaagagtacggccggccctggaaatgcatcagaaaaacccattcccccggtgcactcattctgagcttccttccttcatttctgtcattactgctgagaactggactgtgcccagatgacctttcccttcc

SEQ ID NO: 484203 - DNA, 175 bp, Homo sapiens
  misc_feature (149)..(149): n is a, c, g, or t
  misc_feature (164)..(164): n is a, c, g, or t
ctttttttgaagaaaaaaaaaaaaaaaccactttgagggcataggggatgtcagtttcctatggaaaagacccctttgacccgttatttttataatcaaaatttgaagggaaaaaaatgttttagttctttcccccctcgttgggttcnactagattaaaaggntgattttcaga

SEQ ID NO: 484204 - DNA, 183 bp, Homo sapiens
actgtgtctgtatctgtgtgtgtgtgtgcctgtgtgtgtctgcagtagtgtgcactagtgtgtagtctgtgccatagtatgtatgtgtgtatctagtgtgtgtggcgtgtctagtgtgtctagtgtgtgtgtcactgtctatgaatgagtagtactgtatatgtgtgcctagtgtgtgtgtct

SEQ ID NO: 484205 - DNA, 861 bp, Homo sapiens
  misc_feature (263)..(263): n is a, c, g, or t
  misc_feature (368)..(368): n is a, c, g, or t
gtaattacagtggaatgagtactggacaaggagtcaaaaaacttgatttcaggtcctagctctagcacttacagctgtgtgatcttgggcaagtcacttaacctctctttgcctcaatttcctcatcttgaaatgaggataataatacctgctgtacctacctcacagggctgttgtgaggattaaatgagatggcatgtgaaagcactttgaaaattgtaaaagcgctattgttaaatgttacgggttattaattagaaaanaattcttttaaccattattagtttctattacacatctcatcttttataccaagagaagagggaaagagtcgtgctgtgtagagcgtggtgtgaaaaatgttaatncttgtatataacattgtgtgtttgcataacatatcctcttcagtggttttactcttccaaatgtttcaacagactaattgaacatatgacaatgcctgttttgaactcttaaaggcttcactgagcacgctgcttggagttcacggaagttcacctgttcagaaataggctttggttagctgactagggtcagggcaaactttttctctctcaacatttcgaaacgctgtttcctgttttcattttacattattattcagaaatggtagctattctatacctatggtttaagtcaatatttctgaataaggttcaccatactgtaagcatctcaggtagattgcctttaaaggttattgggagggcattgagggaacacttcttatgcagaaaccctttcataaacaacagaaacttttactaaattaagaacacatcacagtatgacggaacaatcaatctaagaaccttgctcacattatactcccaatct

SEQ ID NO: 484206 - DNA, 208 bp, Homo sapiens
cacccggctttcgcagaacccagatgatgctcctgtctccccctaagtataacgcgttatgtagtcagagagtttgagatcttcctggccagcatggcaaaaccccgtctctactaaaaatacaaaaattagcccagcgtggtggcacatgcctgtaatcccagctacttgggaggctgaagcaggagaatcacttgaactcgggagg

SEQ ID NO: 484207 - DNA, 398 bp, Homo sapiens
  misc_feature (26)..(26): n is a, c, g, or t
accatagttttccatctaatggatanattcattatacataaagaaaaaaccctccaatgcattaaatgacttatttttaataaagaccttctgataaaattagacccttcttcatagataccattcttcagacaaaagccagaaaggctgtctcatactcagactacaaagctgcaaagaccgtgtaatgtgtagattagctcgcctctaatttacccagcaattattaggtctgaataataaggaaatgtgttccaaggcgtgcataattatatactctctaagtagaaccaaatgaaaccattttctgtgtttaaaaaaataaaaataaaacacgccgggcatggtggcctcacatctgtaatcacagctctttgagaggacaagacaggcgtatc

SEQ ID NO: 484208 - DNA, 128 bp, Homo sapiens
gggtacagatcaaggggtgcctgggagcactcgaatgactgggaagtctctgtccctctgctcttggtgtgtagtctatttcagcagtgtgtgtcgttcatgaatgggaggtagtcagggtgtggtgt

SEQ ID NO: 484209 - DNA, 663 bp, Homo sapiens
  misc_feature (97)..(97): n is a, c, g, or t
  misc_feature (188)..(188): n is a, c, g, or t
tcccagtttaaccaaggggatttaatttggtcccctaaaaggtaaattctaaaaaatagcaccccatggcaaaaagagtccttagtacataagaacncattttctcaatctcattctcctcttcatctcatctttcaacatgtgggtgatcacctctttcacagtgttcgcacattcgatctcggaanacacagacgtgattaaaatgtgcaaaccccgtgtgtgttgaagaggccacatgtgggcccataaattatgtggctctaccacacccgtgctataaccactctctccctgtgtgtgagaacgcacaaggggagacagcgcctttttctgtgtgcaatctctctccccacattttgtgtgatatagagaaaccttttatctacaaacacagattgttttatataataggcacaaatatatgttcaaagaggggctcctcctgttctcgcctgtggtctctcttctgcacaccttactatccctacaacatagagagacagagtggctcaccgagacatatttcacaccacaacagcctcttttttttatattttctcccccgcgcagaggcgtgttgtgacactcaagaagagtagtgtctctattcacacagacgacaatatttgtgacaaagaaagaccctatgcgggggttcta

SEQ ID NO: 484210 - DNA, 341 bp, Homo sapiens
ggagctgagataggcaaaggcggcggcagggtcgggggagcatgcggattcatcgcggtgtgactgcctttgatcttggcgaagttcaggatgcccagatcgcacacgatcagcgcgccgcccttgaagaccatcttcggcagcgaattcaggccacctttgcagatcgcgcgggcgctgtagctgacccgcttgccgccttccaggtactgggccagcaccgggtggtgcttgaggcgctggaattcatcgaacggcgacaggaaggtgttgctgtaggacaggtcgacgatcagcccgaccaccacctggttgttttccaggtgatgcgtccgtagcgg

SEQ ID NO: 484211 - DNA, 978 bp, Homo sapiens
tggctggtaccagctgttaattgatgatgactccaggcccctgctgaacgccttggtggtgggaggggcacaaagcgaaatggggcgtaagggaatgcttgaaggctgccccgtgatgtcggtcggagcttccaaactaggcgagggcagggtgaggcctcgggcacacagccggcgcccagtcacccggcccaaatggagggcggccggccctgcggcaggcacttgcccaggggggctcacactcacgcacactcgcaccgagactcaggggcgtctccacaattccaaccagtgcaaaatgacttagggcacaattaatttcagaagggaggggcggaaacagagtcgtggaggcttggaatctctcaggaaaaaacggcaaagacaggaaagctcagaacacaagagagacagacaggcttgacacacacgaccacacgagggacgtgtgtgtggcgagacggcgttcactccccgcgtggaggagcccagctctgggcatcgatgtgcgtggcgcggtgggctccacccgtccgccgcaggggtggttgcccctgtgaacgatgggagctcgccgagtgcgggggtggtgtcgcttgccgggcgccgcctgcttgtccccgatggtcgtcctcggatgatcggcgctgatgaggttcctggtcctctcgctccaccttcgagaagccggatcctgagctccggctagtgccgtggttctgtaaccgtgcccgcttacttccccttccccaagccaaacagggttctgcgcccggctccaaggcccccggcttgatcctgggtaggcccccatccctcccagttgcgggtccgggagcccggagggccgctattgggccccccgggggcaggcccacaccgcccggtctttcgccccccccactcaggtgtcggaggcggcgcccccgtgtcgcgcacagaccgtcgtgcggtgcccccgcacgggttcctccg

SEQ ID NO: 484212 - DNA, 400 bp, Homo sapiens
tttgccctccccagaatttttctttccttctttggaggaactttttaataaacagaatttgtcccttttttagattgggacaatactattctttgagtggttaccaaaaattacaacataaatccttgaattgccaacccctaatacaaattaccacttttacccctttttgaaaaaatctttaaacccatttccctacccccacccagacacagattttattgttgatttcattgttgccatttaaattaattttaaacatatttaaacccccccagggttggcctggtgtgggggttcatgcctgtaaccccagccctttggaaggccaaggcaggaagatcacttgaagccaggagttcaagaccagggtgggcaacaaatagaccctttttttcca

SEQ ID NO: 484213 - DNA, 386 bp, Homo sapiens
taccctagtccgactgcgccagtgatcaccttaatacttagacactctcctgaactgtgctcagatctctcccgtctcatgatttgtcccacaacactacctaaatgaaagatatatatagaagcatgaatgtgactgggcggggtggctcatgcctgtaaccctggcactttgggaggccgaggcgggtgggtcacctggggtcgggagttcgagaccagcctggccaacatggcaatatcccgtctctactaaaaatacaaaaattagccacatgtggtggcaggagcctatagtcccagctactcaggagcctgagacgggagaatcacttggacctggggagggtgcaggttgcagtgggccaggatcgcaccacctcactc

SEQ ID NO: 484214 - DNA, 112 bp, Homo sapiens
acaaggagcaggaggtgaactcccaggagtatgtcaccttcctgggggccttggatttgatctacaatgaagccctcaagggttgaaaataaatagcggcgttggatgcagt

SEQ ID NO: 484215 - DNA, 182 bp, Homo sapiens
tgtggatgactctacaggatccccaatgcagcggactcggcatcatatttatttgaaaaggtcaaaaggagtcatcttatcagacaagggaggggtgctaggctgaatgcagcgcctcaacagccagggaacatgtaggcctacacgagtcaggcacatgcgcggccaccacgtgtccacac

SEQ ID NO: 484216 - DNA, 382 bp, Homo sapiens
  misc_feature (30)..(30): n is a, c, g, or t
atgtaatagactcaaatggaatggacccanaatagaatgtactcgataggaatggactcgaatggaatttgttcgaaaagaatggaatcgaatggaatgacatagtatggaatggaatcaaatggaatggaatcgaatggaatttaatcaaatggaatggaatggaatgcaatggaatggaatagaatggaatgcaatggaatggagcagagtcgaattgagtggaatggaatatgatcaaatggaatggaattaaatggaatggactggaatcgaatggaattgaatggaatggacaagagcataatggaatcgaacaggacggaatggaatggaatggaatgtcgacgcggccgcgaatttagtagtagtaggcggccgc

SEQ ID NO: 484217 - DNA, 665 bp, Homo sapiens
cgtttccttgttagaagaactggtagcaagttcaatgctgtggttcttaagaggctttttatgagcaagattaacaaggctccactttctctctctaggcttgttaagtacatggagggcaaggatggaaggattgctgttttggtgggaactattacagatgatattagggtttatgaagtgcctacgatgaaggtttgtgctttgaggtttactgaaaccgccagggctcgtatcgagaaggccggtggcgagtgtatcacttttgatcagttggctttgagagctcctcttggacagaacacggttcttcttaggggtcctaagaatgctagagaggctgtcaagcactttggcaaggctcctggtgttcctcacagtcacaccaagccttatgtccgagctaatggcagaaaattcgaaagagccagaggtagacgtaacagccgtggttacagagtttaagcttgaattgcggatagaagagtttcagtgtttattgctcaagacttttgtcaatcaatgtgttaccatttggttttgtgtttcaaatatctttcttatatgttgggttagcaaacagaatgttagttatagcaagattgtcccgactactatttttgtcatcacttatggaggtaaattttgttgaagagattgttatc

SEQ ID NO: 484218 - DNA, 168 bp, Homo sapiens
gttcctcctttaaggaaccggaaactttaaaacggaaatcggtcccggccgttttaccggagcttttggtagctcaccagtagacaaacagagtttggaagaacgtttaaacgtggtgggcctcaccttggtgcccggccgggtttaagtgatcggaaacccagcagc

SEQ ID NO: 484219 - DNA, 386 bp, Homo sapiens
gggatgaagctggccaggattcctgcttctgaatttcttttctttgttttgagatggggtttgctcttgtccccaggctgagcgcagtggtgtgagctcgtgtcgttgcaacctccgcctccctggctcaagtgattctcctgcctcagcctcccaagtcgcgagattagagatgcccgtcaccatgcctggctaatttttgtatttttagtagcgatagggtttccccatgttggccaggctggtgttgaactgctgacctcgtgatctgcctgcctcgggctcccaaagtgcggggatgaccaggtgtgagccaacgtgcccggctctccttttcactttcttgatgccatcctttgaagcacagaggttataaatattgctga

SEQ ID NO: 484220 - DNA, 500 bp, Homo sapiens
cgggcatggacgaagaatgccgaggaagatagcggactcactgacggcaaagcggagccgtggcggacggtggtcccatgttcagcctccagagtgtaggtcaggatgatgtactcgccatgctagttgggtgttcccggcactctggttgtaacgacaagctacagctccacttgcacacaagaggtggacgtgcaaagtgcagggtacagaacagctggcctgggcatcaaggtcttgtgtacgatgttgcatcacgggccgggcccgcaggcgcacaatgtggtctgacaggatatcccactagaaggtctgggtaagacgttctcataccatatccatctgcccacgtgaggagacatagccaaaggtggccaacccagagcagtccccagcttctctccatggataaactgctgcggctgtctaaggagccccttagatctactgtgatacatgtacactttgcccaagccttctctctccactccgggtcacga

SEQ ID NO: 484221 - DNA, 665 bp, Homo sapiens
cttcgtattcatcaggagatacggatgtatctttacctctgatgacttcaggtgccacatatgccaaagtgccacagaaggttttcataaaagacccatttccttgtacttttgccagaccaaagtcggttatctttaccaatacaggatcgtcttgttcaataagaatattatcgggctttaggtcacgatggctgatgcccatagagtggatgtattttattgctgtgagtatctgcctggatatctccctcccagcatcttctccaaccgcaccatgagcagcaacaaaatccattaagtcaccaccagaaacgaactccatcaccatataataactctcagtatcttcataaaatcctttcaatcgtactatccttggatgattgagcttttgcaatacttctaactctcttgtcacaccatccatattgcctattactttgcgtttacttataatcttcaccgcgaatgttttcccagtagttctttcaatggctttctttactgtggcaaatgcaccctggcccaccacttcgtcaataatcgaaaaatccttaaaaataccagtcttgttggccaccattgatgatgcagtagatgatgtaagaccaggagaagctattttagaggtatttttcaggttagatcttatgcgatcaact

SEQ ID NO: 484222 - DNA, 303 bp, Homo sapiens
cgtcgacggttatgagaaccgtatgtggcagctagggaatactataacaaaatgccacaggctgaagcatctgaagtacctgaagcaagagaaatcttacaggtcttgaagctggaagtgcaagttaaaggcctctgagacctccttcctggctttgcagttggccatcctctctgtcaattgccatcaaatacctttaatataagaaaaatacagttgttactaacttggcagaaagatatgataaagaaaatcacagatgaagccagtcgacgcggccgcgaatttagtagtagtaggcgg

SEQ ID NO: 484223 - DNA, 381 bp, Homo sapiens
cggcacgaggtgtgacaaaggcactgttcctccaacaccagtcgtgggaaaggcatatgatatggtttggcactgtgtccccagccaaatctcataatgaattatgagcttcagtgtaggaggaggggcctggtgggaggtgactggatcatgggggtgaatttcccccttgttgttctcgtgctagtgagttctcatgagatctggttgtttaaaagtgtgtggcactgccccttcactctatctctttcctgccgccatgtgaatatgtacttgcttcccctttgccttccaccatgattgtaagtttcctgaggcctccccagccatgcctcctgtatagcctgcaaaactgagtcaattaaaccttgtttctttata

SEQ ID NO: 484224 - DNA, 677 bp, Homo sapiens
ccacagtacacctttatgacttggcgatgcgggctcttttttggttccatatgaactttaaagtagttttctccaattctgtgaagaaagtcattggtagcttgatggggatggcattgaatctataaattaccttgggcagtatggccattttcatgatattgattcttcctatccatgagcatggaaggcttttccatttgtttgtgtcctctcttatttccttgagcagtggtttgtagttctccttgaagaggttcttcaatcccttttaagttgtattcctaggtactttattttctttgtaacaattgtgaatgggagttcactcatgatttggctctctgtctgttatttgtgtataggaatgcttgtgattttgcacattgaagaagttgcttgccagcttaagaaaaacctcctgagacgacggtgctttctatatatacaatcatgcatatgacatttattcttggactttacctggacacagccactgcatagatattccggttagcggatgctgatcctcatatatacactatcaattgcacgtcgcccagaacattgtagagccttcttatgcttcacttttcttacgtgaccatgattacctactagcccgagccttatggctcccttcacacctgacttcgcatttgtcgggcccattactc

SEQ ID NO: 484225 - DNA, 422 bp, Homo sapiens
cacacacagtgtataatcttgaccctttattatggaacttaaaaatttcaatcataaaactcatcaacgtatcacaaaactgtcttatcaacttctccccaggtgccgctgtgtgagctattacatcaggtcctccgtggttcctggaccatttaataacggctatttaggcaaataaaacctctctaccactctgaaaatagtattttatcaaacattaggagtctataccattgtattctattctctccacaagctatttccagtgccattaactaagtgccaactaactcttgactgaaatactggtttattctaaactccttattttgtccccagtgctaatcctactcacgtagaagcagcaggaagcatctagaatatcctgctacctggttttctaggcaacaagctatgaacag

SEQ ID NO: 484226 - DNA, 659 bp, Homo sapiens
  misc_feature (77)..(77): n is a, c, g, or t
  misc_feature (85)..(85): n is a, c, g, or t
  misc_feature (126)..(126): n is a, c, g, or t
  misc_feature (181)..(181): n is a, c, g, or t
  misc_feature (201)..(201): n is a, c, g, or t
  misc_feature (236)..(236): n is a, c, g, or t
  misc_feature (652)..(652): n is a, c, g, or t
gtgctcttcgagtgtattgtgttattaaccctcatgccattcccatgacgcctgtgcataggaggaatctgggaccnagagaggngggacggtaggcaggtctgatgagcagctgtgggtggtccnggtgggagctaaggagcaggcagcctgaggccaggcccattcccaatcacatgtngtactgagccagccaccacnttagattttagagtctcctggagcacgtgaaaacnactgaaaaagggtaaccacacatcatttcacttgtgatgtagcttgcctgtctccacaccatgcccctgaagaatagtatatcacctacagccccttccccagtcaggaatggaagtgcatgacacatgtgctcctctaccccttccatgctcatggcagacatcattaatcaattatagcactctttctgtagagccagagacagcatcacactctttcccctcctgcattccagggccaccactaccaactgaaatcgtgttagtaccataatgaatgctatgtaccattctctaccctaaggcgattgcaaactgtaaaatgaattgttgctggatttctgaggcccctcctaggatttggggggtaaattcatttcttgttttcaggaacacagggggatagggggacaccntgtggca

SEQ ID NO: 484227 - DNA, 670 bp, Homo sapiens
ttaccaatctcacttctaggaatactagtatatcgctcacacctcatgtcctccctactatgcctagaaggaataatagctatcgctgttcattatagactactctcataaccctcaacacccactccctcttagccaatattgtgcctattgccatactaggtctttgccgcctgcgaagcatgcggtgggcctagccctactagtctcaattcttccaacacatagtggccttagactacgtacataacctaaacctactccaatgctaaaactaatcgtcccgaacaattatattactaccactgacatgactttccaaaaaacacataatttgaatcaacacaatcacccagcagacctaattattagcatcatccctctactgattttttaagccaaatgcaagcaagcaacctatttagctgttccccaatcttttcctccgaacccctaacaacccactgcctaatactatgctacgctgaactcctatcccctcacaatcattggcaagccatcgccactttatccagtgaaccacctatcactaaaaaagactctacctctctatactaatctccctacaaatctccttcatttatgacaattcacagccactagaactaatcatatttttctatcttcttcgaagaccacacttattccc

SEQ ID NO: 484228 - DNA, 951 bp, Homo sapiens
gcaacctctgcctccggggttcgagcgattcttgtgcctcagcctcctgagtagctgggatcataggcgcgcaacaccacgaccagcactttgggaggccgaggcgggcggatcacgaggtcaggagatcgagaccatcctggctaacacggtgaaaccccgtctctactaaaaatacaaaaaaattagccgggcgttgtagcgggcgcctgtagtcccagctactcgggaggctgaggcaggagaatggcgtgaacccgggaggcggagcttgcagtgagccgagatcgtgccactgcactccagcctgggcgacagagtgagactccgtctcaaaaaaaaaaaaaaaaaaaaagaaaaggggcctgggataatcgtcagggggatggtaagggaactatattagtatttagcatgtcaaaccctctcccatctcagttggtgggcacgggcttaaaaaaatacctttatggagatataatttccctatcattccaatcactagcatgggtgatggcctaatggtggtacatgtgggatactggggcctaaaggtccgggatcttctcccaggtagatgctactgcctttagaaaacaatggaaagcttttaacactataataggggccacatgttctgccctctcctatttttaccagagtcaggtcacggtacacaataagcgcaggaccgaaattccccagtaccgaagtgcccgggtgggtgacagggtcatgactgtaatccacccttgaaagcgacgagggacaatgttgagcccaggcttggcaccgctggccccttgggactattctacaaaaactttatcacaaggtccggcgctggacccgccgaccacttgcggcggggggcatgaagacgaggactgccagggacgccttccaacaatggggggccctccgcgcgaaccacgggggcagcccgagcac

SEQ ID NO: 484229 - DNA, 920 bp, Homo sapiens
ggatgaacgaggtgccatgggaccagacagaactccagccgttccaaaataacagcacagtagctgtatgggccactgggggcaggacagtgtcagctccttcctcaggagcacagctgtatggactccaggcgggtccgtcagtaagcttagtgctgtgagggctgtaggggaccccagtggtgagtactgtaggtgtccaaggtggtgatgtacgcttgctggtatgctattgtcactttttccacactacggagaaagttccttctggttttcagctgatcttggctgggggatggggttgtggagacccaggtgttccattctctgcttggctatcctgagtttctatgctcaccagagttcttggttattactttgacgatattctggtgctttcctttagttatttgcgttaaagactgtattgctgatttgatttgggctctgtggggggtggggagaacaagcatgtacggatcgtgtaatctgcttcttgctgtaagtcactctcttgttaccagatatttggttggaaaacattttcattgtgtattctgttaaataactaggagtaggaatggtggtccatatgatatgtgtatatttagcggtataggaatggcaggtgtttgcacagatggctggtccagtttggatttctccaccaagtatttgtgggagctcccgtccttaatctttttggacccctggtttggttacactttgcgtcttcacttcaccgctgtgtgcgggctcccggtggcccacttctgctggaagtcacggttggccctcccgcttccgggactcctcgtcttccccctttttcgacagacgcccgtcgccgcggagggaaaaccacccccgtgatctgcccccaggtccccccattttgttggtgcgcgttgtcccgttct

SEQ ID NO: 484230 - DNA, 509 bp, Homo sapiens
  misc_feature (11)..(11): n is a, c, g, or t
  misc_feature (24)..(24): n is a, c, g, or t
  misc_feature (81)..(81): n is a, c, g, or t
  misc_feature (209)..(209): n is a, c, g, or t
  misc_feature (212)..(212): n is a, c, g, or t
  misc_feature (286)..(286): n is a, c, g, or t
  misc_feature (507)..(507): n is a, c, g, or t
aagaagctggnaagaaaaccctanaatctttcccccagtgaccagagacctagaaacacatttcaggaagacactttaaanagtgaaaagttttgcaaggatgaaaaagagttacagagatggatgatggtgatggtcaacacagcatcatggacgtgtttaaatacccactgaactgtaccccttgaaaaatggttaaagatgagtcntcntctgctaccccaggctggagtgcagtggtgtgatctcggctcactgcaacctccacctcccagattccagtgantcttctgcctcagccttccaagttacctgggattacaggcgcctgccaccatgcccagctaatgtttgtatttttagtagagacgggtttcaccatgttatccaggctggtctcgaactcctgacctcaggtgatccacccgcctctgcctcctaaagtgctgggattacagcatgagccactgcgcccggctgctttatgaatattaaaactgctaaaanaa

SEQ ID NO: 484231 - DNA, 342 bp, Homo sapiens
ttccaatttgtggctcttgtcattttaaaattaaatttgggtttgccatttattatttttttctagaaattctcgagtctgagaatatgagaatagagttggcctaggttcatacattgttttgttctcaccagataattacacaactttttcttcctattccaaagtaaccagtgttggggagtggaaattactgtggttaattttaacaccataatttggtggaaaaaaatttgggttttgggagccaagtttaaaaactaagcttttggcacttattgcctttaggactatttctataaccctaattaaaaacttttgaactctttaattttagatttt

SEQ ID NO: 484232 - DNA, 232 bp, Homo sapiens
cccacaatgacagcatgtctcaggcttttcaatgctgtgagagactagcatcaggagcccgggcacttgtcgctggacgcagtgctgagatttgttccctccttttccacctaagcgtcttcctcctacacatcacagtagcgaccactcactcctataaccacaactgctagtgcagccaggccagcgacaaatgccccaccaatggtggaatggtgtgactggttaaaat

SEQ ID NO: 484233 - DNA, 950 bp, Homo sapiens
ggcgggtgaaggtgtgtgtcagcttttgcgtcactcgagccctgtggcgctgcttgctaaagagccgagcacgcgggtctgtcatcatgtcagcgttacggcgcggtacggaggagaaaccaaggtgtatgttcggtcaacctgggacacttggctgctgcgcacaaggagcagtccagaaatgggcttctcagcttattcatggtcctcttaagacactgtactggattgcagagcaaatcctccaggactttgcctattgtgcgaattcgcaagactcctagcagatgcagacagatgcagctacgaggcactgcgatggacactggtgactaatgtaggctcccgacgtgagggttgaactatctgacaggcatgcctcaggacatcaacgtattgatagaccaactgcccgacgtcccttagatccaaatgatagatgctactgagtgctggcgaaaacgggccactcatgcttttcatgacttgtcatcgttacagccggcgaacaagacacgcaggtcccggactacaatcacaatctcgatcccaacggcaaggcgaacctcctacgatcacgcacacagggagctcgggcgaccgacgggcccaggacagcatcctcctccgacgacccccgacccaaccaccagcgtcagctcagcatcagccacactcacaagcacccagggctggcgtcctctacgaaggcacggaggccatacccactcacgaacgcagccaacgaatcaagacccaggaccaatcaccggacaacgaccgccgccacccaaggtcccgactctcaacaccaaaagacaccgaccccacagggagagcccaacaatggagccccgaccgacggaagagaaacgcggatacccttcgcagacagcggggcgacccaaacagggcaaggcgctgaacagcgcacacaggccatcaaaagg

SEQ ID NO: 484234 - DNA, 888 bp, Homo sapiens
  misc_feature (487)..(487): n is a, c, g, or t
gtttttaagaaatagactgaattcagctgttaatcctctagtacagtatccatgttaaaatgtttttccattgcatcttttatgtgaattcaaaggtcagaatttatgtctgtgatattgagaccatgtgtacaagaactacttttggcttttcatcattcactccttagcaaacgtttcgtaagtaccctctgtttgctactatatgaggtgctgcgaaattagtgggcgtggcttttatatttttcattcgggtgtatgcgctcaagtgtggggtgttctcgagtatgataccgcgagagaaatgctgcaaatttatgtggtcctcattgctgtgctgtcgtttcctttttaaagacgattatcaatgctgccatttggaacttcctataagaaactaaaaatgatctatttcagtgttcctttcgcctttcctctgcttttctgaataaatggtttcagtaacccatgctgttctctccctatnctacgtctttctccctatgttgaaaaaagattcccacaggttctgatgtgtgtgttatagtcttcatgtatgttaacatgttaggaactgagtattttaagagatgtcttaaaatgcttagtttcataatgtccttaatgtatttcattgattgtgttgacatgagtattacaaggggtgcggaagactctactgtgccattggttctgaatgtataatccggttgggggatgatgttccaagagggtgatttggcgccacacaagacctagggtttccgtgcaatagggggaacgcggcggaaaatggaaggcatttggattgggtataaaaaaaaaatgggccaataaaggcgggagttttttttttcttccgctgtattgctgtggcatcgggaggga

SEQ ID NO: 484235 - DNA, 574 bp, Homo sapiens
atccctgagaatccaaaattctccgtgccacctatcacaccaccatcctgaaaaaaaaaaaaaagaaaaaaaaagaaagaaaatggcggggcgcgcactggagccatagaaaaagttttgccaagaaccgatgccgggttggggggcgcggggcccccaacgagcgtacatctgcgagacgcgggcacagcagcgatgatctcgaaggaacaccggggccgcggcacagtgggggggagctctccacgaccatgaaaaagcggcccggagggcgagaccgaacgggtgcgaagatcaaagtgccatcgaggggagcgctcccgaggaggggtcagctaacggggagactcatatctacatagcgagggagcgctccaagggcggagcgctccgagatatatctacaaaatttagcgcgccgccggtcgggtggggaaggcgggggcacacaaacaagggaaaaacgacaaaaacaaggggacggaacaaagacgtggaacccaaaagaaaaaacacaccggggtaaaccaagagacagagcagtcggcggagaagaaccccccgcgcagaaaga

SEQ ID NO: 484236 - DNA, 1074 bp, Homo sapiens
  misc_feature (553)..(553): n is a, c, g, or t
gggttcctgtggtatttcccggatgttcgtttcgacgtgctgcgggcgtcttgtgtgggcttttcccgtccccggcaagttcgagagtcactagggtccggattgtcccggtgaaccaccggccgtgataaatgttggaggccctctataggcattttcgtcaactcggccggtatcccagttctgccaattgcagtctatcacaaggcgtgctgttggcccaacctcgcagggcaccggtacacaggggatttaaaggaaattgtcgtaggtatgaattccgggaaaatttgagagccagaccctctatcgcattaggatgcctttggtggaagattctttgtccattgccaatatcactagccagctcttattaagccaccttaggctgtttctcccccagcctcccttcctcgtcctgttcctcgtgcgccaaatttttgcccagatacccctgtggttaggtcccccgtgtccagtgtgtgatagaattaggaacacccctgggactctgcccagtgttttagacttgcatggaatagtagagtgtttntggtcccagagaccatcccaggaatagtctcacccaccaggattgaacacttttagcctccagatttctcaacccattttgcccggataattctcccgaatctcattgttttagcattgtctcttctctccctccccttgttgttctttctctttctctgttccgaaagcgtgctggatatattcttcccaagggaggcgttttctttagcgtcccgaatctcaccatattgtgtataatagcccaccagattagggagagtttcttttctttccaacatgtctcagcatcccacacatacgccatccctgcgtacatttctttccattgacatcccacccatttctgtctgtatcgcgtccagcctgtctctggcccaacgttctgcctggtgaccacccagatcctttctgatcatcccatagccggccaacggctcccggccagggtttgcgcgaccggatggaaacggatagtgtctccgactctttcagcctttcgctccgcgtccgggccgacca

SEQ ID NO: 484237 - DNA, 449 bp, Homo sapiens
ttctagaggatccctccatttaggtccacttgtatgaacaccgtgtgctctcctaacaaacacactccgtgatgcgttcggggcctgtgcgcgccgctgcatgacctcagctgtctcaaggcagcatctccgtactgaatacctgagcccattctttctgggtccagctcacctgattcgatttcgttaagtatttttcttgcacactgtacaaaagcctcttctacattctcccctgtgagcgcacttgtatccaaaaacatcagctcattttcttgagcacatctggaggcttctaagaaggtaacttcacagatctgcatccaggtccttcttgtttccacaaaggatgatcacaatgttctggctcgctagcattcgtgcatctggtgatatcatagacgagtgatgagccccggtgcgcgcctcgttaataacttctcgtcagg

SEQ ID NO: 484238 - DNA, 232 bp, Homo sapiens
  misc_feature (129)..(129): n is a, c, g, or t
  misc_feature (153)..(153): n is a, c, g, or t
ttttttttttttataatgcaagcccttgcatggcaatccaaatttattgaactactgatgctaagttatacaaaattgcaccactttaattaaggcttttagtttacatttggccacctcaagtagttnaacattaggaaggtcaatttaatntgtgctcctgtttgatagacacacacttcatcaacatagcatacaagcacagcatgaaataacagcatgtcgcatagct

SEQ ID NO: 484239 - DNA, 309 bp, Homo sapiens
tgcgggtgatctagaggatcccagcggcgcccttttttttgagatggtctgctctgtcgcctaggctggagagcagggcaagatctcggtacactgtaacctccacctcccgggttcaagtgattctcatgcctcagccactcaagcagctggcattacaggcacctgtcaccactcccagctaacttctgtattttcagtagagatgtgtttttttgtttgtttgttttccttgagacatagtcttgttctatggcccaggctggagtggaatggcgtgatcttggctcactgcaacctccgcctcca

SEQ ID NO: 484240 - DNA, 1521 bp, Homo sapiens
  misc_feature (575)..(575): n is a, c, g, or t
  misc_feature (581)..(581): n is a, c, g, or t
  misc_feature (972)..(972): n is a, c, g, or t
tagataccaccagtggttgtttggtttgtggcgggctacctccagccagccacagtggttgatttggccgcgggaggctttgtttgctgcggttctctggtgtatttcgtctttctaatattgtggtggtagttttcagtcctctggctgcttgcgtagtgggttcgctccgctctcggcgcgtccttcctttgtgtgagggtgttctcgcacagtaggtgtgctattgttggtcgcacagctctgccgatctcactggaggcgtcgtctataacgtgtatatcttatcgtcgtccgttttgtggaatattatcagggtgttggggcgttgcactgcacagattaccctcgtggtgtgacggttcctaactcgtgggtggcaccacccctggttgcgctcaggcgtccgcagaaatggtgttgggagatttatgttgtcccgacagggctcactcgtgtgttgtttttctgcaagcccgtagatttttcgtggggccgcccgccgtaccagtgtggtggggtccccaccccgcggcccgcggaattgtgcgtgttgtctgattaagccggcaggntcttcncctctgtcctaccgcagtgttctgcgaattgctcatccttattgttgtgctcggcccacaaggggtgttaaatatggagggaatattataggatagagtatgttggtgccccccctcgggggccgccacattagggcaacacacacacacctcttcactgggcttaaggtacgttctcacgcggcatataatacttggggatataaaagatgcccctcttccgcagctatataagaagatatatagtggtgctacccctctggaagagatgctctttgttgtattttctcgagatagatgcacagcgcacactcgggagattgtgtatagagaactgctggtgttggctcgaggatgttgtggacaacctcggtatatattggagagagtntatacaactcggtgttctccactctcgggtaaattagaacgctgggttcacgcggactcgaatgatgttctcgcggaatttcttcttaagaggcttggccaagagacccacggttgtgtttgttctatttcacgggtcttgtccaagggtgtggataatagtctccaacccgtatggagcacccacattgtctcctttctttagcctgaatgtctatttggcccagagacccccgttgggctggtgtgacattgctgttgtaatttggaaccggtgttgccatatgtacacgcccggtggaatagtgatatgccattgttgtaatattatagtgaagggttttttttgtgacacgccatatttcggatatctttgaaaagatagacccaccaattttggttttttactgttaactgagaaccataggcgccccagccacacgtccattgtgtaaggaaaaattaaagtgctgccggaactaccaaaaaaataagaaaaaaactcgagcataaacgtcggtcgagaagtaattagtggtcatctggtata

SEQ ID NO: 484241 - DNA, 120 bp, Homo sapiens
  misc_feature (63)..(63): n is a, c, g, or t
accctttcacagtacgtgttgtcccggtactcacgccttgcaactactgttacgacgactgtnacctgtctgccgcacttttgcaccggtttttcttcttttgactttactgacttacct

SEQ ID NO: 484242 - DNA, 322 bp, Homo sapiens
catggtggcaggtgcctgtactcccagctacacaggagtctgaggcaggagaatggcgtgaacctgggaggcggagcttgcaatgagctgagaccgtgctactgcactccagcttgggcgacagagcgagactccgtctcaaaaaaaaaaaaagaccgcgtcttctctacaaaacattgaaaaacacctacgcaggggccttagttgttaccaaccctgtgtagttcctcaaccttactgtggacaggctgaggcaagaggattacctggcttgcaggtgaccctgtgataattgcccaagttgcaccccccagtctggcga

SEQ ID NO: 484243 - DNA, 350 bp, Homo sapiens
ggcaaggggctcagatggagtaggtgcagagaaggggagggggttttatggaggaggctcagaaaagggaagggggtgagattgaggaggcgcagtgaagggaagctgctcagatggaggaggcgcagagaaggggaggtgagcagatggaggaggctcagagaagggaagggactcagatgtgaggagggggcgcagagaggagaaggttctcagatggaggaggaggccctgagacggccaggcgctcaagatgggaaggtggccctggtaggactcgactctgcttctgaaaaagcggctgagttttcagggtgaaggattgcagtctgcaggctgggatcccccct

SEQ ID NO: 484244 - DNA, 104 bp, Homo sapiens
taagtgatttgtgaagaacgacttctcgtgatctgcaacattatgctcacagttggagcaacttttgagtagagctcatcctctctatgatctctcttaatttc

SEQ ID NO: 484245 - DNA, 604 bp, Homo sapiens
atcagctcgtacccactatgtgatgggggtatgctaacgtcacccttcagaggatggccacggggactgttagttcgcaatgctggttttctagaccagtgagctggaagcatggtgagcaccgttatctggacgctcaggccgtgtcgggctgcagctcatcatccaccacacaggtgcagcatgacgctgtctggtagtcgcccttagttgtcttgctggatataatagtacagggacttgccgtagcttgctcttgaattcagacctaattttcaacatgtccacttcactgcgggagaccatgattctgatcaggaccttatctcgcgtccccttgcccttcatggagtcatacagccgatcagcaaaatacaggggcttgttctgaatgcactgaaccaggttcaggaaagcattttccaggtctcctttaacctctttcctgatgctttccaacatgtcataagggctgtaactcttgtacctatcaaatactttctggaggtggggcacgctccgctcggtcatgatgctgatccacttgggaacatcagttcctttcctcttcactccagcgtcatagagatcccgagccaatcaa

SEQ ID NO: 484246 - DNA, 410 bp, Homo sapiens
tatggactggatgtcccgcattgaagtgcggaatcaggtggagtggggttcggatcccccatgtcctctgcagaagtcctcaccagcctaccggtgtgagtgtcccggtagtaaactgccgtaatgaaaccgagctagaatctggaatctgttatttgtaatctgtgtgtacagaaaaaagaaaacaacgaagtcctacatgagaacgtgtgggaaaaacgcaaccaatatgtataaatacggatgcagaatgcataaatgcatgtatatgcaacctaatcggagaattaagccttccatttttgttcattaatcacttagtagttataatcacaaaaacggtgttattattgaaaacgacgacctggttacaatgcgagagtagtgaaaagattagggtaccgagctcg

SEQ ID NO: 484247 - DNA, 480 bp, Homo sapiens
gtctgtataggctgtcatatatgtagtaggactggaggtgctctgaattgagtcctagtaggactctggcgtttgaggcttcgggctgttgccaagcaagaagacatttgctctttgcacaggtgcgggggtggggagggaacgcccagcaacagaaatcccccttgcctccctcaggaggccctgttacttttgcaggctgtcactccgacatcagagccactttcctcgtactcttcaaagcttcctaagtgccattcaaacccataccacccactggggcagactgcccttcctaaagttcacatcacgtgcgagctcatggtcttctgcagatcctcacataccaccggggctaaatgccagtgcctttgacaagtgtccagggtcccttgctgcatgactgggagcagcttttccaagcctgtcacctacttcccctccaactgtggctttacttactgccaaaccccatgccgg

SEQ ID NO: 484248 - DNA, 472 bp, Homo sapiens
cagaggcacacgaggcaggagtgaatcatacctgccactcatccatccaggcgtgacccatgcggcaggtatctggatgactggcagagtctggtgaagaataggtgctcagatgggtatgcgagtggtgtctgacctggctcacaaggtatgggctgccatgattgccttcccgtggccctcatcccggctggcatccccatgtccttgacttggcccccagtctcaggtgcctatgtggacttccaatcaagatagagtccatccattcctatccccagcatggcggcttccagaagaagtatgaagcagagcttcaccaacccagcccatttctgctgcaaccggaaagcccagcttttgatctcacgcaggctgaaaagctccagccctgtcaacccacggctctagctgaaagcgcccacaccggtgacacgcgccagtggctagtggccaagctcagtcctcagac

SEQ ID NO: 484249 - DNA, 271 bp, Homo sapiens
  misc_feature (135)..(135): n is a, c, g, or t
  misc_feature (213)..(213): n is a, c, g, or t
  misc_feature (221)..(221): n is a, c, g, or t
  misc_feature (253)..(253): n is a, c, g, or t
gagcatctgctccagatggaaaatgggtaaggaacaatcaaattcaattcgggaagaatatagaggtggtaataattggtaaaagtctgcagggttttttttaaccaaaggaaactggtttgagaaaattgtganatcagcattgaaatttgttacctactccaatcaagatttgcaaactacaaaaaaatcattctggaagcttttcacctntaaatatntaccaaggttaatttcagataaggaatgtccngcaagggaggtggaaggc

SEQ ID NO: 484250 - DNA, 334 bp, Homo sapiens
aaggcagatcgaaatcatggcaggtcccgaaagtgatgcgcaataccagttcactggtattaaaaaactatttcaacacttctcctctcacaggtagactgaactgtgtactggccacatctggaagcattgcattgacttgtctactctttcaagttaaggtccacaaaaaactccagctgtgaaagccacatcactggactttaaacctgtctacggttcttaccctcactctgttaagttcccatgcctggagacgctacatgccaactcactcatgtgataattcaactttgtacaatacaattatgaccccggaacgacgaaaactgat

SEQ ID NO: 484251 - DNA, 136 bp, Homo sapiens
agcagaattcactctggtgagtgtagactcggtcacacaatgcctcaggcgccatccacttcacgggcagccggccgttggttgtcttcttgtagtaatcgaggttgttgccgttccgggccagcccgaagtctgc

SEQ ID NO: 484252 - DNA, 532 bp, Homo sapiens
agatccctttccatcccttttctgtcacatcatcaggctacatattttccaaactcttacgctctgctacctcttgaatgctttgctgcttagaaatttcttctgccaggtaccctaaatcgtgtctctcgagttctagttccacagatctctagggcaggggcaaaatgccaccaatctctttgctaaagcatagcaagagtgacctttactccagttctcaacaggttcctcaaatctgcatctgagaccacctcagcctggacttcattgtccatatcactatcagcattttggtcaaagccgttcaacaagtctctaggaagttccaaactttcccacatctttttgtcttctgagccctccaagtctctaggaagttccaaactttcccacatttccctgtcttcttctaagtcctccaaactgtttaaacctctgcctgttaaccagtgccaaagtcgcttccacattttcagctatccttagagtagcaccccactcccagtaccaatgtactagattaatctgt

SEQ ID NO: 484253 - DNA, 228 bp, Homo sapiens
  misc_feature (38)..(39): n is a, c, g, or t
atctatcagctctcattcgtgactcactcagaataagnnattccttattcaaaaaacaatgtaagtattccgacccaactgttctcagccatgaacaaaaaaaactatggccaggtgtggtggctcatgcctgtaatctcggcactgtggaagtcaaggtgggaggactgcttaagcccaggagtttgagaccaggctgagcaaccaatgagaccccctccccggccg

SEQ ID NO: 484254 - DNA, 219 bp, Homo sapiens
gtactgccaacacgtcccacatccatttcttcatctcgtctgctctggtcttctgtgtgtcttctgcgtctcttcaggttcttcttcaggctcttcttccacctttgcatcagggctcacagttcaaactgaggcgaagcattctttctattctatctccatatgctttagtgtctgataaaacagtttgggatctggctgtggtttggtttgaaacag

SEQ ID NO: 484255 - DNA, 280 bp, Homo sapiens
cctcgcgggaatggcccgcgtgtccattcttgctcgcgcccatacttgtaaatccaaaccagcgtaccacacagtgtgaactctgtataccataaatgtgaatgtcgaaacaatgtgacactccgattgactaatctttaaatatcacatataacatagatgtaaaacataactttacaagagctttggtaaaacaataatgaagaaataatagccggaaacagaaaggacacagaatctcactctgtcacaaaggctggagtgcagtggcgtgatcttg

SEQ ID NO: 484256 - DNA, 125 bp, Homo sapiens
gactcttgaggatccccctcccaagtgatgagaaagttgtcgtcaggacaggtcagatgcataaggttatacaggtgctgcagattgtccacaaccagcaatccattgtgactcaggtccagttc

SEQ ID NO: 484257 - DNA, 561 bp, Homo sapiens
  misc_feature (28)..(30): n is a, c, g, or t
  misc_feature (33)..(33): n is a, c, g, or t
  misc_feature (37)..(37): n is a, c, g, or t
  misc_feature (39)..(39): n is a, c, g, or t
  misc_feature (41)..(41): n is a, c, g, or t
  misc_feature (47)..(47): n is a, c, g, or t
  misc_feature (104)..(104): n is a, c, g, or t
  misc_feature (215)..(215): n is a, c, g, or t
  misc_feature (238)..(238): n is a, c, g, or t
  misc_feature (295)..(295): n is a, c, g, or t
  misc_feature (309)..(309): n is a, c, g, or t
  misc_feature (322)..(322): n is a, c, g, or t
  misc_feature (332)..(332): n is a, c, g, or t
  misc_feature (354)..(354): n is a, c, g, or t
  misc_feature (490)..(490): n is a, c, g, or t
  misc_feature (492)..(492): n is a, c, g, or t
  misc_feature (504)..(504): n is a, c, g, or t
  misc_feature (516)..(516): n is a, c, g, or t
  misc_feature (519)..(519): n is a, c, g, or t
  misc_feature (531)..(531): n is a, c, g, or t
  misc_feature (559)..(559): n is a, c, g, or t
tttttttttttcaacagtgtttgatttnnnttngggnanangggagnctttttatgttgcccaaactggggggcagggactagtcacaggggcaattatagggnactacagcttaaaactggtggtctaaagggatccttttgcctaaggctccccaaaagctgggattacagggacatgccagggcgtttggctccaatcctttaatttcaaangggaaggattacatataattctntcaaagggtatactgcttttattttaaataaacataaaaagagcgcaaagccaccgntttttttacaaatntccattatgaacncaaatggggnctttgcaaacttcaaaaatgtntcaaaccctaacctgggatctttagggccattgatcaattttgggcatacaggaagcactcaataaaagttgttgaatgcatgaaggaatgcataaatgttctttttggatatttagccttactttcccggcattnancttaaatgaccngagaagcacttnctnaaaataaccctntggctcaccatgagaagaatgcctggcnct

SEQ ID NO: 484258 - DNA, 261 bp, Homo sapiens
tcattaccgtccgggcataagagaagtgctcttccgacggaccccatacagtcatcaccccgtcacgggacctcagagagcagcgccacttacgacggaccccatccagtcatcacccccatcgatggtacaccggagatctgatgtcactctcctcgctgaagccctggtgactgtcacaaacatcgaggttattaattgcagcatcacagaaatagaaacaacaacttccagcatcccatgggccatcgagacgagaga

SEQ ID NO: 484259 - DNA, 204 bp, Homo sapiens
agccgcacgacggtcaaagttctgggattacaggcgtgagccattgagcctggcctatttttattttatagagataggatctttctatgtcgcccaggctattctcaaacctcctgacctcaagtgatcctcctgcgttggcctcccaaggttctgggattataggcataagccactgcacctggcctggtactttaagaaatt

SEQ ID NO: 484260 - DNA, 300 bp, Homo sapiens
  misc_feature (40)..(40): n is a, c, g, or t
  misc_feature (77)..(77): n is a, c, g, or t
  misc_feature (86)..(86): n is a, c, g, or t
  misc_feature (124)..(124): n is a, c, g, or t
  misc_feature (128)..(128): n is a, c, g, or t
  misc_feature (131)..(131): n is a, c, g, or t
  misc_feature (136)..(136): n is a, c, g, or t
  misc_feature (157)..(157): n is a, c, g, or t
  misc_feature (178)..(178): n is a, c, g, or t
  misc_feature (187)..(187): n is a, c, g, or t
  misc_feature (193)..(193): n is a, c, g, or t
  misc_feature (201)..(201): n is a, c, g, or t
  misc_feature (228)..(228): n is a, c, g, or t
  misc_feature (231)..(231): n is a, c, g, or t
  misc_feature (252)..(252): n is a, c, g, or t
  misc_feature (279)..(279): n is a, c, g, or t
  misc_feature (293)..(293): n is a, c, g, or t
  misc_feature (297)..(297): n is a, c, g, or t
gcactgcttattacaattttacgggtctctattttacccncctacaagcctcagagtacttcgagtctcccttcacnatttccganggcatctacggctcaacattttttgtagcgacaggctnccanggncttcncgtcattattggctcaacttncctcactatctgcttcatccnccaactaanatttcnctttacanccaaacatcactttggcttcgaagccnccncctgatactggcattttgtanatgtggtttgactatttctgtatgtcnccatctattgatgngggnctt

SEQ ID NO: 484261 - DNA, 261 bp, Homo sapiens
gccagtctatactagaaaatatccgtgagatctttctagggtaaaaggacgataagtgcacagagttaaaattaaactcatttaatttccaggagtgataagcatagggacacattactcaaatggatctggaatcccattatattccaagaaatctttcttgatacaatatggatagagtaggctataaatggacatatcttcctattaaattgccaagcagcaaccccagaacccaacattccattcttttgtctaata

SEQ ID NO: 484262 - DNA, 136 bp, Homo sapiens
gtccgtgacattaggtgattgggaaggtaacatctgtgctctcatcgccaaagctgactgtcttgtccccagtgagatccggaagctgaaggagcggatccgggaggagattgacaagtttgggatccatctacta

SEQ ID NO: 484263 - DNA, 100 bp, Homo sapiens
ggatagatgggaaggggaacgttgtatggattaaatgagtatctttggaaagtgcttacacctgagcctggagcaagtccagagctcagcctcctgggtg

SEQ ID NO: 484264 - DNA, 513 bp, Homo sapiens
  misc_feature (37)..(37): n is a, c, g, or t
  misc_feature (70)..(70): n is a, c, g, or t
  misc_feature (84)..(84): n is a, c, g, or t
  misc_feature (117)..(117): n is a, c, g, or t
  misc_feature (133)..(133): n is a, c, g, or t
  misc_feature (136)..(136): n is a, c, g, or t
  misc_feature (162)..(162): n is a, c, g, or t
  misc_feature (388)..(388): n is a, c, g, or t
  misc_feature (395)..(395): n is a, c, g, or t
  misc_feature (398)..(398): n is a, c, g, or t
  misc_feature (409)..(409): n is a, c, g, or t
  misc_feature (413)..(413): n is a, c, g, or t
  misc_feature (422)..(422): n is a, c, g, or t
caaaaggggttgaacccgccttaaatagcaccgaccntatgggcaaatttttaattatttcagggggcgnaaggaataacattnaaactggaattcaggccttcaaaaacaaggatnatccgggttcttttcnatntcggggggcctaattgaaatatgtanttttattttagacacgcttctgttaaaacagaccaggttttcctggtctcagacctatgatgacttgtccctttgatgtcactactgtgaattgaatataattagtaaaaatagacgatgaataaataacactttatagtaagaaaacaatatattttggccatctaaaaatgagaattataattattatgaattataatttaaactgtttaattttgtttaatgngtatatngantcttccaaatngaanccattattntcaattaagtactacaactatgacaatgcttgacctacatttctaaaataaaaattcacattttttgataaataaactacagttttaccag

SEQ ID NO: 484265 - DNA, 968 bp, Homo sapiens
gggccccccctcgtgccgtcagaatccccaaaataagtaggaatgggcagcgtctgctcacagtcagtacacctttcccatttgctaatacggcctggccaggctgagaggaatccttccctgccttaccctggacagtgaagccactgagaccatcggtaggcaccatgcggctgcttcaagcgactgttcttttcttccttttgtccaacagtctctgccacagtgaggacggcaaagatgttcagaatgactctattccaacaccggcagaaacttccacaacaaaagcctctgtcacaataccaggcatcgtgtcagtgacaaatcctaacaaaccagcagatggaacacctcccgaaggaacgaccaaaagtgacgtatcccaaacatctttggtgacaacaattaattcactgacaacaccaaaacatgaagtgggaacaacaactgaaggtcccctaaggaatgaaagttccactatgaaaataacagtgccaaatactccaacttcaaatgctaattcaacgctaccaggttcccagaacaagactgagaatcagagttcaatcagaacaacggaaatatcagttactactcaactactggatgccttgccgaaaatcactgcaacatcctctgcatctctaacaactgcacacaccatgtcactgcttcaagatactgaggataggaagattgcaaccactccatcaaccaccccctcctattccagtatcattttgcctgtggttatcgcgctggttgttataacactcttggtatttactctggtgggtttgtatcgaatatgctggaagagagacccaggcactccagaaaacggaaatgatcagcctcagtccgataaagagagtgtgaagctgctcactgttaagacaatctctcatgagtctggcgaacactctgcacaggggaaaaccaagaactgacatcgtgatggatcc

SEQ ID NO: 484266 - DNA, 410 bp, Homo sapiens
agcatacactgctctgcaagtccaactagagtccgcactagaaagatatcctatatttcaaacctatcctctgaaatccacatccatacaagatggcctagtaaactctgcatagaataattggcctcattaccactatttactctcatcctgaattccctatattcaaaggccctgcagttttatttccatgcaggtatttttaagtgttcgagaaattgaacataaccagcagtttcaaattttttcagtagctcattaagctgtaatacaggtactcaattacgtatagcttaaatccaacactttaaccattgtgaaaaaacacaactgctcatgttcacaattccgtgaaagccatgaagctgtccttccactattttctgatttactgaagtgtattatacaca

SEQ ID NO: 484267 - DNA, 457 bp, Homo sapiens
  misc_feature (210)..(210): n is a, c, g, or t
ggttatctgtctggacgcgctgggtggattgcgttgtgtggggctcctggtgaactgtgttggagccgagacaagcgctatgccatggctgcaatgcgcgcacagactgtagccatccgaggacaccccgggaccaccggtagcgactcgatggagaaaaccggcaaaatcctccgaatccccatggatatctggtagaggaaggttganatgcgaaagcggtctgggagcaccgagcacacagctagacacataacagatggaccaaactaaaaggaggaagttgaaatataatatcaagacagagattaattttaataaacgcacaccggctatgcaacatagatgatacacctctatagtgcacgcactgagaccagtgtaacatgcctaacgaccctgaaggtggccgcacaatgttaccaggcgatcccagccaagagcctggataaatcaa

SEQ ID NO: 484268 - DNA, 937 bp, Homo sapiens
ggttaataacgacgagataagagatccctgtctgtttttgtttgtttgttttctgaccgagtttcattcttgtgcctaggctggagtgcaatggcgccatctcggctcactgcaatccttgcctcccgggttcaagcggttctcctgtctcggcctccagagtggctgggattgcaggcgcccgccactacacctggctaatttttgtttatttggtagagacgaggtttcaccgtgtggccaggtgggtctcaaactcctgacctcaggtgatccaccttccacatcctcccaaagtgctgggactacaggcgtgagccacctcgcccggcgcttctacttattaaaaacaaaaaaaaaagttagcagtcaaaggaaggcctatacggaggtatccctgaagaaggctcgtaatccataggagaatgaccgatccggggacatgtaacggaccctcggggtacgggtccaccatagaaggggtcagaacaacatgcggaccatgaatcatcatgaacggggagacacgaacgggagacaggactcaaagaatcaaagaggtacacaacacaatgaacgagaccgcacgcaagtagaagaggaagagaaaacccaggggcggaaacgactgactcgcaaaaccacaaagagggcacgtgcaacggcagacttgaaagacggggtccaagaggtccaaagagcccggggaaaaccggggagcaaggtccaaagagtttcaaagggaggaacgggaacgtgaaggtaggggggagagatacagagagaacagaacaggctgggagaccagccgggaacgacaatcgacgaacggcaatcagaggcgcaggggagaggggcaccgatggggggtgcaccagcaggaaaggaacgggagcacaaaccagaacgaaacagagaacagtaggcacctacagag

SEQ ID NO: 484269 - DNA, 694 bp, Homo sapiens
gcgagacgacttcctgggccaggtggagcgtgccccttagtcaccttccgacagaagatccaaccatggagcgaccctatacatttaaggagtttctcctcagaccaagaagtcataagtctcgagttaagggatttttgcgacttgaaaatggcctatatgccaaaaaatggaggtcacagatgaagaacacacagtgaccagagggactgacatggagcatggatgggaagttgttgactcaaatgactcggcttctcagcaccaagaggaactatcctacctacctcctactgcctcccgggtgggacagacacaagtcggacaacttacgccgaactatactatagtcaaccacaacaaccggaccactcagtggcacagaccaagcctgatggacgtgtcctcgcgagtcggacaactaacatcagacagactcaaccaggaggcagcacaccggcgcacttcgctcccgacaggcacatcagcgaagactccggaagcccgaagccctcgagagggcgcgggcatgtccccgagcctatgggagaccatatcagaggaagtgaatatcaagatggaagaactcttctcgggtctggatctggcccacaccaccggcaattcccaggactctcagaccatgcctcaggaagccgtcacaggaacttagccacaaggcatccgattatac

SEQ ID NO: 484270 - DNA, 102 bp, Homo sapiens
  misc_feature (7)..(7): n is a, c, g, or t
ttcaagncttctaacgaatgtacgggcgacatgagttgtggttaatctgtgtttatttcttgttccacaagttaaataaatcataaaacttaaaaaaaaaaa

SEQ ID NO: 484271 - DNA, 120 bp, Homo sapiens
caccctgtcttttaagttagtgtgacaattttccataataaactacttaaagacagggtgagggagatatgtaaattgtccactagaaaattaaataaaagaactgaatgtgaaaaaaaa

SEQ ID NO: 484272 - DNA, 833 bp, Homo sapiens
ggtttatcctgtctcttcttgcctgaccgacttcagctgcaacggacaacggtatggggtcattgtcacggatttggtctctcatctaattaaatatcactgattgtcaagtgttttccacctatttccctggatactatttgatcggtcccgataggcatgtgcctctgtgtgggtgtaccttgtgttaggcttgctcctgtttctcagatgatttatcaatttatgcacaagttcggaagatgccagtaaatctgtatctcaaatctccccaggaccagagttctcttttatgttattaaagatgtttctggcaaaggccttcctgcatttatgaatgctctctcagagatgcaacgagaacatcctgtaggaagtgaatcagatgatgcagaacacagaggaatattcacctgctttaccaaataaagtacgtgttgaaacagatcatttctctctattctgtttcctagtgtgtaatattttacatacgttgaatgcagaattctgtaatcattgaatcacttagtggttaagtgtttgaaaaagctcttgcaatcaagtctcgtgatgtattaagtaatggctttataatatagtgtggtcagtcatcttaaggtacgcattgagccatgttcccctgtagtccgcgtacggggggcacctccttggcttttatgtcatccttccaatctcaacacatgaacttgcgacattaaattatggtaaagactatgtatcatgctggccatttcaaaggggttttctccaaaagtttaaacttctgttatgacggtttttgcaataatccaattgtcgtcaattatccaaat

SEQ ID NO: 484273 - DNA, 135 bp, Homo sapiens
gatttcgtgtgtgtgtgagtgtgttctgttttgtgttttgttctttgttgttgtatttaggtggatggttttcttttctttcccccggccggtcgagtacttcacagcactctggtgcgggaagaagcagaggca

SEQ ID NO: 484274 - DNA, 475 bp, Homo sapiens
atctttctgaccacccaggaacctgtgtggagagagtggctgggccactgtccagccagcgccgagagggtttccgagtagagatgttaccgcagggtcaccggttagtgttgtaaaataagactggtggttgtggatactaaacgtgtgcatgagatctacacggtaaaaaggccaaacaattttttaagcagtgatagaattttccctccagatttagaaggaatcgtccctgatgcttctggctttctaaaaccagggcggttttcccccccgccccgtggaacgccctttccttcattctggcatttcagatggcaggaagagcatttagctgaaatatttacctgctgatttggggttcttaaatttagaatcccctttcatgtgtttaagagagatatttacattcaaatcagccttttataattacattttaaattataataaaatgatggtgccggcgcaaaaaaaa

SEQ ID NO: 484275 - DNA, 406 bp, Homo sapiens
  misc_feature (175)..(175): n is a, c, g, or t
ctcgggtgccatttgctaactctgttctctgtgtagctgcttttggcagctcctcatctcccttctaatccaccactcacagtcctagagaacagaccacaagttaagaccgtcacctacagaatcccaagggccaaaactggtgcacgaaaggaacaaactcccaaatccttcnttacaagggcttctccacaaagcatcgttagactctaaggagatacgcttcagaatttcatggagcagaagccttgaaatgccttatgatcctcacacgatccatacgatcagacacggatggcggaagaacccagaagcaagagcactgataagctgaggtccataaattgaggactagtgtggtacggagggggaagaaacgaaaccttaatatcctatcaagaaagga

SEQ ID NO: 484276 - DNA, 447 bp, Homo sapiens
cacgaggccgatgcggctgttgcggccgaagccgagcccgatgccgtcgtggtcgatgacgacctgcggctcacggttgcgggaccggcttatgccctgcaccacgtagtagcccagcgccagcgccagcaagaagatcagcacgaagcgtcggtcgttcagggacaaagtcggcgcattggccggattgaccatgaaatacgcgatcacggccacgatcatgcccaacgacaccacggccatgctgagattgtgcagcacgccgaagcgcaccatcacaggtgatacggccatctcagctgcattgggcgcgatggcgcagcaggtggtcggccagcaccaccgccatcatcgcttcggcgaccggcgtgccgcggatgccgacgcagggatcgtggcggcccttggtgcgcagctcgacctccttgccgaagcggtcgacgcttc

SEQ ID NO: 484277 - DNA, 197 bp, Homo sapiens
cctttgggggaaaaaaaaaatggttttttttccccccccatttttttttttgaaaaaaaaaaagaaattttaacgttggggggggaaaaaaaaggaaccctttttttaaaatttttttttttttttttttttttttgccccccttttttttttttttttttcaaaaaggttttttatttttttttttggcgggttta

SEQ ID NO: 484278 - DNA, 345 bp, Homo sapiens
  misc_feature (13)..(13): n is a, c, g, or t
  misc_feature (326)..(326): n is a, c, g, or t
  misc_feature (337)..(337): n is a, c, g, or t
  misc_feature (341)..(341): n is a, c, g, or t
aatcaatttaatnggttgcaaccaacatttttttgaaaaaaaaaaaaaaaaaaaaagccagacgatggtgcacgcctataatcccagcactttgggaggccgaggcaggcggatcacttgaggtcaggagttcgagaccagcctggccaacatgctgaaactccgtctctactaaaaatacagaaattagctgggcgtagtgacgtatgcctgtaatcccagctacttgagaggctgaggcacgagaatcacttgaacccaggaggcagaggttgcagtgagctgagatcacactgttgcactccagcctgggtgacagagcgagnctctgtcaaanaaantaat

SEQ ID NO: 484279 - DNA, 373 bp, Homo sapiens
aagtgaaacaggaatatatcacgaaggctaataagaaaatgataagacagataggacagaggaagtcatgaataatagtataaacttactgaggagatacagagaacgtgatggcacattcctagtatcccagcactattgataaggatagatggtgtgaagacagaccgaacccaggtgtttgatcagcctgggtaaaaaatattgtaaaaaggtgagccaggtagtggtgtgctatatgcctagtgatcccagcctactatgggagcgcctgacgggaggtcgacggcatgctagtgacgtctattcgatcacagccggcacacctgccgagcctggtgagaacagtgagacacttgttctcaaagataaa

SEQ ID NO: 484280 - DNA, 1415 bp, Homo sapiens
cgtgggcctgccgtggtgcctggtcacctggggcatggcaacatggttgggcgtgcgtgggaaacggtggggcagaaggcctgtgcgtgcgtgtgcagatggcggtgcatgtggtgactgtccttcagctgatgccctgctcccgtgcagtgtatagtgtgctgctgtgcactgtgttccatgtgctgctttgcactgctgactgtgtgctgctgcgtggtgtgttggcttgtgatgccgtgactcagtgcgggatcttgacatgccttgtccgcgagggtaggtccctgccggtgtccccagctgcttgctgatgtgctgtgctgatgcgcatgtgatgtgggtgctgtgcatgcagatgctggtgggctggtacctctgttgcgctgactcccgcctcccctcgcgggcgctggcttctcaccgcggctgggcgcccgcgcaccctctctcggggctggtggcctgcgtgggcggccgggtggtcggcagagccgccggggcccccgggctcagaaagaggccgaaatggctgcgaagcaggccccgggcaggagtcgctcgggcgcagggaggaagtgaaccggccggaggtagcgcccggctgctggccccacagtcccgacaccttcggaactcctaactcctttacttgtccggctgaaaggtcaccagccccagtccccagctgtgccgcttgctgggcacagagcctctggtaactgccccctgatacacacagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaa

SEQ ID NO: 484281 - DNA, 855 bp, Homo sapiens
  misc_feature (16)..(16): n is a, c, g, or t
atagcatagtagagcngggagactgcgccgacatggagctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaa

SEQ ID NO: 484282 - DNA, 1394 bp, Homo sapiens
cagtcgtgcctcatatcttgttcaacactggaagacttcacactgcgcgagaagccctatgaatgtaaggagtgtggcaaggcctctcagctactggctcataccttgttcagcactcagagcgcatccatactggaggagaaaccctatgaactgtaaggaatgtggcaaagccttctattagctcgccatcagctctaccgtacatcaacacgggcttcatactgcgcacgacgaaacccatatgaaccctgtccagcgacactgccgcgccaggcccttcacgccaccgcacgcaacatcctccaccacagccactcggacaacacttcactacctgaccgctaccagcccctcatgcacctcgctcaccggacacgcagcgcaccagacctccacacgctcccgcagccctccgctcaccccagctccccacacacatcagccccgcaactccccatcacctcgcgcaaaacaaagccccctcctgcactcagctcaaccgcgcagccgcccgcccacaagcgcccccttcaagcacacaccctgcgccctccactaaccccactgactaccacacccacctccaacagaacactccccgctcacctgcgcgccacgcaaacacccccaccactccaactgccaacaccaacaacgctgccgccaacacgccctcacacacacgccccccacccggacccaaccccgaactcgggcaccctgacgcacctgctccccccacccgcgccgcaccacaccctctgcgcaccccgctaccacgcacacgcccgccaccggcccccaccagcacccctcacccccactccctccacctgccccaccagcgccaccaaccccccggcgcaagcccaccccactacacccgccccacacccgcgccaaaagacccccagacaaccccgcacaccccccacaccccgcgccttccgcgcaccccaccctgacccgacaccacccccacgacgccccgaagccccccccccaccacccacccgccccacgcccacccaccgcacacccccccccgaccactcgacgccccgccaccacccccgcgccgcaccacgcccgcgacagcccccccccaccccacctacaacgctaccaccctcacacaccaccgggcaccacaccgcccccagacaccacccgccgggcgcccacccgacccgcagcgcaccacacagggcacaccaccggcagaaccaccagccacacccccacgccgccccccgatcaccccaccccccccaccaaccgcgccacacccccaggcgcaccacccgcagcgaccggccgacgagagcgcacccaccccgcccgccccccacatgccccccccgcactcgccggccaacgcggcccgcacg

SEQ ID NO: 484283 - DNA, 176 bp, Homo sapiens
agcgaagctacataagagaaaaataagtaatcgggtaatgcaagcgttggtggtcaactccacatactctatctcatctgagggtcgtggagtacgccctactcgtctagagcgcagagagatgcgccctgccaagacgagtgagcgctagaagtgagtctgagccagagattcgg

SEQ ID NO: 484284 - DNA, 947 bp, Homo sapiens
  misc_feature (16)..(16): n is a, c, g, or t
atagcatagtagagcngggagactgcgccgacatggagctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggctttgggctgttgagtcctcaaaacttagccatgcgtgtatctacccatctcaataactgatttgtgccaaaaaaaaaaatataaagaggaaagggacaaaaaaaaggggggtaaacagggggaacacctttaaggtaagggaaagagggaagggaaggtgtggattgggagaaaaagaattgggtgggggagaac

SEQ ID NO: 484285 - DNA, 2224 bp, Homo sapiens
gactagttctagatcgcgagcggagctgctgactgcattcttctctgccactgcggatgctgcctccccgtttccagcctgtaagcccgttgtggtggtgagctccctgctgctgcaggaggaggagcccctggctggggggaagccgggtgcggacggtggcagcctggaggccgtgcggctggggccctcgtcaggcctcctagtggactggctggaaatgctggaccccgaggtggtcagcagctgccccgacctgcagctcaggctgctcttctcccggaggaagggcaaaggtcaggcccaggtgccctcgttccgtccctacctcctgaccctcttcacgcatcagtccagctggcccacactgcaccagtgcatccgagtcctgctgggcaagagccgggaacagaggttcgacccctctgcctctctggacttcctctgggcctgcatccatgttcctcgcatctggcaggggcgggaccagcgcaccccgcagaagcggcgggaggagctggtgctgcgggtccaggcccggagctcatcagcctggtggagctgatcctggccgaggcggagacgcggagccaggacggggacacagccgcctgcagcctcatccaggcccggctgcccctgctgctcagctgctgctgtggggacgatgagagtgtcaggaaggtgacggagcacctgtcaggctgcatccagcagtggggagacagcgtgctgggcaggcgctgccgagaccttctcctgcagctctacctacagcggccggagctgcgggtgcccgtgcctgaggtcctactgcacagcgaaggggctgccagcagcagcgtctgcaagctggacggactcatccaccgcttcatcacgctccttgcggacaccagcgactcccgggcgttggagaaccgaggggcggatgccagcatggcctgccggaagctggcggtggcgcacccgctgctgctgctcaggcacctgcccatgatcgcggcgctcctgcacggccgcacccacctcaacttccaggagttccggcagcagaaccacctgagctgcttcctgcacgtgctgggcctgctggagctgctgcagccgcacgtgttccgcagcgagcaccagggggcgctgtgggactgccttctgtccttcatccgcctgctgctgaattacaggaagtcctcccgccatctggctgccttcatcaacaagtttgtgcagttcatccataagtacattacctacaatgccccagcagccatctccttcctgcagaagcacgccgacccgctccacgacctgtccttcgacaacagtgacctggtgatgctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggaggatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtca

SEQ ID NO: 484286 - DNA, 655 bp, Homo sapiens
  misc_feature (332)..(332): n is a, c, g, or t
ggaatgctgagtttcagttttgagcagaggtgaggcagaatccactgtagccttttgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgttnggggtaggtgttgatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaa

SEQ ID NO: 484287 - DNA, 103 bp, Homo sapiens
aatagcctgcaccgacattaggatgagaagagttgaggaagcctagagagtctctgcactgaggctgagccatgttcatgccactgccattaaaggagctgtt

SEQ ID NO: 484288 - DNA, 4925 bp, Homo sapiens
  misc_feature (5)..(5): n is a, c, g, or t
tggangaaaacttaatcgaaacctggtcatcgggctgtccgggagctccggctcgggctgcggacgccatggagcttgctgaccacctggtgaagcgggcggctgccgtgcaggcggatgatgtggaggtgctgaaggtggggaggacccagctgatcgacgccgttctgaatctgtgcacctaccatcaccctgaaaacatccagctcccaccggggtaccagcctccgaacctcgccatctctaccctctactggaaggcctggcccctcctgctggtcgtcgccgcattcaacccagagaacatcggcctggctgcgtgggaggagtacccgaccctgaagatgctcatggagatggtgatgaccaacaactactcctacccaccgtgcaccctgacggatgaggagacccggacggagatgctgaaccgtgagctgcagaccgcccagcgggagaagcaggagatcctggccttcgaggggcacctggcggccgcgtccaccaagcagaccatcactgagagcagcagcctcctcctgtcgcagctcaccagcctggacccccaggggcccccccggaggcctccccctcacatcctggatcaagtgaaaagcctcaaccagtccctccgcctcgggcacctcttgtgccgcagccgaaaccctgactttctcctccacatcatccagcggcaggcctcctcgcagtccatgccctggctggcggacctggtacagtccagcgagggctccctggacgtgctgcccgtgcagtgtctgtgcgagttcctgctgcacgatgctgtggacgatgctgcttccggggaggaggacgacgagggcgagagcaaggagcagaaggccaagaagcggcagaggcaacagaagcagcggcagctgctgggccgcctgcaggacctgctactgggcccgaaggctgatgagcagaccacgtgtgaggtgctggactacttcttgcggcgcctcggctcctcccaggtggcctcccgcgtgctggccatgaagggtttgtcgctggtgctttcggagggcagcctgcgggacggggaggagaaggagccccccatggaggaggatgtgggggacacagatgtgctgcagggctatcagtggctgctgcgggacctgcctcgcctgcctctgttcgacagcgtcaggagcaccacagccctggccctgcagcaggcaatccacatggagactgatccccagaccatcagcgcctacctgatctacttgtcccagcacacgcctgtggaggagcaggcccagcacagcgacctggccctggacgtggcccggctggtcgtggagcgctccaccatcatgtcccacctcttctcgaagctctccccgagtgccgcgtcggacgccgtgctgagcgctctgttgtccatcttctcacgctacgtgaggcgcatgcggcagagcaaggagggcgaggaggtctacagctggtcggagtctcaggaccaggtcttcctacgctggagcagcggggagacagccaccatgcacatcctcgtggtccatgccatggtgatcctgctgacgctgggcccgcctcgagccgacgacagcgagttccaggcgctgctggacatctggtttccggaggagaagccactgcccaccgccttcctggtggacacatcggaggaggcgctgctgcttcctgactggctgaagctgcgcatgatccgttctgaggtgctccgcctggtggacgccgccctgcaggacctggagccgcagcagctgctgctgttcgtgcagtcgtttggcatccccgtgtccagcatgagcaaactcctccagttcctggaccaggcagtggcccacgacccccagactctggagcagaacatcatggacaagaattacatggcccacctggtggaggtccagcatgagcgcggcgcctccggaggccagactttccactccttgctcacagcctccctgccgccccgccgagacagcacagaggcacccaaaccaaagagcagcccagagcagcccataggccagggccggattcgggtggggacccagctccgggtgctgggccctgaggacgacctggctggcatgttcctccagattttcccgctcagcccggaccctcggtggcagagctccagtccccgccccgtggccctcgccctgcagcaggccctgggccaggagctggcccgcgtcgtccagggcagccccgaggtgccgggcatcacggtgcgtgtcctgcaggccctcgccaccctgctcagctccccacacggcggtgccctggtgatgtccatgcaccgtagccacttcctggcctgcccgctgctgcgccagctctgccagtaccagcgctgtgtgccacaggacaccggcttctcctcgctcttcctgaaggtgctcctgcagatgctgcagtggctggacagccctggcgtggagggcgggcccctgcgggcacagctcaggatgcttgccagccaggcctcagccgggcgcaggctcagtgatgtgcgaggggggctcctgcgcctggccgaggccctggccttccgtcaggacctggaggtggtcagctccaccgtccgtgccgtcatcgccaccctgaggtctggggagcagtgcagcgtggagccggacctgatcagcaaagtcctccaggggctgatcgaggtgaggtccccccacctggaggagctgctgactgcattcttctctgccactgcggatgctgcctccccgtttccagcctgtaagcccgttgtggtggtgagctccctgctgctgcaggaggaggagcccctggctggggggaagccgggtgcggacggtggcagcctggaggccgtgcggctggggccctcgtcaggcctcctagtggactggctggaaatgctggaccccgaggtggtcagcagctgccccgacctgcagctcaggctgctcttctcccggaggaagggcaaaggtcaggcccaggtgccctcgttccgtccctacctcctgaccctcttcacgcatcagtccagctggcccacactgcaccagtgcatccgagtcctgctgggcaagagccgggaacagaggttcgacccctctgcctctctggacttcctctgggcctgcatccatgttcctcgcatctggcaggggcgggaccagcgcaccccgcagaagcggcgggaggagctggtgctgcgggtccaggcccggagctcatcagcctggtggagctgatcctggccgaggcggagacgcggagccaggacggggacacagccgcctgcagcctcatccaggcccggctgcccctgctgctcagctgctgctgtggggacgatgagagtgtcaggaaggtgacggagcacctgtcaggctgcatccagcagtggggagacagcgtgctgggcaggcgctgccgagaccttctcctgcagctctacctacagcggccggagctgcgggtgcccgtgcctgaggtcctactgcacagcgaaggggctgccagcagcagcgtctgcaagctggacggactcatccaccgcttcatcacgctccttgcggacaccagcgactcccgggcgttggagaaccgaggggcggatgccagcatggcctgccggaagctggcggtggcgcacccgctgctgctgctcaggcacctgcccatgatcgcggcgctcctgcacggccgcacccacctcaacttccaggagttccggcagcagaaccacctgagctgcttcctgcacgtgctgggcctgctggagctgctgcagccgcacgtgttccgcagcgagcaccagggggcgctgtgggactgccttctgtccttcatccgcctgctgctgaattacaggaagtcctcccgccatctggctgccttcatcaacaagtttgtgcagttcatccataagtacattacctacaatgccccagcagccatctccttcctgcagaagcacgccgacccgctccacgacctgtccttcgacaacagtgacctggtgatgctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggaggatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtca

SEQ ID NO: 484289 - DNA, 530 bp, Homo sapiens
tctctctctctctctctctctctctctctctctgtctctctctctctctgtttcctgcaaataaaacactttattgcagagctgggcctcaccggcctcgccttggctcgtgccgaattcggcacgagccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaagctgcaataaaaaaatagagagcgagagcgagagagacagagggagagagagacattgagcgagggagacacccacccataccgaggtcactttaaccgagctgttaagatgaacagcattgactctcagtcacaacacacctcccctcgggccgaatcctttatgcgattgttgttctctccg

SEQ ID NO: 484290 - DNA, 692 bp, Homo sapiens
  misc_feature (332)..(332): n is a, c, g, or t
ggaatgctgagtttcagttttgagcagaggtgaggcagaatccactgtagccttttgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgttnggggtaggtgttgagcgaggcaaatggatcttgatatttcagatgggcttttgatgcactgttgccaatgaaggctttttctgattttttgacaaatgaatttttgcacactttcattggggtcttgtggcaacttacacacattgtgagctattggacataattgtatatcctccttataaatgcattgctgattgaacttgtaacaatattgtaatgaacggttggcagtaggcccaacgctgattggtttgtaggaggaatagctaccagaacccttaacatactgggaattttttcttgacaacaatttagatttggcaaattactcttccgtcattatttagagctttttttttt

SEQ ID NO: 484291 - DNA, 4847 bp, Homo sapiens
aacgagctgcaactcaggggcgagctgccgtgcaggcggatgatgtggaggtgctgaaggtggggaggacccagctgatcgacgccgttctgaatctgtgcacctaccatcaccctgaaaacatccagctcccaccggggtaccagcctccgaacctcgccatctctaccctctactggaaggcctggcccctcctgctggtcgtcgccgcattcaacccagagaacatcggcctggctgcgtgggaggagtacccgaccctgaagatgctcatggagatggtgatgaccaacaactactcctacccaccgtgcaccctgacggatgaggagacccggacggagatgctgaaccgtgagctgcagaccgcccagcgggagaagcaggagatcctggccttcgaggggcacctggcggccgcgtccaccaagcagaccatcactgagagcagcagcctcctcctgtcgcagctcaccagcctggacccccaggggcccccccggaggcctccccctcacatcctggatcaagtgaaaagcctcaaccagtccctccgcctcgggcacctcttgtgccgcagccgaaaccctgactttctcctccacatcatccagcggcaggcctcctcgcagtccatgccctggctggcggacctggtacagtccagcgagggctccctggacgtgctgcccgtgcagtgtctgtgcgagttcctgctgcacgatgctgtggacgatgctgcttccggggaggaggacgacgagggcgagagcaaggagcagaaggccaagaagcggcagaggcaacagaagcagcggcagctgctgggccgcctgcaggacctgctactgggcccgaaggctgatgagcagaccacgtgtgaggtgctggactacttcttgcggcgcctcggctcctcccaggtggcctcccgcgtgctggccatgaagggtttgtcgctggtgctttcggagggcagcctgcgggacggggaggagaaggagccccccatggaggaggatgtgggggacacagatgtgctgcagggctatcagtggctgctgcgggacctgcctcgcctgcctctgttcgacagcgtcaggagcaccacagccctggccctgcagcaggcaatccacatggagactgatccccagaccatcagcgcctacctgatctacttgtcccagcacacgcctgtggaggagcaggcccagcacagcgacctggccctggacgtggcccggctggtcgtggagcgctccaccatcatgtcccacctcttctcgaagctctccccgagtgccgcgtcggacgccgtgctgagcgctctgttgtccatcttctcacgctacgtgaggcgcatgcggcagagcaaggagggcgaggaggtctacagctggtcggagtctcaggaccaggtcttcctacgctggagcagcggggagacagccaccatgcacatcctcgtggtccatgccatggtgatcctgctgacgctgggcccgcctcgagccgacgacagcgagttccaggcgctgctggacatctggtttccggaggagaagccactgcccaccgccttcctggtggacacatcggaggaggcgctgctgcttcctgactggctgaagctgcgcatgatccgttctgaggtgctccgcctggtggacgccgccctgcaggacctggagccgcagcagctgctgctgttcgtgcagtcgtttggcatccccgtgtccagcatgagcaaactcctccagttcctggaccaggcagtggcccacgacccccagactctggagcagaacatcatggacaagaattacatggcccacctggtggaggtccagcatgagcgcggcgcctccggaggccagactttccactccttgctcacagcctccctgccgccccgccgagacagcacagaggcacccaaaccaaagagcagcccagagcagcccataggccagggccggattcgggtggggacccagctccgggtgctgggccctgaggacgacctggctggcatgttcctccagattttcccgctcagcccggaccctcggtggcagagctccagtccccgccccgtggccctcgccctgcagcaggccctgggccaggagctggcccgcgtcgtccagggcagccccgaggtgccgggcatcacggtgcgtgtcctgcaggccctcgccaccctgctcagctccccacacggcggtgccctggtgatgtccatgcaccgtagccacttcctggcctgcccgctgctgcgccagctctgccagtaccagcgctgtgtgccacaggacaccggcttctcctcgctcttcctgaaggtgctcctgcagatgctgcagtggctggacagccctggcgtggagggcgggcccctgcgggcacagctcaggatgcttgccagccaggcctcagccgggcgcaggctcagtgatgtgcgaggggggctcctgcgcctggccgaggccctggccttccgtcaggacctggaggtggtcagctccaccgtccgtgccgtcatcgccaccctgaggtctggggagcagtgcagcgtggagccggacctgatcagcaaagtcctccaggggctgatcgaggtgaggtccccccacctggaggagctgctgactgcattcttctctgccactgcggatgctgcctccccgtttccagcctgtaagcccgttgtggtggtgagctccctgctgctgcaggaggaggagcccctggctggggggaagccgggtgcggacggtggcagcctggaggccgtgcggctggggccctcgtcaggcctcctagtggactggctggaaatgctggaccccgaggtggtcagcagctgccccgacctgcagctcaggctgctcttctcccggaggaagggcaaaggtcaggcccaggtgccctcgttccgtccctacctcctgaccctcttcacgcatcagtccagctggcccacactgcaccagtgcatccgagtcctgctgggcaagagccgggaacagaggttcgacccctctgcctctctggacttcctctgggcctgcatccatgttcctcgcatctggcaggggcgggaccagcgcaccccgcagaagcggcgggaggagctggtgctgcgggtccaggcccggagctcatcagcctggtggagctgatcctggccgaggcggagacgcggagccaggacggggacacagccgcctgcagcctcatccaggcccggctgcccctgctgctcagctgctgctgtggggacgatgagagtgtcaggaaggtgacggagcacctgtcaggctgcatccagcagtggggagacagcgtgctgggcaggcgctgccgagaccttctcctgcagctctacctacagcggccggagctgcgggtgcccgtgcctgaggtcctactgcacagcgaaggggctgccagcagcagcgtctgcaagctggacggactcatccaccgcttcatcacgctccttgcggacaccagcgactcccgggcgttggagaaccgaggggcggatgccagcatggcctgccggaagctggcggtggcgcacccgctgctgctgctcaggcacctgcccatgatcgcggcgctcctgcacggccgcacccacctcaacttccaggagttccggcagcagaaccacctgagctgcttcctgcacgtgctgggcctgctggagctgctgcagccgcacgtgttccgcagcgagcaccagggggcgctgtgggactgccttctgtccttcatccgcctgctgctgaattacaggaagtcctcccgccatctggctgccttcatcaacaagtttgtgcagttcatccataagtacattacctacaatgccccagcagccatctccttcctgcagaagcacgccgacccgctccacgacctgtccttcgacaacagtgacctggtgatgctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggaggatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtca

SEQ ID NO: 484292 - DNA, 252 bp, Homo sapiens
  misc_feature (6)..(7): n is a, c, g, or t
  misc_feature (9)..(9): n is a, c, g, or t
  misc_feature (98)..(98): n is a, c, g, or t
  misc_feature (113)..(113): n is a, c, g, or t
  misc_feature (148)..(148): n is a, c, g, or t
  misc_feature (155)..(155): n is a, c, g, or t
  misc_feature (180)..(180): n is a, c, g, or t
  misc_feature (209)..(209): n is a, c, g, or t
gcctgnncngacacgaagatgaccctcgacagccgccgggcgctgatcaccagggaaggcaaaggcataggccagcaccgatgaattccctttgaccnaagtctgcagcaggncccttttgcgcttccttcccctcaggcagcctctntcccccngggccactcccgggggcgagggggntacccctttcccaggctttttattcccgnggggctcaccccaaagcattaaaagcagctttgcaattccttg

SEQ ID NO: 484293 - DNA, 4699 bp, Homo sapiens
  misc_feature (20)..(20): n is a, c, g, or t
  misc_feature (26)..(26): n is a, c, g, or t
  misc_feature (40)..(41): n is a, c, g, or t
aacttacggctagtagagcngggtgntaatcggccgaggnnccctcctgctggtcgtcgccgcattcaacccagagaacatcggcctggctgcgtgggaggagtacccgaccctgaagatgctcatggagatggtgatgaccaacaactactcctacccaccgtgcaccctgacggatgaggagacccggacggagatgctgaaccgtgagctgcagaccgcccagcgggagaagcaggagatcctggccttcgaggggcacctggcggccgcgtccaccaagcagaccatcactgagagcagcagcctcctcctgtcgcagctcaccagcctggacccccaggggcccccccggaggcctccccctcacatcctggatcaagtgaaaagcctcaaccagtccctccgcctcgggcacctcttgtgccgcagccgaaaccctgactttctcctccacatcatccagcggcaggcctcctcgcagtccatgccctggctggcggacctggtacagtccagcgagggctccctggacgtgctgcccgtgcagtgtctgtgcgagttcctgctgcacgatgctgtggacgatgctgcttccggggaggaggacgacgagggcgagagcaaggagcagaaggccaagaagcggcagaggcaacagaagcagcggcagctgctgggccgcctgcaggacctgctactgggcccgaaggctgatgagcagaccacgtgtgaggtgctggactacttcttgcggcgcctcggctcctcccaggtggcctcccgcgtgctggccatgaagggtttgtcgctggtgctttcggagggcagcctgcgggacggggaggagaaggagccccccatggaggaggatgtgggggacacagatgtgctgcagggctatcagtggctgctgcgggacctgcctcgcctgcctctgttcgacagcgtcaggagcaccacagccctggccctgcagcaggcaatccacatggagactgatccccagaccatcagcgcctacctgatctacttgtcccagcacacgcctgtggaggagcaggcccagcacagcgacctggccctggacgtggcccggctggtcgtggagcgctccaccatcatgtcccacctcttctcgaagctctccccgagtgccgcgtcggacgccgtgctgagcgctctgttgtccatcttctcacgctacgtgaggcgcatgcggcagagcaaggagggcgaggaggtctacagctggtcggagtctcaggaccaggtcttcctacgctggagcagcggggagacagccaccatgcacatcctcgtggtccatgccatggtgatcctgctgacgctgggcccgcctcgagccgacgacagcgagttccaggcgctgctggacatctggtttccggaggagaagccactgcccaccgccttcctggtggacacatcggaggaggcgctgctgcttcctgactggctgaagctgcgcatgatccgttctgaggtgctccgcctggtggacgccgccctgcaggacctggagccgcagcagctgctgctgttcgtgcagtcgtttggcatccccgtgtccagcatgagcaaactcctccagttcctggaccaggcagtggcccacgacccccagactctggagcagaacatcatggacaagaattacatggcccacctggtggaggtccagcatgagcgcggcgcctccggaggccagactttccactccttgctcacagcctccctgccgccccgccgagacagcacagaggcacccaaaccaaagagcagcccagagcagcccataggccagggccggattcgggtggggacccagctccgggtgctgggccctgaggacgacctggctggcatgttcctccagattttcccgctcagcccggaccctcggtggcagagctccagtccccgccccgtggccctcgccctgcagcaggccctgggccaggagctggcccgcgtcgtccagggcagccccgaggtgccgggcatcacggtgcgtgtcctgcaggccctcgccaccctgctcagctccccacacggcggtgccctggtgatgtccatgcaccgtagccacttcctggcctgcccgctgctgcgccagctctgccagtaccagcgctgtgtgccacaggacaccggcttctcctcgctcttcctgaaggtgctcctgcagatgctgcagtggctggacagccctggcgtggagggcgggcccctgcgggcacagctcaggatgcttgccagccaggcctcagccgggcgcaggctcagtgatgtgcgaggggggctcctgcgcctggccgaggccctggccttccgtcaggacctggaggtggtcagctccaccgtccgtgccgtcatcgccaccctgaggtctggggagcagtgcagcgtggagccggacctgatcagcaaagtcctccaggggctgatcgaggtgaggtccccccacctggaggagctgctgactgcattcttctctgccactgcggatgctgcctccccgtttccagcctgtaagcccgttgtggtggtgagctccctgctgctgcaggaggaggagcccctggctggggggaagccgggtgcggacggtggcagcctggaggccgtgcggctggggccctcgtcaggcctcctagtggactggctggaaatgctggaccccgaggtggtcagcagctgccccgacctgcagctcaggctgctcttctcccggaggaagggcaaaggtcaggcccaggtgccctcgttccgtccctacctcctgaccctcttcacgcatcagtccagctggcccacactgcaccagtgcatccgagtcctgctgggcaagagccgggaacagaggttcgacccctctgcctctctggacttcctctgggcctgcatccatgttcctcgcatctggcaggggcgggaccagcgcaccccgcagaagcggcgggaggagctggtgctgcgggtccaggcccggagctcatcagcctggtggagctgatcctggccgaggcggagacgcggagccaggacggggacacagccgcctgcagcctcatccaggcccggctgcccctgctgctcagctgctgctgtggggacgatgagagtgtcaggaaggtgacggagcacctgtcaggctgcatccagcagtggggagacagcgtgctgggcaggcgctgccgagaccttctcctgcagctctacctacagcggccggagctgcgggtgcccgtgcctgaggtcctactgcacagcgaaggggctgccagcagcagcgtctgcaagctggacggactcatccaccgcttcatcacgctccttgcggacaccagcgactcccgggcgttggagaaccgaggggcggatgccagcatggcctgccggaagctggcggtggcgcacccgctgctgctgctcaggcacctgcccatgatcgcggcgctcctgcacggccgcacccacctcaacttccaggagttccggcagcagaaccacctgagctgcttcctgcacgtgctgggcctgctggagctgctgcagccgcacgtgttccgcagcgagcaccagggggcgctgtgggactgccttctgtccttcatccgcctgctgctgaattacaggaagtcctcccgccatctggctgccttcatcaacaagtttgtgcagttcatccataagtacattacctacaatgccccagcagccatctccttcctgcagaagcacgccgacccgctccacgacctgtccttcgacaacagtgacctggtgatgctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggaggatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtca

SEQ ID NO: 484294 - DNA, 1308 bp, Homo sapiens
  misc_feature (16)..(16): n is a, c, g, or t
  misc_feature (948)..(949): n is a, c, g, or t
  misc_feature (952)..(952): n is a, c, g, or t
  misc_feature (956)..(956): n is a, c, g, or t
  misc_feature (959)..(960): n is a, c, g, or t
  misc_feature (970)..(970): n is a, c, g, or t
  misc_feature (978)..(978): n is a, c, g, or t
  misc_feature (981)..(981): n is a, c, g, or t
  misc_feature (985)..(986): n is a, c, g, or t
  misc_feature (997)..(998): n is a, c, g, or t
  misc_feature (1022)..(1022): n is a, c, g, or t
  misc_feature (1025)..(1025): n is a, c, g, or t
  misc_feature (1036)..(1036): n is a, c, g, or t
  misc_feature (1044)..(1045): n is a, c, g, or t
  misc_feature (1053)..(1053): n is a, c, g, or t
  misc_feature (1056)..(1056): n is a, c, g, or t
  misc_feature (1065)..(1065): n is a, c, g, or t
  misc_feature (1074)..(1074): n is a, c, g, or t
  misc_feature (1076)..(1077): n is a, c, g, or t
  misc_feature (1079)..(1082): n is a, c, g, or t
  misc_feature (1089)..(1089): n is a, c, g, or t
  misc_feature (1093)..(1093): n is a, c, g, or t
  misc_feature (1102)..(1103): n is a, c, g, or t
  misc_feature (1105)..(1105): n is a, c, g, or t
  misc_feature (1107)..(1107): n is a, c, g, or t
  misc_feature (1110)..(1110): n is a, c, g, or t
  misc_feature (1112)..(1112): n is a, c, g, or t
  misc_feature (1114)..(1114): n is a, c, g, or t
  misc_feature (1119)..(1119): n is a, c, g, or t
atagcatagtagagcngggagactgcgccgacatggagctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaaaaaaaaaaaaaaaaacaaaaaaaaaaaaaaaaaaaaaaaaaaaaaaaaaaaaaaaaaaaaaacaaaaaaaaaaaaaaaaaaaaaaaaaaaaanntgntggnccnnttggcccaanggcttttnaanttgnnaaagtttatcnngcggcccaatttggggccattggncanattgccctaangggggggnnttaaaatncangggcccggntttaaaacngnngnnnngggaaancccnggggttccnnantnaancngnttggngaaaaaacccctttttccaacgggggctatatccgaaaaggccccacaccaaggccctttccaaaaatgtcgccccccaaagggcaagggaaattggcgccctaaatttttggaaaaacccccggtaaattttggaaaaccacctctttttaaccaaagggccaaatcgggaaaccccctttaaccaaa

SEQ ID NO: 484295 - DNA, 4753 bp, Homo sapiens
aactcaggggcgagctgcgacaggaggaggctgctgctctcagtgatggtctgcttggtggacgcggccgccaggtgcccctcgaaggccaggatccctcctgctggtcgtcgccgcattcaacccagagaacatcggcctggctgcgtgggaggagtacccgaccctgaagatgctcatggagatggtgatgaccaacaactactcctacccaccgtgcaccctgacggatgaggagacccggacggagatgctgaaccgtgagctgcagaccgcccagcgggagaagcaggagatcctggccttcgaggggcacctggcggccgcgtccaccaagcagaccatcactgagagcagcagcctcctcctgtcgcagctcaccagcctggacccccaggggcccccccggaggcctccccctcacatcctggatcaagtgaaaagcctcaaccagtccctccgcctcgggcacctcttgtgccgcagccgaaaccctgactttctcctccacatcatccagcggcaggcctcctcgcagtccatgccctggctggcggacctggtacagtccagcgagggctccctggacgtgctgcccgtgcagtgtctgtgcgagttcctgctgcacgatgctgtggacgatgctgcttccggggaggaggacgacgagggcgagagcaaggagcagaaggccaagaagcggcagaggcaacagaagcagcggcagctgctgggccgcctgcaggacctgctactgggcccgaaggctgatgagcagaccacgtgtgaggtgctggactacttcttgcggcgcctcggctcctcccaggtggcctcccgcgtgctggccatgaagggtttgtcgctggtgctttcggagggcagcctgcgggacggggaggagaaggagccccccatggaggaggatgtgggggacacagatgtgctgcagggctatcagtggctgctgcgggacctgcctcgcctgcctctgttcgacagcgtcaggagcaccacagccctggccctgcagcaggcaatccacatggagactgatccccagaccatcagcgcctacctgatctacttgtcccagcacacgcctgtggaggagcaggcccagcacagcgacctggccctggacgtggcccggctggtcgtggagcgctccaccatcatgtcccacctcttctcgaagctctccccgagtgccgcgtcggacgccgtgctgagcgctctgttgtccatcttctcacgctacgtgaggcgcatgcggcagagcaaggagggcgaggaggtctacagctggtcggagtctcaggaccaggtcttcctacgctggagcagcggggagacagccaccatgcacatcctcgtggtccatgccatggtgatcctgctgacgctgggcccgcctcgagccgacgacagcgagttccaggcgctgctggacatctggtttccggaggagaagccactgcccaccgccttcctggtggacacatcggaggaggcgctgctgcttcctgactggctgaagctgcgcatgatccgttctgaggtgctccgcctggtggacgccgccctgcaggacctggagccgcagcagctgctgctgttcgtgcagtcgtttggcatccccgtgtccagcatgagcaaactcctccagttcctggaccaggcagtggcccacgacccccagactctggagcagaacatcatggacaagaattacatggcccacctggtggaggtccagcatgagcgcggcgcctccggaggccagactttccactccttgctcacagcctccctgccgccccgccgagacagcacagaggcacccaaaccaaagagcagcccagagcagcccataggccagggccggattcgggtggggacccagctccgggtgctgggccctgaggacgacctggctggcatgttcctccagattttcccgctcagcccggaccctcggtggcagagctccagtccccgccccgtggccctcgccctgcagcaggccctgggccaggagctggcccgcgtcgtccagggcagccccgaggtgccgggcatcacggtgcgtgtcctgcaggccctcgccaccctgctcagctccccacacggcggtgccctggtgatgtccatgcaccgtagccacttcctggcctgcccgctgctgcgccagctctgccagtaccagcgctgtgtgccacaggacaccggcttctcctcgctcttcctgaaggtgctcctgcagatgctgcagtggctggacagccctggcgtggagggcgggcccctgcgggcacagctcaggatgcttgccagccaggcctcagccgggcgcaggctcagtgatgtgcgaggggggctcctgcgcctggccgaggccctggccttccgtcaggacctggaggtggtcagctccaccgtccgtgccgtcatcgccaccctgaggtctggggagcagtgcagcgtggagccggacctgatcagcaaagtcctccaggggctgatcgaggtgaggtccccccacctggaggagctgctgactgcattcttctctgccactgcggatgctgcctccccgtttccagcctgtaagcccgttgtggtggtgagctccctgctgctgcaggaggaggagcccctggctggggggaagccgggtgcggacggtggcagcctggaggccgtgcggctggggccctcgtcaggcctcctagtggactggctggaaatgctggaccccgaggtggtcagcagctgccccgacctgcagctcaggctgctcttctcccggaggaagggcaaaggtcaggcccaggtgccctcgttccgtccctacctcctgaccctcttcacgcatcagtccagctggcccacactgcaccagtgcatccgagtcctgctgggcaagagccgggaacagaggttcgacccctctgcctctctggacttcctctgggcctgcatccatgttcctcgcatctggcaggggcgggaccagcgcaccccgcagaagcggcgggaggagctggtgctgcgggtccaggcccggagctcatcagcctggtggagctgatcctggccgaggcggagacgcggagccaggacggggacacagccgcctgcagcctcatccaggcccggctgcccctgctgctcagctgctgctgtggggacgatgagagtgtcaggaaggtgacggagcacctgtcaggctgcatccagcagtggggagacagcgtgctgggcaggcgctgccgagaccttctcctgcagctctacctacagcggccggagctgcgggtgcccgtgcctgaggtcctactgcacagcgaaggggctgccagcagcagcgtctgcaagctggacggactcatccaccgcttcatcacgctccttgcggacaccagcgactcccgggcgttggagaaccgaggggcggatgccagcatggcctgccggaagctggcggtggcgcacccgctgctgctgctcaggcacctgcccatgatcgcggcgctcctgcacggccgcacccacctcaacttccaggagttccggcagcagaaccacctgagctgcttcctgcacgtgctgggcctgctggagctgctgcagccgcacgtgttccgcagcgagcaccagggggcgctgtgggactgccttctgtccttcatccgcctgctgctgaattacaggaagtcctcccgccatctggctgccttcatcaacaagtttgtgcagttcatccataagtacattacctacaatgccccagcagccatctccttcctgcagaagcacgccgacccgctccacgacctgtccttcgacaacagtgacctggtgatgctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggaggatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtca

SEQ ID NO: 484296 - DNA, 1213 bp, Homo sapiens
  misc_feature (16)..(16): n is a, c, g, or t
  misc_feature (965)..(965): n is a, c, g, or t
  misc_feature (1010)..(1010): n is a, c, g, or t
atagcatagtagagcngggagactgcgccgacatggagctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaaaaaaaaaaaaaaaaacaaaaaaaaaaaaaaaaaaaaaaaaaaaaaaaaaaaaaaaaaaaaaacaaaaaaaacccaaaacccctaaacaccaaaaaaccaaaaaaacttancccacaacccaacttcacagcccctttccccattttaccctattnaaatccattttcacatcacacttttcttacaatttcaaaattttacaaatacctaaaaacttcccattttcacaaatttattgcacctaacccccttttcccctttttgcaaatatccccaattaccaactaccccttccccttttccaaatttctaaacattccaaaactccaaacgatattgggaacctgctaactctttg

SEQ ID NO: 484297 - DNA, 265 bp, Homo sapiens
ttttatgccgacccaaggaatttagtgggtttgtcattggcccttttcccccaaaaataattttttcccaaagctaagataaatggaagactcttgaacctgtgaactgatgtgaaatgcagaatctcttttgagtttttgctgtttggaagatttaaaaatattgttcagcatgggtggccccccaaaagtaatttttagccctttagatgtccccatttaaaccaactggggagttgggtgctattgttaaataaaatatact

SEQ ID NO: 484298 - DNA, 4771 bp, Homo sapiens
  misc_feature (5)..(5): n is a, c, g, or t
tggangaaaacttaatcgaaacctggtcatcgggctgtccgggagctccggctcgggctgcggacgccatggagcttgctgaccacctggtgaagcgggcggctgccgtgcaggcggatgatgtggaggtgctgaaggtggggaggacccagctgatcgacgccgttctgaatctgtgcacctaccatcaccctgaaaacatccagctcccaccggggtaccagcctccgaacctcgccatctctaccctctactggaaggcctggcccctcctgctggtcgtcgccgcattcaacccagagaacatcggcctggctgcgtgggaggagtacccgaccctgaagatgctcatggagatggtgatgaccaacaactactcctacccaccgtgcaccctgacggatgaggagacccggacggagatgctgaaccgtgagctgcagaccgcccagcgggagaagcaggagatcctggccttcgaggggcacctggcggccgcgtccaccaagcagaccatcactgagagcagcagcctcctcctgtcgcagctcaccagcctggacccccaggggcccccccggaggcctccccctcacatcctggatcaagtgaaaagcctcaaccagtccctccgcctcgggcacctcttgtgccgcagccgaaaccctgactttctcctccacatcatccagcggcaggcctcctcgcagtccatgccctggctggcggacctggtacagtccagcgagggctccctggacgtgctgcccgtgcagtgtctgtgcgagttcctgctgcacgatgctgtggacgatgctgcttccggggaggaggacgacgagggcgagagcaaggagcagaaggccaagaagcggcagaggcaacagaagcagcggcagctgctgggccgcctgcaggacctgctactgggcccgaaggctgatgagcagaccacgtgtgaggtgctggactacttcttgcggcgcctcggctcctcccaggtggcctcccgcgtgctggccatgaagggtttgtcgctggtgctttcggagggcagcctgcgggacggggaggagaaggagccccccatggaggaggatgtgggggacacagatgtgctgcagggctatcagtggctgctgcgggacctgcctcgcctgcctctgttcgacagcgtcaggagcaccacagccctggccctgcagcaggcaatccacatggagactgatccccagaccatcagcgcctacctgatctacttgtcccagcacacgcctgtggaggagcaggcccagcacagcgacctggccctggacgtggcccggctggtcgtggagcgctccaccatcatgtcccacctcttctcgaagctctccccgagtgccgcgtcggacgccgtgctgagcgctctgttgtccatcttctcacgctacgtgaggcgcatgcggcagagcaaggagggcgaggaggtctacagctggtcggagtctcaggaccaggtcttcctacgctggagcagcggggagacagccaccatgcacatcctcgtggtccatgccatggtgatcctgctgacgctgggcccgcctcgagccgacgacagcgagttccaggcgctgctggacatctggtttccggaggagaagccactgcccaccgccttcctggtggacacatcggaggaggcgctgctgcttcctgactggctgaagctgcgcatgatccgttctgaggtgctccgcctggtggacgccgccctgcaggacctggagccgcagcagctgctgctgttcgtgcagtcgtttggcatccccgtgtccagcatgagcaaactcctccagttcctggaccaggcagtggcccacgacccccagactctggagcagaacatcatggacaagaattacatggcccacctggtggaggtccagcatgagcgcggcgcctccggaggccagactttccactccttgctcacagcctccctgccgccccgccgagacagcacagaggcacccaaaccaaagagcagcccagagcagcccataggccagggccggattcgggtggggacccagctccgggtgctgggccctgaggacgacctggctggcatgttcctccagattttcccgctcagcccggaccctcggtggcagagctccagtccccgccccgtggccctcgccctgcagcaggccctgggccaggagctggcccgcgtcgtccagggcagccccgaggtgccgggcatcacggtgcgtgtcctgcaggccctcgccaccctgctcagctccccacacggcggtgccctggtgatgtccatgcaccgtagccacttcctggcctgcccgctgctgcgccagctctgccagtaccagcgctgtgtgccacaggacaccggcttctcctcgctcttcctgaaggtgctcctgcagatgctgcagtggctggacagccctggcgtggagggcgggcccctgcgggcacagctcaggatgcttgccagccaggcctcagccgggcgcaggctcagtgatgtgcgaggggggctcctgcgcctggccgaggccctggccttccgtcaggacctggaggtggtcagctccaccgtccgtttccagcctgtaagcccgttgtggtggtgagctccctgctgctgcaggaggaggagcccctggctggggggaagccgggtgcggacggtggcagcctggaggccgtgcggctggggccctcgtcaggcctcctagtggactggctggaaatgctggaccccgaggtggtcagcagctgccccgacctgcagctcaggctgctcttctcccggaggaagggcaaaggtcaggcccaggtgccctcgttccgtccctacctcctgaccctcttcacgcatcagtccagctggcccacactgcaccagtgcatccgagtcctgctgggcaagagccgggaacagaggttcgacccctctgcctctctggacttcctctgggcctgcatccatgttcctcgcatctggcaggggcgggaccagcgcaccccgcagaagcggcgggaggagctggtgctgcgggtccaggcccggagctcatcagcctggtggagctgatcctggccgaggcggagacgcggagccaggacggggacacagccgcctgcagcctcatccaggcccggctgcccctgctgctcagctgctgctgtggggacgatgagagtgtcaggaaggtgacggagcacctgtcaggctgcatccagcagtggggagacagcgtgctgggcaggcgctgccgagaccttctcctgcagctctacctacagcggccggagctgcgggtgcccgtgcctgaggtcctactgcacagcgaaggggctgccagcagcagcgtctgcaagctggacggactcatccaccgcttcatcacgctccttgcggacaccagcgactcccgggcgttggagaaccgaggggcggatgccagcatggcctgccggaagctggcggtggcgcacccgctgctgctgctcaggcacctgcccatgatcgcggcgctcctgcacggccgcacccacctcaacttccaggagttccggcagcagaaccacctgagctgcttcctgcacgtgctgggcctgctggagctgctgcagccgcacgtgttccgcagcgagcaccagggggcgctgtgggactgccttctgtccttcatccgcctgctgctgaattacaggaagtcctcccgccatctggctgccttcatcaacaagtttgtgcagttcatccataagtacattacctacaatgccccagcagccatctccttcctgcagaagcacgccgacccgctccacgacctgtccttcgacaacagtgacctggtgatgctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggaggatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtca

SEQ ID NO: 484299 - DNA, 1375 bp, Homo sapiens
  misc_feature (16)..(16): n is a, c, g, or t
  misc_feature (1015)..(1016): n is a, c, g, or t
  misc_feature (1019)..(1019): n is a, c, g, or t
  misc_feature (1023)..(1023): n is a, c, g, or t
  misc_feature (1026)..(1027): n is a, c, g, or t
  misc_feature (1037)..(1037): n is a, c, g, or t
  misc_feature (1045)..(1045): n is a, c, g, or t
  misc_feature (1048)..(1048): n is a, c, g, or t
  misc_feature (1052)..(1053): n is a, c, g, or t
  misc_feature (1064)..(1065): n is a, c, g, or t
  misc_feature (1089)..(1089): n is a, c, g, or t
  misc_feature (1092)..(1092): n is a, c, g, or t
  misc_feature (1103)..(1103): n is a, c, g, or t
  misc_feature (1111)..(1112): n is a, c, g, or t
  misc_feature (1120)..(1120): n is a, c, g, or t
  misc_feature (1123)..(1123): n is a, c, g, or t
  misc_feature (1132)..(1132): n is a, c, g, or t
  misc_feature (1141)..(1141): n is a, c, g, or t
  misc_feature (1143)..(1144): n is a, c, g, or t
  misc_feature (1146)..(1149): n is a, c, g, or t
  misc_feature (1156)..(1156): n is a, c, g, or t
  misc_feature (1160)..(1160): n is a, c, g, or t
  misc_feature (1169)..(1170): n is a, c, g, or t
  misc_feature (1172)..(1172): n is a, c, g, or t
  misc_feature (1174)..(1174): n is a, c, g, or t
  misc_feature (1177)..(1177): n is a, c, g, or t
  misc_feature (1179)..(1179): n is a, c, g, or t
  misc_feature (1181)..(1181): n is a, c, g, or t
  misc_feature (1186)..(1186): n is a, c, g, or t
atagcatagtagagcngggagactgcgccgacatggagctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaaaaaaaaaaaaaaaaacaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaggaaaacaaaaaaaaaaaaaaaaaaaaaanntgntggnccnnttggcccaanggcttttnaanttgnnaaagtttatcnngcggcccaatttggggccattggncanattgccctaangggggggnnttaaaatncangggcccggntttaaaacngnngnnnngggaaancccnggggttccnnantnaancngnttggngaaaaaacccctttttccaacgggggctatatccgaaaaggccccacaccaaggccctttccaaaaatgtcgccccccaaagggcaagggaaattggcgccctaaatttttggaaaaacccccggtaaattttggaaaaccacctctttttaaccaaagggccaaatcgggaaaccccctttaaccaaa

SEQ ID NO: 484300 - DNA, 4355 bp, Homo sapiens
aacggagattagtgagtgcgtctccgggtgttattgtcatcacgagggacgtggcgttgtcctcgtagctatctcgtgctgtcggcggtcaatttccagactttctcctccacatcatccagcggcaggcctcctcgcagtccatgccctggctggcggacctggtacagtccagcgagggctccctggacgtgctgcccgtgcagtgtctgtgcgagttcctgctgcacgatgctgtggacgatgctgcttccggggaggaggacgacgagggcgagagcaaggagcagaaggccaagaagcggcagaggcaacagaagcagcggcagctgctgggccgcctgcaggacctgctactgggcccgaaggctgatgagcagaccacgtgtgaggtgctggactacttcttgcggcgcctcggctcctcccaggtggcctcccgcgtgctggccatgaagggtttgtcgctggtgctttcggagggcagcctgcgggacggggaggagaaggagccccccatggaggaggatgtgggggacacagatgtgctgcagggctatcagtggctgctgcgggacctgcctcgcctgcctctgttcgacagcgtcaggagcaccacagccctggccctgcagcaggcaatccacatggagactgatccccagaccatcagcgcctacctgatctacttgtcccagcacacgcctgtggaggagcaggcccagcacagcgacctggccctggacgtggcccggctggtcgtggagcgctccaccatcatgtcccacctcttctcgaagctctccccgagtgccgcgtcggacgccgtgctgagcgctctgttgtccatcttctcacgctacgtgaggcgcatgcggcagagcaaggagggcgaggaggtctacagctggtcggagtctcaggaccaggtcttcctacgctggagcagcggggagacagccaccatgcacatcctcgtggtccatgccatggtgatcctgctgacgctgggcccgcctcgagccgacgacagcgagttccaggcgctgctggacatctggtttccggaggagaagccactgcccaccgccttcctggtggacacatcggaggaggcgctgctgcttcctgactggctgaagctgcgcatgatccgttctgaggtgctccgcctggtggacgccgccctgcaggacctggagccgcagcagctgctgctgttcgtgcagtcgtttggcatccccgtgtccagcatgagcaaactcctccagttcctggaccaggcagtggcccacgacccccagactctggagcagaacatcatggacaagaattacatggcccacctggtggaggtccagcatgagcgcggcgcctccggaggccagactttccactccttgctcacagcctccctgccgccccgccgagacagcacagaggcacccaaaccaaagagcagcccagagcagcccataggccagggccggattcgggtggggacccagctccgggtgctgggccctgaggacgacctggctggcatgttcctccagattttcccgctcagcccggaccctcggtggcagagctccagtccccgccccgtggccctcgccctgcagcaggccctgggccaggagctggcccgcgtcgtccagggcagccccgaggtgccgggcatcacggtgcgtgtcctgcaggccctcgccaccctgctcagctccccacacggcggtgccctggtgatgtccatgcaccgtagccacttcctggcctgcccgctgctgcgccagctctgccagtaccagcgctgtgtgccacaggacaccggcttctcctcgctcttcctgaaggtgctcctgcagatgctgcagtggctggacagccctggcgtggagggcgggcccctgcgggcacagctcaggatgcttgccagccaggcctcagccgggcgcaggctcagtgatgtgcgaggggggctcctgcgcctggccgaggccctggccttccgtcaggacctggaggtggtcagctccaccgtccgtgccgtcatcgccaccctgaggtctggggagcagtgcagcgtggagccggacctgatcagcaaagtcctccaggggctgatcgaggtgaggtccccccacctggaggagctgctgactgcattcttctctgccactgcggatgctgcctccccgtttccagcctgtaagcccgttgtggtggtgagctccctgctgctgcaggaggaggagcccctggctggggggaagccgggtgcggacggtggcagcctggaggccgtgcggctggggccctcgtcaggcctcctagtggactggctggaaatgctggaccccgaggtggtcagcagctgccccgacctgcagctcaggctgctcttctcccggaggaagggcaaaggtcaggcccaggtgccctcgttccgtccctacctcctgaccctcttcacgcatcagtccagctggcccacactgcaccagtgcatccgagtcctgctgggcaagagccgggaacagaggttcgacccctctgcctctctggacttcctctgggcctgcatccatgttcctcgcatctggcaggggcgggaccagcgcaccccgcagaagcggcgggaggagctggtgctgcgggtccaggcccggagctcatcagcctggtggagctgatcctggccgaggcggagacgcggagccaggacggggacacagccgcctgcagcctcatccaggcccggctgcccctgctgctcagctgctgctgtggggacgatgagagtgtcaggaaggtgacggagcacctgtcaggctgcatccagcagtggggagacagcgtgctgggcaggcgctgccgagaccttctcctgcagctctacctacagcggccggagctgcgggtgcccgtgcctgaggtcctactgcacagcgaaggggctgccagcagcagcgtctgcaagctggacggactcatccaccgcttcatcacgctccttgcggacaccagcgactcccgggcgttggagaaccgaggggcggatgccagcatggcctgccggaagctggcggtggcgcacccgctgctgctgctcaggcacctgcccatgatcgcggcgctcctgcacggccgcacccacctcaacttccaggagttccggcagcagaaccacctgagctgcttcctgcacgtgctgggcctgctggagctgctgcagccgcacgtgttccgcagcgagcaccagggggcgctgtgggactgccttctgtccttcatccgcctgctgctgaattacaggaagtcctcccgccatctggctgccttcatcaacaagtttgtgcagttcatccataagtacattacctacaatgccccagcagccatctccttcctgcagaagcacgccgacccgctccacgacctgtccttcgacaacagtgacctggtgatgctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggaggatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtca

SEQ ID NO: 484301 - DNA, 3621 bp, Homo sapiens
cggacataagggcgagaggtctacagctgggtgagggcgagaggtctacggccgggtgagggcgagaggtctacggctgggtgaggctgcacggaaggctcggtgccagctgtgtaccctcggcgctggcccagggtccctgaaccttacggcctgattccacctcttttcccacagtcggagtctcaggaccaggtcttcctacgctggagcagcggggagacagccaccatgcacatcctcgtggtccatgccatggtgatcctgctgacgctgggcccgcctcgagccgacgacagcgagttccaggcgctgctggacatctggtttccggaggagaagccactgcccaccgccttcctggtggacacatcggaggaggcgctgctgcttcctgactggctgaagctgcgcatgatccgttctgaggtgctccgcctggtggacgccgccctgcaggacctggagccgcagcagctgctgctgttcgtgcagtcgtttggcatccccgtgtccagcatgagcaaactcctccagttcctggaccaggcagtggcccacgacccccagactctggagcagaacatcatggacaagaattacatggcccacctggtggaggtccagcatgagcgcggcgcctccggaggccagactttccactccttgctcacagcctccctgccgccccgccgagacagcacagaggcacccaaaccaaagagcagcccagagcagcccataggccagggccggattcgggtggggacccagctccgggtgctgggccctgaggacgacctggctggcatgttcctccagattttcccgctcagcccggaccctcggtggcagagctccagtccccgccccgtggccctcgccctgcagcaggccctgggccaggagctggcccgcgtcgtccagggcagccccgaggtgccgggcatcacggtgcgtgtcctgcaggccctcgccaccctgctcagctccccacacggcggtgccctggtgatgtccatgcaccgtagccacttcctggcctgcccgctgctgcgccagctctgccagtaccagcgctgtgtgccacaggacaccggcttctcctcgctcttcctgaaggtgctcctgcagatgctgcagtggctggacagccctggcgtggagggcgggcccctgcgggcacagctcaggatgcttgccagccaggcctcagccgggcgcaggctcagtgatgtgcgaggggggctcctgcgcctggccgaggccctggccttccgtcaggacctggaggtggtcagctccaccgtccgtgccgtcatcgccaccctgaggtctggggagcagtgcagcgtggagccggacctgatcagcaaagtcctccaggggctgatcgaggtgaggtccccccacctggaggagctgctgactgcattcttctctgccactgcggatgctgcctccccgtttccagcctgtaagcccgttgtggtggtgagctccctgctgctgcaggaggaggagcccctggctggggggaagccgggtgcggacggtggcagcctggaggccgtgcggctggggccctcgtcaggcctcctagtggactggctggaaatgctggaccccgaggtggtcagcagctgccccgacctgcagctcaggctgctcttctcccggaggaagggcaaaggtcaggcccaggtgccctcgttccgtccctacctcctgaccctcttcacgcatcagtccagctggcccacactgcaccagtgcatccgagtcctgctgggcaagagccgggaacagaggttcgacccctctgcctctctggacttcctctgggcctgcatccatgttcctcgcatctggcaggggcgggaccagcgcaccccgcagaagcggcgggaggagctggtgctgcgggtccaggcccggagctcatcagcctggtggagctgatcctggccgaggcggagacgcggagccaggacggggacacagccgcctgcagcctcatccaggcccggctgcccctgctgctcagctgctgctgtggggacgatgagagtgtcaggaaggtgacggagcacctgtcaggctgcatccagcagtggggagacagcgtgctgggcaggcgctgccgagaccttctcctgcagctctacctacagcggccggagctgcgggtgcccgtgcctgaggtcctactgcacagcgaaggggctgccagcagcagcgtctgcaagctggacggactcatccaccgcttcatcacgctccttgcggacaccagcgactcccgggcgttggagaaccgaggggcggatgccagcatggcctgccggaagctggcggtggcgcacccgctgctgctgctcaggcacctgcccatgatcgcggcgctcctgcacggccgcacccacctcaacttccaggagttccggcagcagaaccacctgagctgcttcctgcacgtgctgggcctgctggagctgctgcagccgcacgtgttccgcagcgagcaccagggggcgctgtgggactgccttctgtccttcatccgcctgctgctgaattacaggaagtcctcccgccatctggctgccttcatcaacaagtttgtgcagttcatccataagtacattacctacaatgccccagcagccatctccttcctgcagaagcacgccgacccgctccacgacctgtccttcgacaacagtgacctggtgatgctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggaggatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtca

SEQ ID NO: 484302 - DNA, 480 bp, Homo sapiens
attccctttccatctctctgccaagctaatgagcctctgaatttcgtggagctggagtccctgccatcttggcagctttcattccgggtcttgtttcttttgctgtgtctgctagggaactttgtagtctgggggcaaggtaacctccccagcaaggcgcccctcaatcagtgccaacttgagatgacgtgctgattattttgtgcagacgtcaccaggaagagtgagtgctttggagccataataaataacttggacagctgctccttgacttacaaatggagttatgtcctgataaacccattgtaagttgaaaataccttaagtcaaaaatgtgtttgatacatctaacctaccaaaccaaatagttcagcctggcccaccttaaacatgctcagaacacttactttagcctgcagttgggcaaagtcatctaacacaaaactattttaaaataaagtgttgaatatctcatgtaaa

SEQ ID NO: 484303 - DNA, 1400 bp, Homo sapiens
  misc_feature (1399)..(1400): n is a, c, g, or t
cttgaacacgggaggcagaggttgcagtgagcagagattgcgccattgtactccagcctgggcaacaagagtgaaactccatctcaaaaaaaaaaaaaaaaaaaaagaaaatgaatctgccacgccatggcttaaacccttttaatgactctgtgagtgtactggggatgaggtccaaattttactaattaaggcctgcaaagcccgtgtgtaatttggctacctagttaatgggctgggcaaatcttggcaaccaacaaactaacaagccacacttggccaaccatcccccttggccaacaacaacaacatatttaacaacatgaacacaataagtagtggtttcactggtggtttgcgcaaatatcacagtctttttctcattctcccaggccttctttggagctttctcctctggccttgagaagatacggctcccagttcacattaagacatttggggggcacctaacattaaaaattacgctggtttaatcttggaatctcgggaactcgtatccatttgggaacccaagtttgggaacatttggctaacttctggtaaagctaggccttataattcttggaagttggctaattactcatacaaactcattttatgcatttagaccacacaagtcacctatggtcactggcacaaccatagttgtactccagaacgaggaaatagcttagggatgtggaattgtgcgctgtctccaggcgacaccgactattcggcactaatatgaagaactgtccataaacattattcggtattgcgtggacagattatcacgaaagaagaatgccttaaaagaggagcttaaaacaaacggggcgccaacatatgacgaggacaggaggtatggaacacccctgtgcaagaacaatccccgccgagtgcagacaacattggtagagccccccacatctgtgcgcgcgaagcagcgccatgatgaacacacagatgagagaaggagagacccccaaggaaagagatatagtcgacgagcacgacaccagccagcgacacaagacagaatacggtgacgaaaaaatgtacaccccccgcagagagacgagatatggtggtcgcaactgagaacagcgaggggattagacacgccccatcaaaatttagtgaataaaccaccaaagtaggagatgaagtagacaaaacacaaaaccacccgatgatagtgacaaagagcaataggagtgaatccacacaacaacagagagaaggagactagtgatatggacgaactgcagaaaacaaaacactaactattagagtagatcatgaaagaacaagacaacataagtaaaaaatggcagcacagatataatcatctgctgtattaacgtatttatatatattattctaataatgatgnn

SEQ ID NO: 484304 - DNA, 468 bp, Homo sapiens
tcccccttttttttttggtttgggggcccatttccccttttcccttttggaatttgggtcaaacccccctgggccaccttgtgggaccccccttttttttaaccttaaaaaaatttccctgccttgtgggtttcccccttttttcccctttctttggggggtttggccgggggatttctttttccccggggggggggggttccgtttgcttaaattgcccccccttttcccccccttggccccccggggggtcccttttcaaaaaaaaaaggaatttttttcccggaccttgttttccccccgggtttttttttttcggaccccccaatggtttttttgggggggtggggtttaaaatgtttccaaatgtttttttttttttttactgggggggaaaaattttttttttgttttccccccgtgtttggggtttttttcccgggggttttttaaaggttggaccctgga

SEQ ID NO: 484305 - DNA, 3112 bp, Homo sapiens
ggctcagttgtcaaacgttacgacgcagtactcggctaatcgagcggtgaatcgccagtcctctcacggccaccaccgacacttgcagaattacatggcccacctggtggaggtccagcatgagcgcggcgcctccggaggccagactttccactccttgctcacagcctccctgccgccccgccgagacagcacagaggcacccaaaccaaagagcagcccagagcagcccataggccagggccggattcgggtggggacccagctccgggtgctgggccctgaggacgacctggctggcatgttcctccagattttcccgctcagcccggaccctcggtggcagagctccagtccccgccccgtggccctcgccctgcagcaggccctgggccaggagctggcccgcgtcgtccagggcagccccgaggtgccgggcatcacggtgcgtgtcctgcaggccctcgccaccctgctcagctccccacacggcggtgccctggtgatgtccatgcaccgtagccacttcctggcctgcccgctgctgcgccagctctgccagtaccagcgctgtgtgccacaggacaccggcttctcctcgctcttcctgaaggtgctcctgcagatgctgcagtggctggacagccctggcgtggagggcgggcccctgcgggcacagctcaggatgcttgccagccaggcctcagccgggcgcaggctcagtgatgtgcgaggggggctcctgcgcctggccgaggccctggccttccgtcaggacctggaggtggtcagctccaccgtccgtgccgtcatcgccaccctgaggtctggggagcagtgcagcgtggagccggacctgatcagcaaagtcctccaggggctgatcgaggtgaggtccccccacctggaggagctgctgactgcattcttctctgccactgcggatgctgcctccccgtttccagcctgtaagcccgttgtggtggtgagctccctgctgctgcaggaggaggagcccctggctggggggaagccgggtgcggacggtggcagcctggaggccgtgcggctggggccctcgtcaggcctcctagtggactggctggaaatgctggaccccgaggtggtcagcagctgccccgacctgcagctcaggctgctcttctcccggaggaagggcaaaggtcaggcccaggtgccctcgttccgtccctacctcctgaccctcttcacgcatcagtccagctggcccacactgcaccagtgcatccgagtcctgctgggcaagagccgggaacagaggttcgacccctctgcctctctggacttcctctgggcctgcatccatgttcctcgcatctggcaggggcgggaccagcgcaccccgcagaagcggcgggaggagctggtgctgcgggtccaggcccggagctcatcagcctggtggagctgatcctggccgaggcggagacgcggagccaggacggggacacagccgcctgcagcctcatccaggcccggctgcccctgctgctcagctgctgctgtggggacgatgagagtgtcaggaaggtgacggagcacctgtcaggctgcatccagcagtggggagacagcgtgctgggcaggcgctgccgagaccttctcctgcagctctacctacagcggccggagctgcgggtgcccgtgcctgaggtcctactgcacagcgaaggggctgccagcagcagcgtctgcaagctggacggactcatccaccgcttcatcacgctccttgcggacaccagcgactcccgggcgttggagaaccgaggggcggatgccagcatggcctgccggaagctggcggtggcgcacccgctgctgctgctcaggcacctgcccatgatcgcggcgctcctgcacggccgcacccacctcaacttccaggagttccggcagcagaaccacctgagctgcttcctgcacgtgctgggcctgctggagctgctgcagccgcacgtgttccgcagcgagcaccagggggcgctgtgggactgccttctgtccttcatccgcctgctgctgaattacaggaagtcctcccgccatctggctgccttcatcaacaagtttgtgcagttcatccataagtacattacctacaatgccccagcagccatctccttcctgcagaagcacgccgacccgctccacgacctgtccttcgacaacagtgacctggtgatgctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggaggatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtca

SEQ ID NO: 484306 - DNA, 133 bp, Homo sapiens
aactgaatgatactacagatgataggatgtatcatgtgtgctgtatgcatcggggtagtactgagtaacgaggtgcctaccggataggccgagacagtgttgtgggcaagaatgttagatttacgcctgatga

SEQ ID NO: 484307 - DNA, 5137 bp, Homo sapiens
  misc_feature (5)..(5): n is a, c, g, or t
tggangaaaacttaatcgaaacctggtcatcgggctgtccgggagctccggctcgggctgcggacgccatggagcttgctgaccacctggtgaagcgggcggctgccgtgcaggcggatgatgtggaggtgctgaaggtggggaggacccagctgatcgacgccgttctgaatctgtgcacctaccatcaccctgaaaacatccagctcccaccggggtaccagcctccgaacctcgccatctctaccctctactggaaggcctggcccctcctgctggtcgtcgccgcattcaacccagagaacatcggcctggctgcgtgggaggagtacccgaccctgaagatgctcatggagatggtgatgaccaacaactactcctacccaccgtgcaccctgacggatgaggagacccggacggagatgctgaaccgtgagctgcagaccgcccagcgggagaagcaggagatcctggccttcgaggggcacctggcggccgcgtccaccaagcagaccatcactgagagcagcagcctcctcctgtcgcagctcaccagcctggacccccaggggcccccccggaggcctccccctcacatcctggatcaagtgaaaagcctcaaccagtccctccgcctcgggcacctcttgtgccgcagccgaaaccctgactttctcctccacatcatccagcggcaggcctcctcgcagtccatgccctggctggcggacctggtacagtccagcgagggctccctggacgtgctgcccgtgcagtgtctgtgcgagttcctgctgcacgatgctgtggacgatgctgcttccggggaggaggacgacgagggcgagagcaaggagcagaaggccaagaagcggcagaggcaacagaagcagcggcagctgctgggccgcctgcaggacctgctactgggcccgaaggctgatgagcagaccacgtgtgaggtgctggactacttcttgcggcgcctcggctcctcccaggtggcctcccgcgtgctggccatgaagggtttgtcgctggtgctttcggagggcagcctgcgggacggggaggagaaggagccccccatggaggaggatgtgggggacacagatgtgctgcagggctatcagtggctgctgcgggacctgcctcgcctgcctctgttcgacagcgtcaggagcaccacagccctggccctgcagcaggcaatccacatggagactgatccccagaccatcagcgcctacctgatctacttgtcccagcacacgcctgtggaggagcaggcccagcacagcgacctggccctggacgtggcccggctggtcgtggagcgctccaccatcatgtcccacctcttctcgaagctctccccgagtgccgcgtcggacgccgtgctgagcgctctgttgtccatcttctcacgctacgtgaggcgcatgcggcagagcaaggagggcgaggaggtctacagctggtcggagtctcaggaccaggtcttcctacgctggagcagcggggagacagccaccatgcacatcctcgtggtccatgccatggtgatcctgctgacgctgggcccgcctcgagccgacgacagcgagttccaggcgctgctggacatctggtttccggaggagaagccactgcccaccgccttcctggtggacacatcggaggaggcgctgctgcttcctgactggctgaagctgcgcatgatccgttctgaggtgctccgcctggtggacgccgccctgcaggacctggagccgcagcagctgctgctgttcgtgcagtcgtttggcatccccgtgtccagcatgagcaaactcctccagttcctggaccaggcagtggcccacgacccccagactctggagcagaacatcatggacaagaattacatggcccacctggtggaggtccagcatgagcgcggcgcctccggaggccagactttccactccttgctcacagcctccctgccgccccgccgagacagcacagaggcacccaaaccaaagagcagcccagagcagcccataggccagggccggattcgggtggggacccagctccgggtgctgggccctgaggacgacctggctggcatgttcctccagattttcccgctcagcccggaccctcggtggcagagctccagtccccgccccgtggccctcgccctgcagcaggccctgggccaggagctggcccgcgtcgtccagggcagccccgaggtgccgggcatcacggtgcgtgtcctgcaggccctcgccaccctgctcagctccccacacggcggtgccctggtgatgtccatgcaccgtagccacttcctggcctgcccgctgctgcgccagctctgccagtaccagcgctgtgtgccacaggacaccggcttctcctcgctcttcctgaaggtgctcctgcagatgctgcagtggctggacagccctggcgtggagggcgggcccctgcgggcacagctcaggatgcttgccagccaggcctcagccgggcgcaggctcagtgatgtgcgaggggggctcctgcgcctggccgaggccctggccttccgtcaggacctggaggtggtcagctccaccgtccgtgccgtcatcgccaccctgaggtctggggagcagtgcagcgtggagccggacctgatcagcaaagtcctccaggggctgatcgaggtgaggtccccccacctggaggagctgctgactgcattcttctctgccactgcggatgctgcctccccgtttccagcctgtaagcccgttgtggtggtgagctccctgctgctgcaggaggaggagcccctggctggggggaagccgggtgcggacggtggcagcctggaggccgtgcggctggggccctcgtcaggcctcctagtggactggctggaaatgctggaccccgaggtggtcagcagctgccccgacctgcagctcaggctgctcttctcccggaggaagggcaaaggtcaggcccaggtgccctcgttccgtccctacctcctgaccctcttcacgcatcagtccagctggcccacactgcaccagtgcatccgagtcctgctgggcaagagccgggaacagaggttcgacccctctgcctctctggacttcctctgggcctgcatccatgttcctcgcatctggcaggggcgggaccagcgcaccccgcagaagcggcgggaggagctggtgctgcgggtccaggcccggagctcatcagcctggtggagctgatcctggccgaggcggagacgcggagccaggacggggacacagccgcctgcagcctcatccaggcccggctgcccctgctgctcagctgctgctgtggggacgatgagagtgtcaggaaggtgacggagcacctgtcaggctgcatccagcagtggggagacagcgtgctgggcaggcgctgccgagaccttctcctgcagctctacctacagcggccggagctgcgggtgcccgtgcctgaggtcctactgcacagcgaaggggctgccagcagcagcgtctgcaagctggacggactcatccaccgcttcatcacgctccttgcggacaccagcgactcccgggcgttggagaaccgaggggcggatgccagcatggcctgccggaagctggcggtggcgcacccgctgctgctgctcaggcacctgcccatgatcgcggcgctcctgcacggccgcacccacctcaacttccaggagttccggcagcagaaccacctgagctgcttcctgcacgtgctgggcctgctggagctgctgcagccgcacgtgttccgcagcgagcaccagggggcgctgtgggactgccttctgtccttcatccgcctgctgctgaattacaggaagtcctcccgccatctggctgccttcatcaacaagtttgtgcagttcatccataagtacattacctacaatgccccagcagccatctccttcctgcagaagcacgccgacccgctccacgacctgtccttcgacaacagtgacctggtgatgctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggaggatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtcaaaaaaaaaaacaaacaaaaaaaaaaaaacatcacaaaactaacataacaacaaactcaacgaaacacaaaacacacactcacaaaaccaaaacacacgccgcggccttctttttggggggcggacacaaaacagtgcatggcggcggccagtgccatttgttttcccccccccccccttttttctccccggggggtttatcgcgcgccccta

SEQ ID NO: 484308 - DNA, 1403 bp, Homo sapiens
ccacgcgtcggactagttctagatcgcgagcggccgcccttatatttttttttttggagatagaattctcactctgttgcccaaactggattgcagtggtgcaatctcgtgtcactgcaacctctgcctcccagtttcaagcaatcctctcgccttcagcctcccaagcagttgggatcacaggcttgtgccataaggtcatgaggccttttgcgctcatgaatggcctgtccattatcgtgggagtttggtatagtaacctcaagagtgagtgcctgggtaattttatatggtatttccaggtacgaaccggggtgtttacaccgatacctggccatgtgctggtcttggaactcccagacctcaatgtagatccgcccgtctacagcctcccaaagtactgggatcacatggctgtgagccaccactgtacttggcctatataaggagtcaatctaatatgcagaggttaaatccccaaggatcgtagggcccaagatccttcctagatctgataaggaacagctgaacactctattgtgacctcgtgcgtgagtattgaggacaaggaacatcatctgcacttacgagttttcatcttacactgtgctcaactttgacgccataaacaatatcgccagcatctagttgctttgcccaaaatttctccaagagtattcagaattacgggtgataccacagtgttgatttagttgactacatagaagattgcgcacttggtccccttttacactttgttcaaggatacctacacgtgatatctcttaagcagtggtgtacggccaataatcacgcgaagatcaaaggggaccaattgcctgacaggggacattggccacaggttgtttccccggatgactatgaacgcgaccctctagcttcatgtacacacacgggacaccgcacttgacgccacaccgaaggggaaaaaccaactacgcgatgattaatcgacagtgagcaccggacacgaaaaaagaacacgcaggcgctgacagaacaaaaacacgaaccagcgcccacgaacgccagaagtgaacggtattaggaagatacacgtgcggcgaaagagaaaaaaacgacacaccagaaagaccagcgttggcgaccccacacggagcacaggaccctgacggacgagacacagatgtaacgaacacacgaggactgcacgaagagaacgacgggggcccacatagtgccagcacagaacaagagaaggcgccgagcaagccaccgaggcgcaacggcagagacgacagagaagaccgagagggtacgacacgacaaaaacacacgacgaacacgcggactagcacgagcgagtcaaccgagaaagcgacgacgagagcgacgaatgacgggcgcgcgacatgaggtgc

SEQ ID NO: 484309 - DNA, 239 bp, Homo sapiens
tacaagcgggagcacattaacctgcgggctgcgacatgggatttcgacatttgctggggccttccatgccggggtgctctggtgctaggttaggaggcctggctggccggctaccagatgaatttttgaggctcacaaaatcccgagtgacccagagcaactttgcagttggctacaagacttatgaattcccagcttcacactattgtgagtcacgggacagagtttcgcggctccat

SEQ ID NO: 484310 - DNA, 1092 bp, Homo sapiens
  misc_feature (447)..(447): n is a, c, g, or t
  misc_feature (566)..(566): n is a, c, g, or t
  misc_feature (710)..(710): n is a, c, g, or t
cttcaaagggcctgtgtggatccccctccagggggaaccccccccgggtttttccgaacttgccccttctccaaaggttctccccctgccctgtcaatcccccctttcaatggcccccgttcttggttccacaagaccattgagcctgttcagagtcaatgaaagggggaaacccccaccccaactaattggaagaaatttcttcactcacaccttttggaggaaaagattgtagagatgattggcccacgaaagcccgctcgccgcgaattttctggcacaccacgcttgtgccccatagcccaccacaaacccctcgtggcccctgctgtcttcacaccacctctcacgaaagacccgcagttgttttccccacccccctcgcactcgagtggacccacagccccacgcgttggggcccgagaggatatttccacacacaaacgnctctcgcgagagcccacgttgtccccctctgaggagccaccccgccgaagagtttcccacaccgcacagcgacacactgcgggggctcttaagtgtgcccacggccacagcgctcgaanagagttcactttgaagacacaccccacagcccgcgggagaactctctgtccccgccgctctctctctctcgcagagagagcctcgcgagagcccactcgagagagagagggggtctcgggagactcgggagagactgggagagncacagcgcacactctgcacagaccggcgagaaacccacaggggttgttgcccggggccacacagattaactcacacacaggctgggccaccacagcttggcgcacaaggcttctctccctctggaagttggaacttcgagagtgtccctcgggagagcacaggcacagttgtgtggaaggcacgccactcccccgctgatgaactggcacgctataaggaggaacctcgcgaagtggaacccgaagccacgcgaattatacgaatgtacccacaggcccaaggaaagggaaggacacacaaagaaggccccacaggaggtgggtggagaatggagatgcgcctgggacacttgtgtgccaaacgacaggtttccaccaccca

SEQ ID NO: 484311 - DNA, 81 bp, Homo sapiens
tttctgtacaagtcgcattgggttttgttttaagttttactaatttctatatgaaataaaagatataatgattgtgctttt

SEQ ID NO: 484312 - DNA, 351 bp, Homo sapiens
  misc_feature (166)..(166): n is a, c, g, or t
  misc_feature (322)..(322): n is a, c, g, or t
ttttggagatggagtcttgctctgttgcccaggctggagttcaatggcacaaactcggctcactgcaacctccgcctcccaggttcaagcaattttcctgcctcagcctcccgagtagctggaattacaggcacacgccaccatgcccagctaatttttgtatttnagtagagacgggggtttcaccatgttggccaggctggtctcaaactcctgaactcaggtgatccactccctcggcctcccaaagggttgggattgcaggcgtgagcaccacggccagccatgatccttaaacttgttttaagaggtataataactngaaatcatgatgctctttaaggaatacca

SEQ ID NO: 484313 - DNA, 727 bp, Homo sapiens
gggttgcctaccatgtttgcctacaggaggtgtgcctctttgtcgccgggcgcctttgcgtcgtggtgactgtacatgcccgtagatgctatctctctttatttggggcacgatgtgtccccgctggtggcgccccttggttccgctgtgctatgcggggttctttatcaatctgcgcgtgggtgaacccccccaagcaggcgcgcttgggtggagtaatctgcatggctgggttcgggctcttctgtggtgttactggttctcgcgctcgctgtttggtgtctccgccgcgcgtgcacccccaacattgtgtggtaaacctccctgctactcgcgtctccccccccctcagataaggttatggcaggatttgttgcacacccccaaatccaccccccacacctccctcaggttataatagttatgtatactgttcgccacagctactcactctgacattgatttcttcttctatagaaaccagagaagttttcgacattgattgatgccccactctgttttgacagagccatgcgagacaacattgtttcactcctctcccctttgtgtgcccgtccactacttctcatcaccccctatcataataatgtatgcccccctccctttagatgataatattcatactaatctcccctctcgtccccccgagtacttctaaaatttttcgtagttatccctccccctgttttatcaatagtcacaaaat

SEQ ID NO: 484314 - DNA, 605 bp, Homo sapiens
aacgatggtcctcagctgcattacagccccagttcctggcctgtcttgggggaagtgaaggtgtgtgagaggatggcgccagatactgatgctaagaagtttgcagcagatgcagactaaagaggacagaccagggacagatgagggttcactgggaggatgaagcagaatccccaggcttagctgaaggatgagaaacatggggttgctactgttcttgaggaggagatggatgaatgtgagcagtcgtgggctggagatcgcgaatgccaagtgagcattcatgtcacctgtccaagagtaccttagtgtcggaagaatttaagcgcaatgtactccagtagaggacatagtctctgtggtcctggcatatttctaggaacactttgataaggacggctggtccctgtggtactcagagtatcgcttccctgaagaactcactcagaccttcatgagctgcaatctcatcactggaatgttccagcgactggacaagctgaggaccatcgtcaacgatggtcctcagctccacgaagaatgtactattacctgaatgcttctattccttttatgatcttcgaaaagaattgagaaatgttgcc

SEQ ID NO: 484315 - DNA, 802 bp, Homo sapiens
  misc_feature (723)..(723): n is a, c, g, or t
agcgggcggggatggggtgcgagctgcgcggcgcctgcccggcgtgcggagcgggctccccggtgccgccgccgagtagggggagccggaagtcggcgcgggcgcccctcggcccgacgacgccgtgaccttggccgtcccgctcacctctcggaatctcgcctgtccgggaccgcgaagtggggggcgaccgcggacgtccctctccgtcggcgcagtcctcgacggcgcttgggatttgaccccggcgcgcttgcatcgacccttctcccgagaaggggtatcgtgacatctagtcctactactagatggtagaatgtaagctgtgaactgactcatgatgtatagaaatcagagggcacatcaagctaaagatcatagcaggtagggcaactttgcttcacaataggaaagttacccatacatttagcaatttctacgttataactggagcttagttctattataaatttggaccttcaatactggaggctgagccagtgaaagcaagacatatgagcacagtcatactggagaagagccatcgaattagtccctatttcccctggagaaacgctagcccttcctgagaaactcgaaagcaatttcgatccaatagtactagtttggtgacggactttcgacttatgagacgagacgaaaagtcatcctcaagtgctggttgaaggtgttttatcgagacattgaaggtgggcccgtcgngcgggaaccagggttccatcacgtatccccttggctaagccgctaggaacttcgacagtaagcaagggaaaagcggatg

SEQ ID NO: 484316 - DNA, 292 bp, Homo sapiens
agaggagatctcatatgtagcgcacaagagaacaggcgttgtaaaccacatcacctgtttaaagaatctgattggtaaattaactcttgaactactagcattttagctctaatagttttaaatgatttgtcatttgcttataaagctttcatctgtcaaattgttttataattcagtcaacaaatatttgtttagaaaatatatgagtacttattttagataggcgctgaggctacagctgtaaataaaacaaagttcttatccttatatatatctgtctgcctgggagaga

SEQ ID NO: 484317 - DNA, 425 bp, Homo sapiens
  misc_feature (13)..(13): n is a, c, g, or t
  misc_feature (119)..(119): n is a, c, g, or t
  misc_feature (417)..(417): n is a, c, g, or t
taagtatcctgtngagagttactctactaaaaatacaaaaattagctgggtgtggtagctcacacttgtgatcccagctacttgggaggctgagacaggagaatctcttgaacctttgnctcccagtctcaagcagttccactgcctcaacctcccaagtagctgggattacatgtgtgcaccaccatgtttttgttttttcagtagagacagggtttcaccatgttggccagactggtctcgaactcctaatctcaggtgatcggcccacttcggcctcccaaagtgccaggattacaggcgtgacacccaaaccctgccaaatatcctgtttctcatggaaactttcaccttctggttttataggccaaagtctaaggcaggaagcccctgcgaaccatttccaacattgacagnatcattcc

SEQ ID NO: 484318 - DNA, 114 bp, Homo sapiens
agtcctgaggtggtcgtgggcatgtagacgttgtgaggattgctgggttgtaataggcgctggcggtgcttctgctggacttgtgcttcggcttgcaggaagtgtgaggggaca

SEQ ID NO: 484319 - DNA, 364 bp, Homo sapiens
ataaaattccaccccaagggcaagggctttttgggaaatcccctcaaggggaatttccccaagttccttttcgccaagaagggggggggggtgaagggcttcggccccctggggggccccctggggataaaaagggccccccccccctttttttagccccccaaggggggggccccgccggggcccctgcccacgcccttggggccttcccccggcattttatagggcccccctgcaaccctgtgggggggggaaccccaaaaatccggggggcccccccccgggggagggtcccctggcctgtgggggttgggtggggcccccccccccggggtcccttgggggaataacccgccaaattaga

SEQ ID NO: 484320 - DNA, 363 bp, Homo sapiens
cccctgggaattttgggggcccgtttgccatgcccgggggcccgggaaaggtttatcctaggatccggtccccccccgggcattttttttccttttttgggccccgggggccgggggagggggggggttccccccccgggcctaagaaggggccccggttttttacctggtggaggaagtttttttttgggcccgggccctttggggggggttgggggccattctggggggggttttttcccttttggggggtggggggggggggggggggggtattggtgggttttaaaaaaaaagggggtttagggctttttttttttttaatttggggcgggaataaatttttggggaatttttttccca

SEQ ID NO: 484321 - DNA, 396 bp, Homo sapiens
ccagtctaaagtagggaagcggccgtgttgcaactctagaaaggcctcaggtataatccacagctacatcacttgaagtgcattctacaacactggacgctcagtacatagcatccctgctgcctgccatgacaataggcgtgccagctcccatcccccgccggctttcccctccagatacactgtggaactatttgagcaggtgggacgagctatggccattgcagccctggacatggcggaatgtaatccgtggccccgaattgtactgtcagagcacagcagccttactaatctacgggcctggatgctgaaacatgtacgcaacagccgagccctaagcagcactctgaatgtgggtgtcaacaagaagaggggccttcgaactccacccaa

SEQ ID NO: 484322 - DNA, 449 bp, Homo sapiens
  misc_feature (448)..(448): n is a, c, g, or t
caccatttaagaagcacgtgattaaaataggtgatttcatgttttgtttttttaaatgagggttttcttttgcattttgtgtggcttggtgcctttgtgtgtgttacagagaaagcagaaaataatggggaaatattttagtacaggaagatgagaacatgcaaaatgaataatgaaagacttaccatttattcagataatgaggatttaatttgcctaaaactcaggcatcttaaaagataacttacaaccttaagactcctgttcctcccaagacttgctgttaaactgaagttaaaatgaatggaagaatgaatgaatatgaatgacagccaagtatagactttattgaccttttgcttcaccagaccagaatttactctacaaaaaggttcatcttaactacatttactgaatctgtccccacctcaaacttgaatcccattant

SEQ ID NO: 484323 - DNA, 575 bp, Homo sapiens
  misc_feature (29)..(29): n is a, c, g, or t
  misc_feature (122)..(122): n is a, c, g, or t
  misc_feature (125)..(125): n is a, c, g, or t
  misc_feature (129)..(130): n is a, c, g, or t
  misc_feature (152)..(152): n is a, c, g, or t
  misc_feature (168)..(168): n is a, c, g, or t
  misc_feature (175)..(175): n is a, c, g, or t
  misc_feature (212)..(214): n is a, c, g, or t
  misc_feature (328)..(328): n is a, c, g, or t
  misc_feature (347)..(347): n is a, c, g, or t
  misc_feature (374)..(374): n is a, c, g, or t
  misc_feature (380)..(380): n is a, c, g, or t
  misc_feature (402)..(402): n is a, c, g, or t
  misc_feature (421)..(421): n is a, c, g, or t
  misc_feature (450)..(450): n is a, c, g, or t
  misc_feature (471)..(471): n is a, c, g, or t
  misc_feature (524)..(524): n is a, c, g, or t
  misc_feature (526)..(526): n is a, c, g, or t
  misc_feature (533)..(533): n is a, c, g, or t
  misc_feature (535)..(535): n is a, c, g, or t
  misc_feature (547)..(547): n is a, c, g, or t
  misc_feature (549)..(549): n is a, c, g, or t
gtctctttactacaacagtgaaggatggnaaaatatgagttcagcatgtattttaatgttgcaaaggaatgacaactcagcaagctgtagaaaatggcagaggagacggggtaataacagangcnatgnnggctcctgggtgtgcccgaggncatcctacggccagcngcttggnttctcccagaatcagtttacagacttgctcagcctgnnngggggcccagggatcatgcaggaagaaaacggaatacgcttgattctgggattggtcattttaagacgcttttagtaagatggtttcctgtctacacccaagtcttgccaaccnagacgcatcaacgtgaacngctcagagacattcctgcacggggggnctgggnggtggcagcggaaaggtacctntgagctgccgtgcccggtngcgctggccacctccctgcgctccggttnccctcccccgctccctcaggngttcactttcagtttccccaccttgcagcagccgttaggctccgagtcacccncnctccatncntccctctgctcntnccctgcctgttgtgtggctccgtcta

SEQ ID NO: 484324 - DNA, 391 bp, Homo sapiens
atcctaatgtacatcttacatatattggctgatgtctgcctgtacttctgacccctaaaacgtataaaatcaagctgtaacccaagcaccttgggcacatgttctcgggacttcctggggctgtgtcacgggccttggtcactcatatttggctcagaataaacctctttaaacattttacagagtttgactcttgtttgtttgtttggttttgagacagagtctcactctgtcactcaggccggagtgcagtggcgcgatcttggctcactgcagcctctgcctcctaggttcaggtgattctcctgcctcagtctcccgagtagctgggattacatgcaggaaccactgtgcctggccaagatctctgttttaatgctggtcatttgtg

SEQ ID NO: 484325 - DNA, 213 bp, Homo sapiens
atcatgtatccctttttatcctatctggaaacaagacttggacacattattactctccaaataaaaagaatggagaagttgtataaatgaatgttagtgcttttaaactgtaaattatataacatgtaagttatatctagtttcagaagcatcccaacgtaatacatgaaatttgaaaggccaatttttgggtaaacagactactttctagaa

SEQ ID NO: 484326 - DNA, 209 bp, Homo sapiens
ggagtagcctcaaggtagtacataggtaaaatgggctattaggatgatccttgaagcctttagaatggtgcatgttggacactgtacatccacacaaagtagcttttcctcctatgttggaaaaaaagactgtttctttgttttgagaccaagtgaagttgttggtgtttgtttaggggccatattgttaccaaacaaacaaacaaaaa

SEQ ID NO: 484327 - DNA, 232 bp, Homo sapiens
gtagattgagaccagctgggcagatggcagatcctgtctctacaaattagaattagctgggcatggtgttgtgcaccaattgttccagctgacttgggaggctgagacgggaggatcccctgagcccaggaattcaaggcaacagtgagctatgattgtgccactgctctccagcctggttggattttttttttttttttttttttttttttttttttttttttttttattg

SEQ ID NO: 484328 - DNA, 197 bp, Homo sapiens
  misc_feature (179)..(179): n is a, c, g, or t
tgtgtgcagtctctggtgctggctccgtggggcacatttggttgcaaggtcctccccatactgcagtgcatttcatagggtttctccccagtcatggcattctctgtgtgtttggtcacgtgccgcagctgttccggcaagccttttaagccattcgtgtccattcatccaggtctctnctcctgcactgcgtcgcg

SEQ ID NO: 484329 - DNA, 300 bp, Homo sapiens
cgtgggagcagacagctttgacatcatgagtaaatttacttggttgacattgttggcgtccgtgtcgcgggttcacatatagagattcttcgactatgtgagtcatctccatgagagagtgtaagaggtagtcatcgtcggtccaacaccacttcctccccttcttcctcatcctcatcatcctcatccacagctgcttctgtgaagtcttccagatctgcttcagataggaaattcactttaataaacatcatagtcttcctcttcatcttcctcttcctcttcctcttcatcttcctc

SEQ ID NO: 484330 - DNA, 157 bp, Homo sapiens
tgtgcagtgtgtagccgagagaccgcgattcactgaatacgaagtgaggtcaaaacaagagaggcactcaaaaacaccaggtaacctaccttcttttttttttccaggttctttttttctttttttttcttttttttaatctatcatggcaccaggg

SEQ ID NO: 484331 - DNA, 169 bp, Homo sapiens
acgaatcgagctggtacccgctcacacatgcacagccgctcacaacagcacaggtgggagtcttttgtatatagttgtaaattatgtcttggttatgtaaaaatgaaattttttagacacagtaatgaactgtattcctgtttgtatatttaataaatttcttgttttc

SEQ ID NO: 484332 - DNA, 143 bp, Homo sapiens
ttgaagcacaaagcttcactattgcagcggaagatagtgaggctcactttgggaaagattttggggcactcacacactctgggcccagggctgcatggccaaggtagggcttacttataaccaaggtgtacccaagccaccca

SEQ ID NO: 484333 - DNA, 740 bp, Homo sapiens
  misc_feature (721)..(721): n is a, c, g, or t
ggacttcaacatcactggtgaggccagtggggaggaagcgggttgttgagaaacctgtcactgcctgggggagggacacattcctcccctgtgagattggggccatatgggtatgacgcaggggatatatatccaacctgagtgaaaacagaagatccactaatacccattaaagccggcaagaggctctctgaggctccctgagtctccctttagttgacttcaaagctgccaaagatttggggacctcctcgcacccagccttctttctgaggcccacaccacagtgggcacccacgttgctgccatctgggagccaaagaccatctgagccctattcctgcagcaccagaacacaagcccggcccggtgagcagtccaccaatcagctcaggcctgatgaccagtccaccaatcagctcagtactccgggccaggcacaagcctcagatttctcataggtacaattattgaagatgaaaatagtattttcagacttcagtcatgattttagttacatccaagtgccaactttacaatggcaccctggttcacttgctttatccaagtgttacctgtgccatgacttttattaagttgtttttcttctaatggactgaatctcttaagcaaatttggaatgttgatggtcaggacttcatctgtctgtggcaagttatgcttaccttagacagaaagttaactgtaaaaataaaagttnctaaaaagaaaagaaaaaa

SEQ ID NO: 484334 - DNA, 980 bp, Homo sapiens
gtggagctggaccaggaggagctgcagctgggccggggcggagcgccggtcgcgccaggcccgcgagggaggggcgtgttgctgctggcccagcggagccgccccagcccgcgccgaggcgccttcccgccaggccggctggcttccggctctttccatttgcctccgtgaatcgtcagcccggcgacgctcgtggagcgcctgccgctctctgggtggagaagctcccgggcgcttcccggtttcactccttctcaggctgggctcccagccccctctctccttttcctggagctggctgctcacgcccccttcggtccccttcctttagctcaggctccctaccccttcctgttaggcccgacagaccagagtcccgagctcctcagtctgttgcctcaggcatgggtcccaggcttccttcttgctttcctttgcactatcccgtagtcctgcccgcgttcctctagtccctagggctcagtgttcccgacagtccgtgcgtcccccttcccaggaccggagtaccagagctttttggtctccgtttcgtggtcgttctgtgtccttgccgcccttttccccacgtttggagttccacgatgcggagccgggctcctcccagccccagaaaatgcttccatggagaatggctctctaaaacatgactattcctagagactaggcaaatctctattaccagtagttgaccctattgtacctatgttgccgggtttaatactcattgggaaagggcaaggtggtttggaagcaggaccatggttctgcggttggatttgtgggctttttcaatggatttccttacttaattcgaggtgttcgatggaggggatgagaagaaaggagatggatatagttatctcacatggaaagcatagagtaaggccaagaaaccaaggagagtcaacggcacagggaacaagagagtttaaatccaataatagaaaggagacgaagga

SEQ ID NO: 484335 - DNA, 1423 bp, Homo sapiens
gagcggggagctgcgtgcggaggatctggggcgcagagcagcggcgtggagtgaggcggacacgtggcaacagctggtagcagcccgggcggtggcagcaacagctggcggcgggatcaggccctatgccagcaggcctgccctgcattacatcaactgactccccgcaggcagaccctatacatccactacacactcttggttccacactgggtagcaagatacgactacagccagagagctagactctagcgctactaaatcaacatcgataactcacagacaacagaacccctgcaccgcccgaggacacctgcggcaaccgagcatccaactggcccgacaccggcgcttcgggaccgcccgactacaggcattcgagcccgctgccaagagcttgcaatcaaaagagacaacgggctgactacagaaacggcgcacacaacaggggacacagcacagaccacgcggagacactgggactggaaccctcaaagaccagcgcaaccgcccccccccccctgcgccgtgcaaatcgacaacacccctcacacgcccatgaactgaagacactacactccgctcgcaactactgccgcccccaacacctattgaaagcacatcaggagcatcttcccgcaatcctaccgatcgtagacagccctgagtaactaccattctacgacgcaaaaattacgatctaccataaacagaccaccatacatctcccacagtacactaccccaaaaataacgtacacctagcacactcgtaacactacaacgaacatacctacggtctcgaaccaagttcacacacaagacgaacagacaacacccaccacaacagtgctacacttgcgacacacattcggacacacccacccatcccacaccaacaccaaacccataaccacctacaacaacttactccgacccctccgatacaacacaagacaccaatagcaacacactcaaggtcaacccaactacaccactgaattccggtaataaccaacagcaacgacgcataacataacacacacaactatgccagtcatacctacatatacttgacatccagcccgtgccttacatctaccaaccaccaacagccaaactgcccaacctcagccaggcaaccccaccagaaaacaaccgcatgcacaaacacaacactcctacaccacgaggcaccacatagcctcaccacaacaacacacacaatcccaagtacacagccacgcccaaatgacagatcagaactcgctgactccacctacactgcacatcttctctagtcctatcctagctccaggccctcatagcgtctatatcacagacaaatgctaacactcacacgcacccagctccacaactagcacctcataccaacaccaacctcaagcaaacagcatagtcag

SEQ ID NO: 484336 - DNA, 245 bp, Homo sapiens
tgaatatcagcaggattgagtgtttgactgattgctaaagtagtataccatgtgtgtatattgccacatttcctttatccattcatctgctgatggacacctaggttgcttccaaatcttggctattgtgaatagtgctgcaatgaacataggagtgtagctatctctttgatatactgatttctttcctttttgatatatttcagcaagccacggtcaatcccacaagccacggttcaacccac

SEQ ID NO: 484337 - DNA, 264 bp, Homo sapiens
gtggcgatcgacctcgcgcaggaactttcgccgtccgcgatcatccaggtgcagcgcattccgcccgcccacgttgacgaaaccaccgcgctcagttgtgccggcaatgcgtcggtcctgtggaaaccggtgagcaaaacgcgtttggcggtctatgccgtgggctgcgacccggcggatcacgccgagacggtgcaattccgtctcaagattcttgaccagccttccctaaatacgcccggaccgattaagctgctcccctag

SEQ ID NO: 484338 - DNA, 125 bp, Homo sapiens
ctcctgggcatgtcctcctgctcagctcctctagctcctccagccgttcatcctcatccacatcatctccaaagcccatagggcgagaaatggcatctgagatctgctgggcacacattatggag

SEQ ID NO: 484339 - DNA, 156 bp, Homo sapiens
agactctcaacaacataagcacatggagggggtgaggggggtcatagtagaagagcgacggtgagagctaagtgtcgggcggtgatgtagaggggtgatggtagatgtggcgggtttagggggctctttgggtgaaagagtttttatgggcgtcag

SEQ ID NO: 484340 - DNA, 219 bp, Homo sapiens
ccaccgagataatctgcatgtctgggcagtagcgtgtttcgccaggctttaggatcacagtgtggtaagatcagctacatagcattcatgaccgtgaggctattggcaccacacatcagccaagaactgaccagtgaggcgccattcgcgtaatcgatagctgagtgtatgctgttgtaatggcaatcctagaaatagatttcttggtcaaatcgttcg

SEQ ID NO: 484341 - DNA, 533 bp, Homo sapiens
cacgagggccttgtcgctcgcgctgggcagcagcccggcgatggccgacccatccaaggatgcttcgatgctgaagctcgccgccagcagtggctgcaccgtctgtcacagcgtggagccggccaagaatgccgacggccgcacgccggtcgggcctccgtggcgtgacgtcgccgcgcgctactacggcgtcaaggacgcgcagaagcagctggtgcagacggtgatgaagggctccaacccctacgacagtcactggaagggcaaggccgccggtctggcgatgccgcccaatgcggtggccatcaacgaagccgacgccagcaagctggtcggctggatactgtcgatggacgtccgctgaaacttgacttgaaccccgcacccccttaaggtgcgggtccgcgccgatttgagcctccagcttgcgggcgcgttataaatgccgctaaagcgagctgcccacgacccgtcagcacgctttccgcgttcggcgggtttttcgcttttgtgtccgccattcgatgatcacg

SEQ ID NO: 484342 - DNA, 81 bp, Homo sapiens
ccggcacgaggctaacatgagataagtggaactacaagttgtataggctttattgtttattgctggtttatgaccttaata

SEQ ID NO: 484343 - DNA, 277 bp, Homo sapiens
  misc_feature (249)..(249): n is a, c, g, or t
gtgctctagaggattctttgcggtgcctttccatacacacctggagaacaggggaggttctcggcggcgcaaggtctacttcgcgtcctgctgacggtggcgctgacgggaaactggagtactaacggacatcatgcacacgctcttcctggagctcctggagcagtacgtggtgggcaagaaacccaaagctgatgcttgcgcaggtctgagactgtggtggagaggatgctgtccaacgtggatgtnccatctgcctgtaccaggtaccttcaag

SEQ ID NO: 484344 - DNA, 622 bp, Homo sapiens
  misc_feature (34)..(34): n is a, c, g, or t
aaagatttaggcaatagacacattcattcagggntggtgtgtaaacccatttcttgtaacaaaataccttcccatcagaaatgcatgttcacagaaaaaaaattactgcagcatgcccccctcccaaaattagctaataaaccctctcttgcagaacataaagaaccatagttgtgtataaattatcataattgtgtatttcatgcccccacgacccatatcttcaatagttggcttaccatttataggtaaaagaaacattctctaacccccatgcccttgaaccattgtctgggccgatttcattccagaagatagtgccttaaaccttgtcagctcagctgtatcttttcacattctacagcctccagagggtctagattccatatcatcaatacatacctgataaccctttgagaacattttctacctgtaaccctcagaagtcattagtagttccgatccagaaattctacctgtatgcttcagcattacaacatatatgtggcatttaaaatacacaggttaaaaaatgtccctttgatgaagctgtcctgtacacaggcctggtagagcctcaaatactcctgtcaatcctgtccacctatcacagccatcgctg

SEQ ID NO: 484345 - DNA, 190 bp, Homo sapiens
  misc_feature (59)..(59): n is a, c, g, or t
  misc_feature (62)..(62): n is a, c, g, or t
  misc_feature (149)..(149): n is a, c, g, or t
ccggtcttcagtcatttacgccttaatctactgagctactcacagatagaacttgcatntanactaattatcatgacgcgctgtgaaatctgcgctgtccatccatagtagtagacacttgtgctgagattctcccatctgtacacaantgggggagaagataatagaagtcattagtaatcacaaagta

SEQ ID NO: 484346 - DNA, 103 bp, Homo sapiens
tatacctgggccagagttagagggggcacgataaggttgacgaacattcgacttccctgcaaaccttggtatagatcacttccttttctgttaggaaacgaaa

SEQ ID NO: 484347 - DNA, 560 bp, Homo sapiens
gatctagaggatcccgtctattactgaatccccatcgaacgatcgctcgaccacccacacctgacgtaagtgacctcttccatttccttcaggttgtggatcgggttggactcctcaaccaccttgacggccggatcctgatggatcgtccgccacacagcgaacggattgagctccaccttggctgccgacgtaccgcgcgaacgatgcacgcggattgccttgaccatttcctggtagaccatacccggccagcgctcgtaaccacggatacgctgataggccatgtcggtttcagccggcgaccagtcgctctccagcagttcgcacgaacggaacaccagaccaatgaaggtctccggctccttcatctcctgcaggatctccagggtgatcggatcgacgaacagatcgaccatcaggtccatctcgcgcaggtagcgcatgccgatcttttcgttctccaagatgttcaggtcaatgtccttcttgtcgaacagaccaatcggatagttacgcagccacttgtcgaactggaggaagcagccagatcagcgtgc

SEQ ID NO: 484348 - DNA, 981 bp, Homo sapiens
ggcagcgaacgctgaatactgtgtactattgagcgcgattgtgccgaccggctagcgtagttgctctcgtaactagttgcactgtgcgcattgtgcgagtgctttgcggtcagtgatctccctttcgatcagttcaagcggatacaggtcgacatacactagacgctatgatacatagttgtgctatcgctcttacgcacttgcacaactaagcggatttagggtcataaggggggttccctggctttgacatccagacatgacttcctagtgggctttggtgtcgctcatgaggtcgtgtcgatcgtctacacacagccaatgaatctcgtggaccttgcgttggtgcgaatgtcccctcgtattagggggagaagatcttgagaaaatggagtaacgcatgtcaagtctcgtaagacgacggtacctagtgggtcccttggtgcgtcttctgtatcgcaatgtgagcattcatctggcatggaaacccaaaaccaacaaataaatgggccttccaccaggatttttgtcaatcatgcagcgtgaacccaatagaaacgtggaagtatgtgtatctgtgaatgagacagaatcaatggctggcattggttacatgggaccacaaaagctggaaaacgacggcacaggggccactgcacacgtatatgcctgcgcacagacgaccccaatgatggagactgacagaactaagcaaaggtacgccaagcgaaacaagtgagagccacacggcacacccacagccaaagagagaagaacttcaaacagcaagttgagagacatagcaacatggatagaaaaccaacactgcgagaaataaacaagcccataaagcaaggatagaccacgcacatcaagagaaatacgtccaagacccaacagaccccacgaaaaactacacgcccgtaatgactagacaagagccacatccaagaggacgaaaagccaaacacacaaaataca

SEQ ID NO: 484349 - DNA, 415 bp, Homo sapiens
agcgcatacactattagggagaaacccgacgtatattagcgtagcatgaatctgggactgacttacttacttctcaggatacaggtagacttaagaaccaataactccttgacttgggataaccgataaagatatccaccacctgagatgcttttctgggaacaacaggcagggacgtgacatgtcagactatgtatgcattagcatgccctatggaatttaaagatgcacagacaggggctcagataatatatgaccccgttgttaaggcacgttaaatgacatctcattcatcataagagcatgctctgttgattattgcttttgaaggcgatgttcttcatcgcgttcccgcttcattcacaccagtcatagcgccctacagagataactgctgctgtgaacaactacacgg

SEQ ID NO: 484350 - DNA, 199 bp, Homo sapiens
cggacgcgtgggctgcggcgcggtctggctgccccatgggcctgcgctgtagactgtcccccataggtcgccccagggcctctgcccaccctgagccccaccactctcagaacccccgatccagctgcactggctgacctcgctgcctcacctggaagaccttgcctctgtgcctgtggaggtccaggaggaaactgtg

SEQ ID NO: 484351 - DNA, 176 bp, Homo sapiens
cgaaccgagctggtaccccgagttgtgaaagtccattagcaaacaaggatgctgtgactcaatgtggggtggaggtggtgggactgtttccacagactccaagcaatgaagtcagttctgcagcagtcactagcagggctatcctccagtgcagttctgagattacctggagatag

SEQ ID NO: 484352 - DNA, 891 bp, Homo sapiens
gcccaactattcgatcgaagaggagtccttggtaggaaggatagaaggtgatcgaagaggctatcctagtgaagcatcttgtctaatcgtatagagcgtgtggatcctcatgcaattaagaatagagcgaaaggtgcaagttacagggtgccgcatttgagtaaggttgctaagttcgaaagtccgttggaaccttaacgtggaagttcttgaatacagacatgtgaagacttatgaatgaagtctggaattttgagatattcggaggtgaaaattgtcatttttgtataatagtgctgactgtaattgggttttgaaattagaacagagttgttaaccatacattgtgggctccgtgacctttcctaaggacaaaccgtgtgcaggccattgacagcacaagccctaaagctgtcaagaagacttgactcggtcattggccttcacttccttaagaattaaaggaaacctagcaaaagtgtggttgtacaactttgtatactgtctagttttaccttcagatctaagactggtaagtctgaacccagacatttgtataacagacttgtcagtgtgaaacatgaccttgatttttggagaggactttgttaatcacaacaacaattcgtaaatcttcttcctctatgtatattcgtgcagctagggcgcagtttgtgtaagcagttggaggtaatgcgtggtaacgctgttaagggtggcgtgttgcagtgcagagtgcttgggttgtttcctggtatctcccgattgctcctgtgtaacgaatccttggcgtgcgaaccacatgggtgccagttttttaaagtgctggcactggcttcaggcaccgggctgctataaaacggggcacacaggggccctcctgtgatgaag

SEQ ID NO: 484353 - DNA, 365 bp, Homo sapiens
aaagaggagctgtagaggacagccgggcgaggggggcactttgcgaacaggtcagagtctgggctcagtccccctggcagtgttgcccagtgacatagaacatgaactctgggtgccgggaacggtacctcacgcctgtaatcccagcactttggcaggccaaggcaggaagatcactagcccagtgttggagaacagcctgggccaacgtattgagactctgtcttctacaaagaataagaaagttagctggatgtggtgttggcaccctgtggtctcagctactcaggaggccgagccagggggatcaattgagcccaggaattttagagttggagtctgtctaacctgcttggggtaccgga

SEQ ID NO: 484354 - DNA, 262 bp, Homo sapiens
atcactcccattcctgataaacatcatcttaccatctctatactacacaatctatagacgccctcgtgtttacttctcttccttctctccttaatgacatttacgactattctcaccagacctcctaggctacccatactattataccactaggcaaacccttaaacagcactcctcacatcaagcctgaatgatgtttcctagttcgcctacaggattctccgagtccgtccctaagaagatcttggagtcgcccttgtgt

SEQ ID NO: 484355 - DNA, 580 bp, Homo sapiens
gagtcgtcacactgggttcgagttctgacagaatattcacaaagctatagtgaggaatgaatgagaaggtatcaaaagggcttaatacctaggtgataggttgataggtgcagcaaaccaccatggcacatgtttaactatgtaacaaacctgcacatcctgtacatgtatcctggaacttaaaataaaatagaaaagacaaagaaggatattacataatggcaaaggcttcaattcaacaagaagatctaactatcctaaatatatattcatccaacacaggagcacccagattcataagtaaagttcttagagacctacaaagtatgtttcacagtaatagtgggagactttcacactccaatgacagtattagatcattgaggcaaaaaaatgaacaaagatattcaggacctgaactcaacattggatcaaatggatctgatagacctttacagaactctgcactcaaaaacaacagaatatgcattcctcacatcatcatatgccacatactctaaaatcaaccacataattggacataaagcaatcctcagcaaatgcaaagcaactgaactcg

SEQ ID NO: 484356 - DNA, 164 bp, Homo sapiens
attacgccaatatcggccctcataaattcgctaatttccacacctaattacaggaaaggatctcaagaacgacactgttaaggataattccaggttgtccccgcctcacttatcccctggtcattcttgtgcccgagcgagcagctaaagggcgccaaaacaaa

SEQ ID NO: 484357 - DNA, 682 bp, Homo sapiens
  misc_feature (24)..(24): n is a, c, g, or t
  misc_feature (61)..(61): n is a, c, g, or t
  misc_feature (124)..(125): n is a, c, g, or t
  misc_feature (133)..(134): n is a, c, g, or t
  misc_feature (138)..(138): n is a, c, g, or t
  misc_feature (140)..(140): n is a, c, g, or t
  misc_feature (180)..(180): n is a, c, g, or t
  misc_feature (187)..(187): n is a, c, g, or t
  misc_feature (232)..(232): n is a, c, g, or t
  misc_feature (239)..(239): n is a, c, g, or t
  misc_feature (262)..(262): n is a, c, g, or t
  misc_feature (264)..(264): n is a, c, g, or t
  misc_feature (286)..(286): n is a, c, g, or t
  misc_feature (289)..(289): n is a, c, g, or t
  misc_feature (291)..(291): n is a, c, g, or t
  misc_feature (318)..(318): n is a, c, g, or t
  misc_feature (327)..(327): n is a, c, g, or t
  misc_feature (361)..(361): n is a, c, g, or t
  misc_feature (372)..(372): n is a, c, g, or t
  misc_feature (380)..(380): n is a, c, g, or t
  misc_feature (384)..(384): n is a, c, g, or t
  misc_feature (415)..(415): n is a, c, g, or t
  misc_feature (423)..(423): n is a, c, g, or t
  misc_feature (451)..(451): n is a, c, g, or t
  misc_feature (508)..(508): n is a, c, g, or t
  misc_feature (549)..(549): n is a, c, g, or t
  misc_feature (682)..(682): n is a, c, g, or t
tcaccaggggactaaacacaaaancaccagcaccatgagggcgctctcgaaccaaaaaagncctggtccccgtcagttaatgtgactgagtccgccattgaggccagtatggctggacccaaannaaccctcnnaatncncaactccctggccagcaaggagtgaagctccatgcccctnggaccangcctctagagtctgagcatatcctgcagcctcgatctcaggaggnaacgcangcagcccccctgcaatcagaaangnggcttctccagtcgtggtcttnttntntgtccacaagtttccagatggcccctncttggagcncctgcccaggcagggaacggccacatcctcgggnagagccaagantcaccgtntttngtgggcctgggaccaggcccagctaggacgntaggaggntgcctctgctgccatgggctggatcaanatggtggtggcctgcagcgggtagtagcggccccgccaggttttccagaagattttntttttaagcttctgctgctgctgtgggatggagcggaagtnctggccgttgaggttggaatggctgcaggtgccaaaccatcagccttcagagaggctcttggcgcagttcttgtccctgcggaggtcgtgatcctggtcccaagtggagaagggtacggagaggccgctgggn

SEQ ID NO: 484358 - DNA, 939 bp, Homo sapiens
  misc_feature (285)..(285): n is a, c, g, or t
ggtgaacggaagagtccttatgttgcagtaatgctgtatagtaactgagcctatcagcatcctacttcatacaagtagactggggaaaatgccagaatgtagattgccatcagagtatctgattagtgaacaaaggactgcatctgcagatagcataatggcatgaggcatgtttaacttctttgctatctccgacacattgaatgaggatcaaatttcgcagatgctgttctctatctcttaatgcttcatgggacccaatgttcttcgtcatcaagactaganttcaacgatgctaacccatttacatgagtcctgtaacagatcaatcctctagttactcgtcacttacagaatagttaccatgtctggcaatattgttatatcgtagtatgtattcatgagtacgaatagatttataggtgaaggtatctgctaatggcgacagtatgtacgaaatacgaaaattgggtgtaagtatacatcaaagttccatttcactgctgaatatgagaaactgattgtaactctctagatagcacatcgagaacctttgttccggactaccgcatatcttgttcacttagacatagtggctcacacttctgtgtcacgatcaacggatacgcatttcaatatttaataggtgctctgctgtttttcctctgaggcgacaccattattcgatcgattaaccagcagtacctcatacttcttagccagactctagctttatgacaagtattctaaacattatctaaaaccaaggctttatggcagttctctaaaacggatcgacacgtgacctggagatggtaacttcaacgaaatcactattgcccagacatgccgcataagttcaagcgtttgctgggcactataccacgtaggcctaacatgctctccgtaggtccctggaaacattcttgcctagtcctt

SEQ ID NO: 484359 - DNA, 157 bp, Homo sapiens
cagccacaacagctgctgctgatgcctcaactggcccaagcagtaggagcccctccacgctactgcgcaagacgcccactgccattaagactgagcgaacacctgcagaagtcaagaagacgactgcaaagtctgtaccagctgactagagcgacgt

SEQ ID NO: 484360 - DNA, 936 bp, Homo sapiens
  misc_feature (779)..(779): n is a, c, g, or t
gactctgggtccatcttcaagacactgggctgtggatcaacccaaccaccactcctcttccaagaatcatttgacaggttctttgggaggaactccttctctttttaacccactgcttttaataagaacaaagagtgggctgcaataggaatagaggtgaagaaagctggtggctgcggatgcggtgccccagacaccggggtaccgggatgtggagccttgagcctggtgaccgccagtgcaaacccaagagtaagaaagaaattgaggctcttctggcattaaggatcgagttcgtcttaagggaagaatgcaggatgaattcagggagggatttctcatgtttgatgagaacaggggattgtccaagattgcaccttatagccaggtcggtgatggtcctgtcgagactctgggcacgaaatcgccgaccaagtgcggaggtcacggaaaggttctggggaaagcccggcagaatgaagagctgaattgccaagaaaatggagtttgaacaatttcttgctatgatgcgaagcatttccaatgaagaaggaccaggcacctatgaagaactttgtgaggggctgagtgtcttggacaaggagggattggacagtcatgggtgtgaactccgcagtgtctagccacctggttgaatgatgagagaggacaattggagcctggttgagttcagaaagatccatggttgtcataagaagttttgtaggaattatgttgatcgatggagttcaaaaaagctgtaaggagtgctggaattntttattaacctgaaatttccgtttttgtcatctcggaaacgagctggcggttatggcagccgatgtaactgctttctgggatacaccaagttgtgtttgagaactcgtctcaacaaaaaacgcggcgtcacacacgcgggagaatatacttgtcaca

SEQ ID NO: 484361 - DNA, 697 bp, Homo sapiens
cgcacatgagacagaaaaactctggacaaagcaactttacttttatgatggtttctgcaggaaggaactggtgaggcagggtaagcaggcttgagattgctagtttgaataatttcagcctcccgagtagctgcgattgcagacatgcgccaccatgcctggctaattttgtatttttagtagagatggggtttctccatgttgatcaggctggtctcgaactcccgacctcgggtgatctgcccgccttggcctcccaaggtgctgggattgcaggcgtgagccactgtgcctggcccgttttttttttcttttcttttcttttcttttttttggagacagagtcttgctctgtcacccaggttggagtcaagtggtgtgatctcggctcactgcaaactccacctgccaggttcaagcaactctcctgcctcagccttcggagtagctgggattaaggcgcctgccaccacgcccggctaattttggtattttatagtagagagggggttcaccatgtaggccaggtaggtcctgaactcctgaccatcagggtgaccatgccaagacactatggaagagactgaggcatgttggaattgttcgacggacaaggagatatgaaaccagcctggaaccaacccatggcgaacaccagatttctccacaacatacacacctaagctagggcgaggag

SEQ ID NO: 484362 - DNA, 674 bp, Homo sapiens
cacgcgtccgacataccaccacatccggctaatttttaaaattttttgtagcaatagggtcttactatgttgcctgggctggtcttgaacccttggcttcaagggatcttcccgtctcagcctcccaaagctctgggtttataattgtgagccactgtgcccagcccatctttcagttttaaaaacaaacacgtgagcccctctttgtgtaactgttgagagctgatcggtcctgtgtgccaccttccctaggtggaggctgtatgtcatcttagttccggtgcttcttattcccccatcaagcaaccatgattattagattgaagtatacattttactggttactttatttaccattgtttgctgtatccaagtttcccctcctttttggcagtatttaatgacttttttttttttttttttttttgagacaatctcagactggagtgcagtggcatgatctcgtcttactgcggccacgaccccctgggctccagcgatcctctcacctgagcctcctgagtagctgggactacaggcatgtgccatcatgcccggctaattttttgtgtgtttttttgtttttttgttttttttgttttttgttttttttttcgtagagatggggttttgccatgttggccaggtaagccaccgcacccagccatgacttt

SEQ ID NO: 484363 - DNA, 206 bp, Homo sapiens
cagcaagaatggcatatcagatccatggttcgttacaagcttcattttaggtcacaggccctaaagatgccattatgctcagtttacatcaatatacaaagcccaacatttactatttcaaaaacattaaagcaaaccccctaaaccccacaccgaacacaaaggcttggtttggacatcaccactgtatatgccattcttgcttg

SEQ ID NO: 484364 - DNA, 878 bp, Homo sapiens
  misc_feature (41)..(41): n is a, c, g, or t
  misc_feature (222)..(222): n is a, c, g, or t
  misc_feature (238)..(238): n is a, c, g, or t
  misc_feature (252)..(252): n is a, c, g, or t
  misc_feature (258)..(258): n is a, c, g, or t
  misc_feature (266)..(268): n is a, c, g, or t
  misc_feature (270)..(270): n is a, c, g, or t
  misc_feature (273)..(274): n is a, c, g, or t
  misc_feature (285)..(286): n is a, c, g, or t
  misc_feature (299)..(299): n is a, c, g, or t
  misc_feature (305)..(306): n is a, c, g, or t
  misc_feature (314)..(316): n is a, c, g, or t
  misc_feature (318)..(319): n is a, c, g, or t
  misc_feature (334)..(334): n is a, c, g, or t
  misc_feature (348)..(348): n is a, c, g, or t
  misc_feature (350)..(350): n is a, c, g, or t
  misc_feature (364)..(364): n is a, c, g, or t
  misc_feature (368)..(368): n is a, c, g, or t
  misc_feature (384)..(384): n is a, c, g, or t
  misc_feature (392)..(392): n is a, c, g, or t
  misc_feature (422)..(422): n is a, c, g, or t
  misc_feature (426)..(429): n is a, c, g, or t
  misc_feature (437)..(438): n is a, c, g, or t
  misc_feature (443)..(445): n is a, c, g, or t
  misc_feature (447)..(447): n is a, c, g, or t
  misc_feature (456)..(456): n is a, c, g, or t
  misc_feature (458)..(458): n is a, c, g, or t
  misc_feature (464)..(464): n is a, c, g, or t
  misc_feature (467)..(467): n is a, c, g, or t
  misc_feature (477)..(478): n is a, c, g, or t
  misc_feature (499)..(499): n is a, c, g, or t
  misc_feature (503)..(503): n is a, c, g, or t
  misc_feature (541)..(541): n is a, c, g, or t
  misc_feature (561)..(562): n is a, c, g, or t
  misc_feature (569)..(569): n is a, c, g, or t
  misc_feature (780)..(780): n is a, c, g, or t
  misc_feature (809)..(809): n is a, c, g, or t
  misc_feature (813)..(813): n is a, c, g, or t
  misc_feature (854)..(854): n is a, c, g, or t
ggaattttagggcaacaaaagtctaaaaggccacaaaaganaaatagcaccactgtcatttgaacaatggctagttacttgcattttttggcattgttaatcactgaatctgggttttcctctgaattccacacagagcatgcactacacaacatttttatcataaaatacttgctttctacacacatttcagacaagctaccaccagcaacgatcaatacnatacatcggggctgancaatctcagtagtnggtganacacattnnncnganncctgccaaacnnaggaactgaatangctgcnngcaaaccnnncnncggagagttaaggcntgccgttttttccntntttttggttggttngggnggggtagtgtgttttngggggggnggggttgggtttttgtgacagactaatggntttnnnntccaaagnnttttnnntnttggttttntntttggnttnttgtggagtnntgtgaacagcagattccgaantttncccatcttggtagttcccaaggttacgttggccttttntgaccactccctttgccagnngtccagnaagaacttgcagcatgatcacctgcctgctgcacttccaactctaagcagcaaacttcaaggagccaaagaggagtccccagtgggcaaggggagcagagaagagaaacgtggtaaatgtaaacctaaaagacagtaaaatgggatacaatccccattcaaatcccagagatgtgggcaagtccccaaaagtagttgttagattaaaaaantgggcacacctcacttcccaaaaaatatnatanatagaaatttcggggatacttggaaaatagagaaatgctcnaatgaaaccaagctcttcactgta

SEQ ID NO: 484365 - DNA, 758 bp, Homo sapiens
ggagtggaggcgcgtcgcgagactatgcaaggcgacgcgcatgttcggcggcgagatccttatccgagaaagcgagagatgctctggcgcgggcggagccacagaacagtccagaggatgcccaacggatgggttaacttcttgtattacccgtgaaggtcttcagcttcactctcgggtgctgggactttctgctgatgcgcgtgcgacgacgattggctcgaggtactgtgagactcgaccgggccaggtgtagggctgtaggactgatggagtccgctgtggggatggagagggacagggggggtattcgggccaggaacttgtatataattctgctcgaactaaacgagaagacgacaaatggcggcagtagcagttaagagtgtcgtgggacatgaggtgcagggagcaccgaatcttcccgtcgtaacacggccgctcggtctctagatgtttctgtttaaatcgtcgtagccctagtctagagcgccggcttaggggtcaggcccgggttcgagtcccagccttcgccgctgcgtcgagtgacttaacctctcctagcttcagtcacctgcagattgagagtctactactttttactgggtcagaacttcctattccttagctgcaaaataggcagaaagtacgcgtcaaatccttgtctcaaagaattgagaagcgttacactaagagaacccggtaaaaacatcgatcacacaggttgttgtagacgtacaacaaaaatttagttcact

SEQ ID NO: 484366 - DNA, 326 bp, Homo sapiens
gagctttgtgggtaccgtatggaaggcagcccgtgtccccagaatctcatgacctttgaagggggaagcaagtgtctcatctcagttccacagagtcccaggcaggtctgtcctcagattaggttgctccctgtgggtgatcttgagccagtgtggccctccccaaccttccacccacccacagaagtgagaagtgctccatgcctccccctccccaggagacccaacatttacaggaactcttacagtgcccagctactctgcaatccagatccaccaggatcccaaatattcatcccaagacacccacgggggcaagtttccac

SEQ ID NO: 484367 - DNA, 520 bp, Homo sapiens
taatggatgacttggagagaggttcaagatttcagtggaggaattaactgcaaatacagtggtagtagcaaactagaattagaagtggagccagaaggtgtaactgagttgctacagtctcttgataaaacttgatcagataaggagttgcttcttatggtggacgaccagagaaagtggtttcttgagatggaatctactgtgaacattgttgaaaaaggattttgaatattccataaacttagttgataaagcagtagcaaggtttgagagcattgcctccaatatcgaaggatgttttgctgtgtgtaaaatgctatcaaacaatatcatgtactccagagaaatttttcataaaaggaagaatcagtcgatacggcaaactttattactgttttattttaggaaattttcacagctaccccagccttcagcaaccactaccttgatcagtcagcaggcatccttattgaggcaaggccctccagccaaagaaaagattatgacttactttgtttca

SEQ ID NO: 484368 - DNA, 105 bp, Homo sapiens
gggctctgtgctcatcaccttctgcctcattatttgctcatatactcatcttttatcatgtactacaactgtgatttagaaagtacattccaccgataggggtac

SEQ ID NO: 484369 - DNA, 180 bp, Homo sapiens
gctgatgttatatgctgacagagctttatctagcccatcattatcttgtttgtgcttggtttggtctggcatgacttttgctaaggcaagtctagaagagtttttctgatgtatcttctagaatttatggctcggtctagattagttttgatcccttgagttggtttttatataaagggg

SEQ ID NO: 484370 - DNA, 744 bp, Homo sapiens
gcaatatcagctgggcgcttataatcctgacactttgggaggctgagacaggcagatcacttgagcccaggagttcaagcgtagcctggccaacatggcaaaacctcatctctactatatatatatatattatataatgtgtgtgtgtgtgtgtgtgtgtgtgtgtgtgtgtgtatcatgttatcacacaaagacacacgcgtagggcatcacacaagggagatgatgaataagtggtgctgtcctatataatatatgtggtgtcgtcatacgtagtacgtataccgtcgtcgtcgtgcgcggagagcagcatgcagcagcagcagagagaggggggggggcgcgtgctgcatctactacataatgatgaagaccaaataataataatgtgtgctgctgctgcagcagcgaagagaagtagtaacaccgctgccgcgcacgagggcggggcgtgctgtgtcgatgagaagatagtaacaacaaccagctactatcatccatctctatcaatgatgatcgtcgtggcctcgaagcattcagcgcggcagaaaaaggagtcgtcgtgatgaagagaagatagaagagaagacaacaaaagagagagctgtgtagatatcatcatagcatcagcacacagacgcagagacgaccgggtcatcagcccaacgtgtagtatgtgtactaccacacgggggggcgctctactatactagacccacgcggtagaagtgggggagagagtaa

SEQ ID NO: 484371 - DNA, 517 bp, Homo sapiens
accaaatccaagctccagatgcatctcatgtaaccatcatacagttcatagtcattaacttaacctgcttctagcaactacaactaacaagaggtcaaaagcacatgaaccaaaggggcagtggattcctcacacattactcctaaggtatggaatcaaactaagtgttaattaacaggtgaataaatatagaaaatgtggtatcatttcacacaatggaatgctattcagccacttcaaaagacagcaacatctggttcatgtgcaaccacacatctaatgcaacctggaggcacattatgctcaagtaaaataagtcagcaccaaaacactgtagaagcagagcagtagcacatgcatgattgcctggggctgggggtggcaggcagcatgtgggtcaaaagtaatgggtcttccctatgtctcttaccttcaacatgtaatttattcttctctccagttttgattcaccagggaatggaattatatgctgaggagtcaaaacttaatgtaggta

SEQ ID NO: 484372 - DNA, 392 bp, Homo sapiens
actcctagaggatccccccgcagtctggggcttgtatggtgtcagaacgctgcaaaggagcttagccattatcatgttttgcatttgtatggtcgccttcacccttggccaaattatttcttctacattctttttctgcttctgcctcctggattttacagtctaattgaggagacaggacttgttcttttgcatacgttttagtttgtcgaacaaggcttggtatctcttgtcattgcccaaacagtgtttaagcctgagtgtgttccgacggtttcgatcctacactggatgggttgcttttctggtgtgtcgccggccgtaggatccctggctgggcatacaatttcagcgctggccttctgtttctgcttggccgtttcctcctcctt

SEQ ID NO: 484373 - DNA, 186 bp, Homo sapiens
ctgtgcctaccatgaccaccttgagtatcagtgccagaaattccttacctaaagtggcaaatgcgaccgggatggggtgggtcatagccatctgttatgcctttgtattttctgcactgattgaatttgccactgtcaactatttcaccaagcggagttgggcttgggaaggcaagaaggtgccag

SEQ ID NO: 484374 - DNA, 318 bp, Homo sapiens
cgaattatgcaccaactcgatcggacgacccgaggaacggaggggggagcctttagtgctgactggggatactattttaatgaatttccggatagctggttcaagacggcgtaatttcactttttcttcatctggggacggggtaaaaaatgttgtatcacctccctggtaacagctgtcttctccactcatatagaaaaacctaaaagaaaaatatttctttaagaatgttttcaaatctgtttccactatttttaaaagccaacgattagttgtacaatttattctaaggggggggatagaatatttctaatgctg

SEQ ID NO: 484375 - DNA, 1360 bp, Homo sapiens
cgcatggctcatgcgtgtaatccctgcactttgggaggctgaggcgggctgatcacctgaggtcaggagttggcagccagcccggcaaccatggtgaacccccgtctctactacaacaataccaaaacaaacacaacaaaaaacaccaaaaattagccggcgtgtgcgtggtgcctatagtccccagctacctggccacggcacacagaatcacttgaccccaggacggtgccgcatcgcccgtcctgcccgcgatgtgcccactgcattcccccctgtgtccccccccactgacgactcggtctcccccccccccgtcccctgtccctgcgccttccctctagctcaacctcactgtctcccctttggtaccggcccgccccgtcccggccgcctccctcctaccacccgccaacttcacgagactccaggcaccaccctccctttcagacggcccccacctgcgtcaccttcttctaccctttgcctgcctcccgcgagtcgcccttcctggctggttgcgccaccttgccttcctttccactacccccgggcttcctccctacctgcctacgcgcaccgccttccttggtccctctgactgccacgtcccgcgtacctctcctttcactccccccttcctcccaccggccccccctccacacgcccaccccccgccgcctcgcctttcgcccacctcccccctttccacctccgcccacaccccgccccctcccccccaccccccccccccctccacacatcccttttgctctactggagcatacgtacccccccccccccccccccccccccccctcccccccccccccccccccccccccctccccacccctcacctctctcccttctcttccaccctcttccatccttccctccttccctactcccctccctcacacaccaccatcctttccccctactcccccctcctcaccttatcccccaactctaacctcttccgcttactccctcccccccccccccctatcttcccccccccccccgcccaccccccctcgcctcccccccccccccgccccctccgccccccccctccgcccggcccccctccctcgcgctctccgcccaccctccccctcttcgtcccgtctctactcgctctactctcctccccctcccccccccctcccccccccccaccccacccctccctcactcccctccccacccccacccaccacccacacaaccccccacaccccccccccacacccccaccctcactacctcccccccctcccctacccccccacctgcatctacccccaacaccctcccccctcctccctcacacctcctcctccctcccccccca

SEQ ID NO: 484376 - DNA, 1080 bp, Homo sapiens
actcaattcgacaatgcgtcctcgctagaagataaaatccatctgtaactaccctatgttgtgaatcctctgcatgacaacagaacttagatgcccactagtgacaaaatgacatatcttgacggtccatgctacttccttgagatcttccgaaattatttgcttctacttcataccagacaatagtctctctatctgtagcgatagcagagaacccgttgggtctccccagtccttatgcaccgggatgcctgctatgtcccttcgtcgttgaaacggctgatgttgctgatggacgagaacaacatagatgtgcaatgcccgtcccgaggagtaatcgctggatgaatagtccagctccttagatgcattacctgtctgagctccataatcacgtgggcgtaatgtgggcctatgtagttctactatgcatacactttattgcactgatgcatagacagcaatgtgggcatgacccaacgtgatgtgatgtactagctgtgtgtgccgatgtatgtggtgaccaattgtgccctaggataacagttcctgtgtgctaagcctgaaacacaagttactgggccccgaggatacaagctccttttaaaacctaggatatatttaatctactcattaatgttcctccagagcgtctgcaattgataatacctgtatgcatgcataggttgcatcttgcttccccaagtgtatacgataaggggaagccaggcgtataaccaaagtatggctttaagattctcattggtctcccaccaagctactttgggaatgaacattccggcgggatgtccccaaaaggttaattctttacaaccgtaagtgttgagtactcatgaagaaacactggcataccgaatctggaaggtgacccatgcacacttcaggcttaaattggctaccatgtgtttgggcacgcttatctcacagggaaaaatccggcttttggggaagcgaaacaccatataaaaggtagcaagcgaaacagactagtgtacagtataccaagcataagacaagtagcaaaaagagaataaatgcaaacagtcaagagagaaaaca

SEQ ID NO: 484377 - DNA, 906 bp, Homo sapiens
cccaatgtcccaggtgtaggtggagcgccacatctacctgagattattagtacgaatgggcaagcacgtgtttggcttatagcacctctggatgagaagagccttggttaattgactcaattatgcttcagcgatgtcctaagagtacctggcaaagaattctgcaaggctttgttcagtgccagcgattatgaagtggctcctcctgaatgtaccatcggaaagctgtgtgagacggcacgtctcactcacttatgtcttggatctccgtagagatcacattaatgtgtcttagtctatctcttgtatcagaacgtatgttgcttgttgagacgaatgtgtagtggtcataagcaagatttgagtcgtgtttgtttgtcttgtcttgattttgtaaaacagacgataaaaataagcatgggggtaatagctccttgcatcttctgactgtaagatctatcgtttcaaaatggctagtccagagtgtgcaactgtatggagaaaagagggatatgcgggagaggtgtcgaatggcgctgaatgggacatagagcatgctgtggaactgcggggtggttctattcctttgagataacgtcactttatctacatacttgttaatgctatattgacatagcattgtctctggattgctagatgccgaaaaggtccagatatcagtgtgatatatctgggatcatcactcatcgcattggggagctactggaggaaagtaaaatgggtgctggcaaggtaaaaagggagcccatccgttgtgccatgtccttgcccagtgtgggtaccgttaaaggcattgtatcattgggctcaagattgtttgcacgcacagggccggttgggaccaggggtagaattgggtccaaagggcccggttgaatcttgatg

SEQ ID NO: 484378 - DNA, 205 bp, Homo sapiens
tcgtcgtcagatggggaggtaggcgcagacgacctagcctgaattagcactgtaacctaccagatgtggaaatgtctggcctctgtggaaagaaaagtaggagatgatccccagtgacagcacccagtggggaggggttccagtgaacccacagtgctctttacagaagcaagagatggcttgcaatgtccatctgacccatctt

SEQ ID NO: 484379 - DNA, 501 bp, Homo sapiens
ggcgactactggaattcagtaaccaccacctcgtttggttatctcaggctcgggatgttgtagctacattggaaagtagggaggtggtttacgaagtgaagatgaggtcaggtgcctgaattcaacagtctacccattccccttttccagataatgctcggaatattttacaatgtcctgactggtatgtcgctggcggacgttcccttcacggagaaagattgtgagaatggcccccagaacatatacaatctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgtgggactgggtttcccgggcgagagactgaatccc

SEQ ID NO: 484380 - DNA, 103 bp, Homo sapiens
tggatccttatgaggaacgtcactcacgcattctcctgtactcagccttcggaagtagctgggactaccaggtgccctgcaacaaaactggctaatttttctc

SEQ ID NO: 484381 - DNA, 181 bp, Homo sapiens
gctgcagcccaagagcaagcccaccagcctaagtccagcagaggacctcccacccaaggtcttgttctaatgagaaggggacgtagccacagaaaatcaatttatctataattacaaaattctcttgactcaccttaaagttctattgacactagtgctttaaacctattggaaatttgat

SEQ ID NO: 484382 - DNA, 961 bp, Homo sapiens
  misc_feature (164)..(164): n is a, c, g, or t
  misc_feature (285)..(285): n is a, c, g, or t
  misc_feature (297)..(297): n is a, c, g, or t
  misc_feature (317)..(317): n is a, c, g, or t
  misc_feature (322)..(324): n is a, c, g, or t
  misc_feature (330)..(330): n is a, c, g, or t
  misc_feature (337)..(337): n is a, c, g, or t
  misc_feature (348)..(348): n is a, c, g, or t
  misc_feature (352)..(352): n is a, c, g, or t
  misc_feature (377)..(378): n is a, c, g, or t
cttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttangagctgaatggctcaaagaatttaaagcttcagttttacatttaaaatgctaagtgggagaagagaaacctttttttggggggcggttttttggttgtgtggtttttttttttttttgggngggaaaaaagantttggctctgttgcccaggntggannntgcagnggcgtgntctccgctcantggnaacctccacctcgcgggttaaagcnnattcttcgttgccgtgtaatcccaggtactgggaagggcggaggcgggagaatctctggaacccagagggcgagggtggcagtgaaccgagatcaggccatggtactctagccggggtgacaagagcaagactccgtctcaaaaaaaaaaaaacacaaaaaaggaggtggaaaccggggacacggggccccccgggggtcgccaaaggcgggttgtgaaactcggggggcaggtgtttcccccccttgggcccccaaagggggggggactaccgggtggaaacggccccggacgaaataagctcaaagtttcggaaacacagtcgggacgcctggcactccaacgccgcggggcgcttccgaaataaactcacgggtgcccccgctgtctgccagttgtgttcttgttgcgatcttccccaggtgggtcggatccaccagttgaaaaatggctgcgcggcttcccaaaaggggggggggcggcgcaccactgggtgatggggcgacagcatcgagcgcaatgatgggcccacgagtcggaagatgtgcataagatagaagaggatgtgtgacggacggcatcg

SEQ ID NO: 484383 - DNA, 362 bp, Homo sapiens
tattacgatcctttcctctctcacgtggatctcaagccgaactgcttgcttgtacttctccacattcttaatgatcatcagggcaactcgagccccacccctgcgatggtcaacacattgtacaactcggccgaaggtcccctctcctaaggtgctaacgatttcatctgaaatgaaagagagcagggtcggggagagggagggagagaaggtggggaatgagctgagttggaagaaaaaaggggacagcaacctggggtggagatgaaggaaggggaacagatacagatggtcacaggggaagaaaacccctgcgtgatttccaccacctttaacccatgggccgtgaaagagggaaggat

SEQ ID NO: 484384 - DNA, 784 bp, Homo sapiens
  misc_feature (164)..(164): n is a, c, g, or t
  misc_feature (285)..(285): n is a, c, g, or t
  misc_feature (297)..(297): n is a, c, g, or t
  misc_feature (317)..(317): n is a, c, g, or t
  misc_feature (322)..(324): n is a, c, g, or t
  misc_feature (330)..(330): n is a, c, g, or t
  misc_feature (337)..(337): n is a, c, g, or t
  misc_feature (348)..(348): n is a, c, g, or t
  misc_feature (352)..(352): n is a, c, g, or t
  misc_feature (377)..(378): n is a, c, g, or t
cttctgtttgatgggtgcaacctgaccagagagagctggaaggccctggagcgggccagcttctctaagctgaagctgcagcacatccaggccccactgtcctgggagttggtgcgccctcatatctatggatatgctgtgaaatagtgtgagctggcagttangagctgaatggctcaaagaatttaaagcttcagttttacatttaaaatgctaagtgggagaagagaaacctttttttggggggcggttttttggttgtgtggtttttttttttttttgggngggaaaaaagantttggctctgttgcccaggntggannntgcagnggcgtgntctccgctcantggnaacctccacctcgcgggttaaagcnnattcttctgcctcagcctccctagtggctggggattgcaggtgcccaccaccatgcccagctaattggtattttaagttgacgacagggtttcactacgtgggccaggctggtcttgaactcctgatctcaggcaatccacccacctcagcctcccaaagtgctggggatgacaggcttgagcaaccgcacccagtcttagggttttccggtttcggttctcgaaacggagtttccgctctggtgtgcccaggcgggacgtgcaaatgctgtgatctcagtttaccacaacctcccacctcccgggtcacaagtgatcacacctgcctcagcctcctgagtggctggtatacaggcttgcgtcaccacgccggctaatttggtactttagaacaacctggtgttcc

SEQ ID NO: 484385 - DNA, 931 bp, Homo sapiens
  misc_feature (240)..(240): n is a, c, g, or t
gctgctctgggtgcggcattgccagccggctgtagcgcattacagggcagtgtcttctgcatctcctagtgaacctcgggagacggcagatccggcgcctggtacccgacgaggcggagtaccgggagaattcccgggcactacacattcggtccccactgtgagtcaagagagcggtcacatgggtagtaccgacgttgcccacaggatccgtgggactgcgaggccacaaaacttgcnccctgttgaaaaataccttaccagtgccagctgcatgcgaaccttgaatgaggcccatttcggaccatcacattgaaagagggagagcatggatatgcacagcgcataaacaccgtcgtcccacaaagcccatttgggacaggtgaccatggcacaaacacttcataacttacgcccgttacaaccacgagtgggcttcgagacaattcacgaccactagtgacattaccatactatacgccctggccacgatcggcataccctaggggagccataatgggcaagggtacaatcacatatcacatggcaccccattgggaggatgcattccgaatatgagtagagacattgaacggcacgagcactcccaatacaaaaagccttaaattaccaacgaggacctaaaaaaaaaggagacagaccaggccaaatacactacctcctacttggtcaccattcggcaatccgcaggacaaattcacggggagcgcaatcttacctttgcaggacacggctttatcatcctcccaggttcttggccacacaacatcccaacaaagtgcgcataaccccacaaggcgcttcccccaagatggacggcggggtcacatgtgggcaacaccatgtaccacccgtaggacttacaatgataggcatggacccatatgtgagccactgagagtgcatgcat

SEQ ID NO: 484386 - DNA, 1337 bp, Homo sapiens
agaggtggccaataatgttcgcgcaaagcgactaggagctactacagccaggatgccaatgcctcttccctcttagacatctatagcttctggctccatacaggtctgccaaggtcccagagcgaatagtttacatgctaaataggaccagtggctaaccaaagctaagaagaaggcctcgatccagtgactagttgaggactagctagctgcaggaggcacgcgacggaatttcaatggtgcctccagtcaaacgaacggtctgcctgtatccatgtccaaagccgacgctctggtctcgccatccttgggatatggctgcatgccaatagcagtcaggacgcagtagcaaggcaagctgagatgagtccaagtcgtatcgattgcatcgtatgacggaggacacaacatacggcacaaccagtctggtccagcaaggagagttaagccctcatagctcacatgtgccagcctaaagctctctcctcaatcaaggccaagaagctcctagatatcttgatttctagagctcaactgctccggatggggatagaagcccaacctagaagatacccacgaagcccaacagaataagcacctgttgagccacggtaacacgctccagactaaacaagcccacctcctcaaataacctagcctcgatgcaagccaaccttaccatagtagcgccaagtgggtacaagtcaaggccaaggtaaccagccacgtgagacaagccagcaagacacgccacgctagcagcgggatgcacctcaggaagcggcagcggaagaacgcgcacagcagacaagcccccccagcaacgacttggtactccttaaacacaaggcaacacctctggtgagcccaaacgggccccccagatttaaacacgcccaggttacatcgaacccattaacccgggacaccaaagttctctagacacgtgcagggatctcccatccacaccgacaccaacgagaccaagcgcgcacaacagaacccgcaatcgaccacaacaaccaacggccccacacggaggacacaccccccgcgagatacttatgttaccaccacccaaaagaaaactactttgtacaacccaccacctcccatcaaaaccgtcgtcaagtaactctccccgctgtcaactaatacaacaacaacacaactctctacaacctacttagctaaacacacaacacccaacctgacacatctataccacccaaccaccaccccataaaaaagaagccacacactaacagcccaacatctatcaaccaatacactcgcaacacatatactgaacttcccactaaccatacatcacctaa

SEQ ID NO: 484387 - DNA, 626 bp, Homo sapiens
tgaaggaatcttagacagcaaaactctattcgccaaacgactgctgtgaattatacctgattaacattcctgacaccatctgtgtggtcatcctttccctgtgacctgttcagtggacagctttcaatgcatgtgcttgtatgtgatggtcccatcttggccaagaacttaccttcagaacatactactaataatgcagccatggagcctgtcatgccagatcccaaatgagtgccttccgaaattgacccacctgtggagctatttacaaatgtccatgtgggagacgagagagcatgagagcacatgtagcccatgcctgctggtcagcatggctcactctgtggttcacctgtagacagagagcatgatcaatgtgtacttcagacaccagaaatgtctggtgtgctttggtcccaagtgggaaaagagaactgcccatgcccatgcttgtagattatcgcttaccttgagaccttgatgcccacactcgcggtcgtatggacttctgtgacacgtacttgtctcctggactgaaccattgtgaacggaggcccctaaacctagttctcatcctcccctggtctgcacatgctagctggagcagggattgacccaagacgcga

SEQ ID NO: 484388 - DNA, 291 bp, Homo sapiens
tctcattgccctatgtatgccatgccctgccctcttagactcaaatgcggtggggacctacgcctagcccccgtgcacagacagcccttcccacagtgcacagacagccccacccacagtacatgatacgccctgcccacagtgcacagaacaggcccacccgatagtgtatcccacgagccctaccccacatgtgtacacctacagtgccctccccgcacaaccacactagcacgacccccgaccatacctcagcagagctgggacgaggctgcagacaaggactttgcc

SEQ ID NO: 484389 - DNA, 267 bp, Homo sapiens
ccgctacacttccttactggttacatgcagttccaaacattgttcgctgaatttctctctcaccagcagaattggagtcatatctttgtgtcccaatggacgtctatttcatcagataaacagcgatggacgcgtgcatgttcttcacacaagctcggtagacaattccccgatagcgagtttgggccctatcacctaccgtacttctagaatactttcagacgaccaatccactgctctaagaatagagagctgagagtttgagta

SEQ ID NO: 484390 - DNA, 888 bp, Homo sapiens
cgtagccggaaacatggcctccgattgtggctgtcactgatggtgtcatcaaggtgtgcaagcgacatgaaggtgcgtaggtcttcaacgccagtgaggaggtgaagaaagcgcaagaaggcggtgcatcttactagcgctgagtgaggatcaatgcaagaacatcgatgcctggaggagggcaaggagatccatggtgggtcgactggtaggggcgcagagctgtacggaggatgcgccgtacgcgcgaaccttggttcaagatggctggccagataaggaactggacgctatgcccgtctatgactgcaaaccgtatgagatcgcaacggatgaggcaaagaccgtgacggactcatggcagattgactacttcctggggacccgccgaagagacaagtagccacctatacagacggcagaaatagaaggaaatagaccatgatgccaacggaagagcccaatcaagagcatagaagcgtgacacaggggatacaaagacgatggacaggagggcaagggcaagagaccatggcattaccggaaaagaaagggaacaccaagggaacgcggcctggacagaccgcaagggcgagaacgaagcgcaagaaggggagggaaaaaagggccccggacacagatccaacacacgaagaggaagtggcaaaaaggcacaaagagaagaatcacaaagacacacacagacaatcagagggaatcacaacaccatgggccataggagaaggcaaagtcaacgggaccagagaacgcccaaaaacaacgcatggacaccccaaaggagagatgggaatgagaccacaggccatggagcacacgaaatgagacagtagcaaccaacagacgacacggcgaaggggagggcaacag

SEQ ID NO: 484391 - DNA, 135 bp, Homo sapiens
ggttttaaaaagggggggggcccccaaaaaattttttttttaccccctttttcccccccctgggttttaaaaaatttcccccaggggcccctgggaatgggttttgttccctttaaaaaaggggtgggggtttta

SEQ ID NO: 484392 - DNA, 477 bp, Homo sapiens
ggggggggggggggggggggggggaaaaaaaaaaaaaggggccccctctttggttccttggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaactctcgtagtctggtt

SEQ ID NO: 484393 - DNA, 289 bp, Homo sapiens
tcggtggtggtcacttacggtttgcgttgtctcttacgcttttctcgttagactcgtacattctctgctcactgtaggtctcatgaaacacattgtttccttcataacagaacaaaaaactttaaggtaagtcataaggatcgtttcctcttgtgaaaaatggggaagttcgtctatatcatgtctattgtctctaccaaatccatgagtcagagaaaacatgaagcacatcacactttttgtgcgatcccatagcactatgctactctccagccatcgtcagtgacca

SEQ ID NO: 484394 - DNA, 1295 bp, Homo sapiens
actggcttcaagcaatggtaaaaaaggaaaccctgaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaactctcgtagtctggtt

SEQ ID NO: 484395 - DNA, 1237 bp, Homo sapiens
actggcttcaagcaatggtaaaaaaggaaaccctgaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacactttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaactctcgtagtctggtt

SEQ ID NO: 484396 - DNA, 1184 bp, Homo sapiens
actggcttcaagcaatggtaaaaaaggaaaccctgaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtattt

SEQ ID NO: 484397 - DNA, 1296 bp, Homo sapiens
actggcttcaagcaatggtaaaaaaggaaaccctgaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgagattgttgtttcctttctctcctcccgaaggcacaggtgatgcatgctcacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaactctcgtagtctggtt

SEQ ID NO: 484398 - DNA, 102 bp, Homo sapiens
gatccgaatttaagcgcagggggtttatattgaaattggtgtggtgaaattgatggccctaagatagaggagacaactgctaagtgtcaggagaaagatggt

SEQ ID NO: 484399 - DNA, 161 bp, Homo sapiens
acggattcgaggaaaatatagaggagaggtcacattacattgtcatgggtcaaatgcagcctgccgcatgttattttatatggtccacaaacgaaggatggtttgttatatttctatacggaggcttgagggaaaaaaaaagacaagaaattattatgaaa

SEQ ID NO: 484400 - DNA, 140 bp, Homo sapiens
ctctagaggagccacactcattctcagcccctgaaagaagtatagctaccttcttgtactatccctatgaggataattatacaagctccatctgctacgaaaacaggacttaaattcgtcaattgtaactctttaaatca

SEQ ID NO: 484401 - DNA, 163 bp, Homo sapiens
ataagcttgattgaaaatgacatagaggcaggcctgtgtaccttcaggaggctctagtgggagaatctgctcttgccttatccagcttcttaaagggccaccatgcattttatagccctgtggtccctatcctatgacctatcagaagctatatcactactag

SEQ ID NO: 484402 - DNA, 393 bp, Homo sapiens
cacttgttttttttcaatatttaactcaaagggcctaaagcattcttttctgcttacaggagatgtgttgttggtatttttggtggcatagcataatgggaagaaatcggccgggagcggtggctcacgcctgtaatcccagcactttgggaggctgaggtgggtggatcacgaggtcaggagatcgagaccatcttggctaacacggtgaaaccccgtctctactgaaaatacaaaaattagctgggcgtggtggcatgtgcctctaatcccagctatttgggaggctgaggcataagaattacttaaacccaggaggcagaggttgcagtgagccgagatggcaccactgcactccagactggacaacagagcaagactccatctcaaaaa

SEQ ID NO: 484403 - DNA, 938 bp, Homo sapiens
gtcctctcacgcttgccgtcggtatggaggggtcacactcctgttccaacatgcgtatcgaatagtgtcattcctgctcgatatccatgtatcctgaataaggaatgatgtgcgcaccggaacgagttgcaatcgatgttcatgatgcttgccatgtctaagtgtcatagaaccttgtaagcatgatgcgcgagatactctcgcaagagattaagggtgcgacacaagacgccgattccaggaagaaggcagcttggatataatgatgcttgactaggcgcgagtaattgtccgattaagagagtgggaaaaagagtgtaccaaaatgaaaaccttatcaaacaatacccaggcgagacgcctaatggaaagtaaagaactcatgagattgcgatccatacgcacgaggttagcataaaaatttcattaccaagaatggctgccaagctgaggattctataattgagacaggaattgacagacaacacatggatagaggctccagaaaaggtccaggcgatattcgatagaagtgtccgagctacaaaaagttccagtcctgatatgccgagcccccattcttgcatggcgaagtgcgataccacacgtgtgctacagcagcacccctactgtgttacacgcaaggcttgactagacgtagggaattgtgcgtaccaattggaatatcatggctcccttaaaagaatttgctgaaaagccgatttttccttctctatgctaaccttttatgtagagaaatgacgccatttgcggtatacattgggacttgctgaaattaataatatatcttcaaagcataaaggtgcacttttacagtgaaacaggcgagaaaaagcaaattttcttcctttgcattggaggaactaggatccgtatccaacaatagacggcaggtgaaatgacctttagcggttaac

SEQ ID NO: 484404 - DNA, 1046 bp, Homo sapiens
  misc_feature (4)..(4): n is a, c, g, or t
  misc_feature (14)..(14): n is a, c, g, or t
  misc_feature (499)..(499): n is a, c, g, or t
  misc_feature (628)..(628): n is a, c, g, or t
atancgcgggcgcngaagagggaacgaatagacctaccgccccttctttttgtggtttgggggggggaaacttccgcaacaattatttttattatctctagaggttcccgcggacattgcgcgcctttttcaggaggaggttacaccggtgtggtaggtggggcctctttgggaaaggggtgtttctctccagcaaggcctaaagggagaagtggaaactttctctcctctttgctggaggggggcccaaccggtattgtccttggggcatatagcacccgtgccctgtggagatcccaagggtgccataagaattccttggttttggcccgactctaactggtttggtcttcaacttgcaaccaggccctccggaatattgggaagataaacaggttggtttgaaatttgggcatggtcctcacgcacctggtggcagaagcaagctttccagaagatgctgttcttaagacagtggagatgaaaggggaagtccccnccagaggttttcttttgagcctccgcccagcggatagcctgtgatgaagaattttccaatttttaggatgaaggagaaggaggttcaaaaaatgtggctggtccttaaaaaggggccaagaaagcttgnatttgagaagattagaaagaccccgggggccaaaaaacccgcgtttagggagaagattaatcccagggcccccgtggtggaaaaaccaattcccaagggacccaattagaacaggtccgccacccctggatttggccgtttcccccatttccggaaatcctttaaaaaaaaaaattgaaagggaaaaggttttttttttaaaacctttgggttcctttttaaccactttgggaagggcggggtttattttccaaagggcttttcggttttggtttttttggccaggtttattggggggttttttaaatatgaagcaaaattttttttttccccccgggtttttgtgataggattttaaatttatgtggggttttttggccaaaaaactggtttttttaaaaaggaattggcccttcca

SEQ ID NO: 484405 - DNA, 173 bp, Homo sapiens
gagacaagactgcaagaccaacgccttctcttcctccccatctctctccgcctctgcctactcaatgtgaggacaatgagaatgaagacttttatgttgacccacttccatttaatgaatagtaaatatattttctctttcttatgattttctaaataacattttctctagct

SEQ ID NO: 484406 - DNA, 901 bp, Homo sapiens
ggacagctcggtgatgagctgtggcggagccgcagggcctggtcggccgccgagtgaagtgtgactccgtggtgcctggccgtggaggctgggcgcgctatgctgcggcctggctcgtgaatcgcgcgtggttttcctgctcctggcaagggaaggggcctgcgagaagggagcggggacagttagcagacaggcagacctccatgccttcctctcttccctctcctcccttctcttggataaagctgagctggtgcagacacgagctgcctactcaatagcgagactggacactctgtgcctagagccccctctgcagctggcctttactcctgggaccccacttatcctcacttctgctttctttttcttccctgacctggctccctgcgcaagggtcccagagagcacgcagttgagtgcagaggaaaatttcgtcacaagccagccaagaaggggctttaagcaaggatgttggcacgatggtgattcacggggccagcctttctgacggctcttgaccaaggaggcctgggcacagccttcttattacacgcaactgcatcgcgaaatcgcagccttcagccgcggaggaaagactggctgcacggcaccggtattctcaggcaccccagaatattgtttccccacgcttcgcaatccagttgccgagctttgaccactatagaaccaccattattacccgcgcacaacccgtagcaccttgaaaactttgcgcaaaacaaaccattttaccacccaaaatactgaacaatacccatctcctcacaccaaatcttaggtccttacgcataaacttaacgaacaacagaaagtttactccaatgtacaggaagccctgcaattaccaagtacagacaatcacggatcgaaccatacc

SEQ ID NO: 484407 - DNA, 467 bp, Homo sapiens
ttgctgctcgtcgtgtctagattatcccctctctgttcgtcgtttctcagtgtctgtgactggcgggacctgccggtcctgcccccaggtcggcggtgttgtttgtccctcctgctctaggtttcacgggtaccagccttgggtcctggtggtatgatgttcccaaatacctagactcagcagaatccccagagggctttgacctcagttgaaatgatctttctgtgcctctggcaagggccaattggctaaaaatcttcccaaagggttagtttttattgcaaacagtccttggactcctttgggaccactgggtcacaaacattagtgccagcctctcccatctcagagcactgagatccagctgcagtgaaaccctggccctggctggagctggagggagacttccatcgaagtgtttgggaaggaaagcagggaaacctgcctctctggagcagcaagtgcat

SEQ ID NO: 484408 - DNA, 534 bp, Homo sapiens
gcgggtctcaaactcttgggcctcaagcaaaccttgccggcttggccatccaaagtccggggataatgggcatgagccaccacaccgggccgggttatactttaaaatgatgtattctcccctcctcctaccagagtatgagaagatgtttctccagtctcaccctgagagcggggtgggggctaatgggaggtaaaactcagactgggtagggggcactcccaagtgattattccctgggagttttggtctcgtacgggtccaggctcagtctctgccattggtcagttcccctttcctctcggcgggtgcgggctctagggttctgcccggaattggagcggtgattcttagcatggcatatcggtctctccatcttgggggtaatggttttgccatgtgacctcaataatctgagggatcggagaacagtcatggatttgaagttggccagctttctggtggtgaggaggggagtgatgacttcttgagcctttacaagctggacaggacctgggaatgtcccatttcatt

SEQ ID NO: 484409 - DNA, 535 bp, Homo sapiens
tagactgaatgctcttttttgtaatagctgtttagcattacaagttgaaagcagcgctcccttttcaatgatgtgtataaagctgcatgacctcttttctgaatcactgatggtcggcatgttctttctaataggcttgtatatcccggcttgatctttggtaggagtggccataccagtttatcaggaaataacatcataaaggtcaatctacgaacccagcgctagtgtacggtgaaactctactcattcaatattatggattataaacgctaccagactcatacatgcttaatctgttacaccttatggaccatatgcactaggtggctccaggggcgcctaggatggagacggctgaactatccatctcttactctctcctcaaataggactatgatccataccagtccaaagacgggtgtcgtgctagatgagtctcagagcatggctctgctcttggatataattgaacatgtgcatatttctgaccgacgataagaataaacttaacagggtgggcctttatttgctt

SEQ ID NO: 484410 - DNA, 948 bp, Homo sapiens
  misc_feature (29)..(29): n is a, c, g, or t
  misc_feature (84)..(87): n is a, c, g, or t
  misc_feature (131)..(131): n is a, c, g, or t
  misc_feature (133)..(133): n is a, c, g, or t
  misc_feature (138)..(138): n is a, c, g, or t
  misc_feature (167)..(167): n is a, c, g, or t
  misc_feature (169)..(169): n is a, c, g, or t
  misc_feature (179)..(179): n is a, c, g, or t
  misc_feature (183)..(183): n is a, c, g, or t
  misc_feature (221)..(221): n is a, c, g, or t
  misc_feature (254)..(254): n is a, c, g, or t
  misc_feature (256)..(256): n is a, c, g, or t
  misc_feature (266)..(268): n is a, c, g, or t
  misc_feature (276)..(277): n is a, c, g, or t
  misc_feature (301)..(302): n is a, c, g, or t
  misc_feature (304)..(304): n is a, c, g, or t
  misc_feature (327)..(327): n is a, c, g, or t
  misc_feature (363)..(363): n is a, c, g, or t
  misc_feature (365)..(365): n is a, c, g, or t
  misc_feature (391)..(391): n is a, c, g, or t
  misc_feature (407)..(407): n is a, c, g, or t
  misc_feature (410)..(410): n is a, c, g, or t
  misc_feature (435)..(435): n is a, c, g, or t
  misc_feature (458)..(458): n is a, c, g, or t
  misc_feature (464)..(464): n is a, c, g, or t
  misc_feature (519)..(519): n is a, c, g, or t
  misc_feature (522)..(523): n is a, c, g, or t
  misc_feature (561)..(561): n is a, c, g, or t
  misc_feature (568)..(568): n is a, c, g, or t
  misc_feature (571)..(571): n is a, c, g, or t
  misc_feature (592)..(592): n is a, c, g, or t
  misc_feature (605)..(606): n is a, c, g, or t
  misc_feature (721)..(721): n is a, c, g, or t
  misc_feature (730)..(730): n is a, c, g, or t
  misc_feature (758)..(758): n is a, c, g, or t
  misc_feature (770)..(770): n is a, c, g, or t
  misc_feature (798)..(798): n is a, c, g, or t
  misc_feature (810)..(810): n is a, c, g, or t
  misc_feature (815)..(815): n is a, c, g, or t
  misc_feature (844)..(844): n is a, c, g, or t
  misc_feature (942)..(942): n is a, c, g, or t
gataatcttttaaatatgaaaaaagaagnaagttcaaaataaaatagaaatctcaaatgtaggatagaaaaaaacaaagtgtgnnnngggggaagaaaaagcaaaaggaagaaattagatgtatgcaaaananatggnggaggagttaacatctactctggggaatnantcaaacactnatgnggcagtatacaccaatccagagttaggggtgttaattnttttttgggagttaaataagagtggggattaanangatgtttatnnnaaattagnnaaaaggttgagtatcttatatacnnantccaaacccccttgatccctttntatgattaggggaaaggagctgagtgagggaggtananttggaaagggaaggattccacttganagagtgggacagactnctncagagtagagcttggagggagattnaaagtggagataatactgctganacctcncttgaagctgagatgggaaatggacataattagaaatttagtgactttaatagantgnnatattacctatccaaaacttttaaaatgagaaaatcancatcccnttncttatatagatgacttctacncactaccttctannattttctactttgggcttaggatgatggccattatctacatgtgttttcagcacctggttggttctaaatgggatctggagacccagcttcttggagatttttaagaggaagtantaactgganaaatggaatgggcaccagaaagaaatanagggtcacccanaatggcagaaacctaggtttcccagaanggaaagagagangaganattcaacaaacaagtatttattgagcgcntactatgtgccaggcactgttctagaccccccccagaagaaaaaacaaaaaacaagatagaggcagcaaacacaaattctgagggagaggaaaggggnagttga

SEQ ID NO: 484411 - DNA, 1332 bp, Homo sapiens
  misc_feature (914)..(914): n is a, c, g, or t
gccacgcacttatagctacttggaaggctgaggtgggaggatcacttgagcctaggaggcggaggttgcagtgagccaagattgcaccactgcactccaggctgggtgaccaagtgagaccctctctcaccgaaaaaaaaaaaaaaagctgagttccaggaagttccaggatccatgtgggggacctagtggttgaaaccccaatctctacacaaaattacaaaaaattagcccgggttgtgatggacacacaccatatagtcccagataccttgggaaggctgaggataggaggaaatcacctgaggacggggaggcagtatgtttgaagttgagccattgactgcgccaacgctgaactcacagccatggtgtgacaagaaacagaggacccttagaaaaaaaaaaattacgaaacattagggggataaaaatatcataaacgtccttagtgttggggccaggacacaagggatctaaaacaccgtgtaaataccatgtggagttggaatggctttgaagccagaggaactatgaagaaaccaggcattgaggacaaaagtgtgcgaaaaaacgagtgataatcataacagagagaattagaaaaatttaacgatggagaacacgtgggagagcgggcacaactataacccacgtggagggagcagcacataaagagcatacacccccggggagaacgggctatgaacacaacaacggggaagagcacaccggtgctgataacaccgcccagcgggacaccggcaccagaagggcagtagaacaggaaggagcgcccagaagagaaatgtggagcaacccaacgacgagaggaacgccaatcgacaagcagtccacaacaaccacgaggtaggacgacacaggaggaacacgacaaaggcaagaccgcaccnaaatcctaatcgacacagccaacagaacgaaaaactagcgaaagagaaacaacactgagaacggcgagaaccacatacaagaaaatgcagcaggaggaggtcgaagaagaaagaacaaaaagaagaagcaacgaaacggaagacacaagagagacggacacagaccgaggtgagcgaaccacaagaacggaagctggcacagaccagcagacgaacagacgcactgacaccattgacatagacgtaccgaacacacagcgggaggaaacaacacaacaacaggagggaaggagtccaaccgctaaagaacgggtacggacgctgagggacctaagaacagcaggatgacatagacaagaagccagccagagggagagacacagccgcgacaattacacgaacggaagtggaaaaaaaa

SEQ ID NO: 484412 - DNA, 301 bp, Homo sapiens
acccataaatttgccggccgggcgcggtggctcacgaggtcaggagatcaagaccatcctagctaacacggtgaaaccccctctctactaaaaatacaaaaaattagcgtggtggcgggtgcctgaagtcggagctactcgggaggctgaggtgggagaatggggtgaatccgggaggcggagcttacagtgagccgagatcacaccactgcactccagcctgggcgacagagcaagactccgtctcaaaataaataaataaataaataaaaaataaaaggaagtcagaaagctaagcaaa

SEQ ID NO: 484413 - DNA, 296 bp, Homo sapiens
  misc_feature (192)..(192): n is a, c, g, or t
ttttttttttgggggggggggggttttttttccccaaagggggcccccctaggggggggggggtggaaaaattggggggggggttgggaaaaatttgtggggggggggcccccccccccccgggatttttttttttgggggtttggggattttttttccccccccccccttgaaaggaatcaaaaggggggnaaagggggtggtggggggggggtttcccccccccccccttttggggggggggggggggttccccccggtttttttttttacggggtttttttttttccccccca

SEQ ID NO: 484414 - DNA, 394 bp, Homo sapiens
catcccggggctgtttctgtcgaccagcagcgctctcagagtctcctaaacagaccatgggtcatccccgtggagttcaggatgctactgacagcccgattccggaaggtcaagtgttatacaggactggagaggccacaattcatcaaaagtaatcaaagcgcaacgcgtatcagcgctatgagaataatgttggtctgtgtccccagtaacgaatctcatcataagccctaggacagaatggctttgtaagtgatggttttgaaggaaatgcataacaaagtagttggaactcctctgttaatgtgtctttcataattgttgaagtgcaaggtgattatacttaaactaatggaaaataaaaatccatcccttgaaaggtgactataaaaaa

SEQ ID NO: 484415 - DNA, 474 bp, Homo sapiens
  misc_feature (474)..(474): n is a, c, g, or t
atttacagtccaatgcttcactcagccattttacctcacccctaaaaaaaaaaaaaaaaaaaaaaaaaaaaagattgtggggcggccatggaccatgaaaaaagtttttaaaaccatttcgtgtgggcgggggggcgcaagttaggttaagtgacaagtgtgctataagctgtgtccttagggaagacccggggtccacagactaatgtgtcggggtgttcttccacacaaattaaaaagaacggccgggcggggcacacacgaaggttgtttccggaacaaactcccaaagaggcagaggttccagcaggggccaatacacgggcgtcctaaaccaaccacggcgagcgtcccaacagcaagagcgctcggaatcattacaatattaacgcgcccggcgcaccggtcgggggaggcaggatgtataccgcacaaccacaccacagcgagacccaccaacgcagcaccgacacn

SEQ ID NO: 484416 - DNA, 1043 bp, Homo sapiens
  misc_feature (1016)..(1017): n is a, c, g, or t
cgcctttatcgtgacagtatggtggtgtgaagtgtcatctacatgtactccgactgccagtatatgtatccctacgtgtcttttcttgactcctgtagcgctgcccgctgggtactctgctgtagaagggtgacagtatgcattacctggaaaggtaggtgagccatgctactggcggtctacagacaacaagaacttccgtggatacggaggtgtgtgtgtgatctcgacattcgtggcggttccattctgccaaggccaggaatgcccaggttgctcaaggaccgccacgtggtctgggaatgcttgatgcccaccttggtttgagaatccgagctcatgaagtccgcgtggcgctagggggagatacgatggggatgcccttcgatgtgtcgagagcttctgaagactgtgcttggtggatcaccggagtgatctcttgctccaggggtagctagtctggactttgcgccctcgatgctgcagaagatggctgtgaccacagtattctgacaggagtatgatgaagatgccgggggcgctggactggctggtgctgaaggcagtgaagactgactggagacgagggtattggcactgttcatccgggtgttgtgtgcactcactcaagtatgtgtgcctgtggtacatctggcggcacgatgtaatgtccttgctggatggcaaggactagtgtgaactaggcgtagtggtggctgtggtgttgacttggcccgttgaaaagttggaacgtccgttgcctgtttaccacctgtcgggcagggtgggataacgccgcgaggggttcccacggagacaggttgcaacgggcctccttttgtcccgaggaattgtctgaggcgaactagcgtcaagggcgggtttgtgggtgaccaccaggcttcttatcgagcgggggagaatgatccctctcatcaatattgtgtgtgcgctatgtcggcgacactcagttgattatacaatcgcatgcatatatgttatggtatgactgctcnngttcaacatataccaactatacaaag

SEQ ID NO: 484417 - DNA, 1535 bp, Homo sapiens
  misc_feature (421)..(421): n is a, c, g, or t
  misc_feature (759)..(759): n is a, c, g, or t
  misc_feature (1276)..(1276): n is a, c, g, or t
gacccatggtggtcgatctatgcagactgcgctcgtgcgctacggaccgttccgcactggtgcatgctaatgatgctcgtgggtgccgtgagtctgggtcgtgttaccgcgctggatcctttgtctgtctccatgcggtagcaaggagactcatggcttgctcgtaggactactcggccgtgggagatacttaccacgatgattgcctcgtatctcaggtcgtcgtatggagcatacgcagtcggattatgaagacagtgaaggattgtagactgtggattgggcagtgacatagtctcggagtcttactacgtacgtactgatactgtcagaccgctgtgggtcgagtatgcgtggcgcgagggcaccactgatgacatgtcccgcggagggaagcgcagtcatgactccgacagcggtntggtagcgttcgagataggcggatacagcgagcccgtgagatagaggaatccggcgaggtttgatccctgatcttacgcactgtggattgagattgagtaagcagcaacggaggcgtaaacgagggagtcgctagaattgatcctttcccgcagttagcagttcctgtactactaagagcataaacttgcacaagcgcatcgacagaaattgacacctaaagcgaaaagcagacgcccaatacattcctgtaggtatttctctgcatagcgactatgtgtgcacacgcaaggcgtacgtgtaccacagtgcaatcgccctgaggagagagacatagcnatcgaggtatgacgatggtcgggaacgccaatcaatactgagattcgtctgagacgtatagcgacgcgatcgcaatccgttgaccacatatcgaaactaatacgtcagcaccacattacgcaagacacagctcccagacctccgtagttccttggacacgcaacagtgttaagtcacaagacgcacccctaaggaacttaacctcccgcattatcgactaagaatctacctttcaacacctaacttaccacaatccaaatgacgaccctgcatataatcaaccagatcactccttcaacgacagctgacaccaatatcaccacgacctgagagacaccaacaataattgctcaatacataccactacaacaacatcccgcttagcgatatcatctgatctcgccacacatccgaacctcacacacatacagctgataacaaaaccccacacagagccacttaacaacaactgcccaacatattggcaccttaagcatgctaactacgtgcagagtgnagatgacatacaaactaagccttgcatatacctcaacgatctcaccagtacctcaactagcacaaacatcgtacactcgacctacaaaatagcaccaccagcttatacccacatatacagactacacactacacacgcacaaccaaaaccgcacacatcacatcagacagcacagaacaatccgaccacaaccacaccacaccaactaaaaaatcaccaccaaacctacgaccctacacaacagactcgaaccaaccaa

SEQ ID NO: 484418 - DNA, 914 bp, Homo sapiens
  misc_feature (12)..(12): n is a, c, g, or t
  misc_feature (70)..(70): n is a, c, g, or t
  misc_feature (80)..(80): n is a, c, g, or t
  misc_feature (84)..(84): n is a, c, g, or t
  misc_feature (93)..(94): n is a, c, g, or t
  misc_feature (107)..(107): n is a, c, g, or t
  misc_feature (123)..(123): n is a, c, g, or t
  misc_feature (133)..(133): n is a, c, g, or t
  misc_feature (157)..(157): n is a, c, g, or t
  misc_feature (162)..(162): n is a, c, g, or t
  misc_feature (166)..(166): n is a, c, g, or t
  misc_feature (171)..(171): n is a, c, g, or t
  misc_feature (178)..(178): n is a, c, g, or t
  misc_feature (187)..(188): n is a, c, g, or t
  misc_feature (206)..(206): n is a, c, g, or t
  misc_feature (220)..(220): n is a, c, g, or t
  misc_feature (222)..(222): n is a, c, g, or t
  misc_feature (288)..(288): n is a, c, g, or t
  misc_feature (290)..(290): n is a, c, g, or t
  misc_feature (293)..(294): n is a, c, g, or t
  misc_feature (296)..(296): n is a, c, g, or t
  misc_feature (305)..(305): n is a, c, g, or t
  misc_feature (309)..(309): n is a, c, g, or t
  misc_feature (321)..(321): n is a, c, g, or t
  misc_feature (330)..(330): n is a, c, g, or t
  misc_feature (335)..(335): n is a, c, g, or t
  misc_feature (346)..(346): n is a, c, g, or t
  misc_feature (369)..(369): n is a, c, g, or t
  misc_feature (406)..(406): n is a, c, g, or t
taccaatttttnttgtcatctcttctaagaatcgtgttttgcgtacaaaaaaaaccttacatatattaanaatgtatacntttncaggcgtanntgcataccgcttncaactcaaagctagtnacagcccacngtgttctggccaaagacatctgcnagganaggngactnggtcctnggggttggnntttccaaccctgacaganccgcaagttaaaananctggttcttgccagcctctagagatatcccagtacatttttttttttttttttttttccctgcacntnttnntngttgctggncacnctgtctctccangccacagtnttgtnttccacaagcncgttcttaccttagccacgaagnaccaagccacacgtactaaaggttgaactcaaagttntgtacagggttttaaacaaataccaaggggaacagttaacttcaatacaaggtcaaaatcagcaacaagttctacaatccagtgctgatatcagatacaagcttcaaggacaatttcttttcgaaggcttattccagtttcgtgaggctagcatgaggtgtgtgcatttgccagggcgcaaatttctattctcaattaacccatgccgcaaatgctacgcgatctgctgagtccgtttagaagcatttgcggttggacgatggaggggcccgactcgtcgtactcctgcttgctaatccacatctgctggaaggtggacagtgaggccaggatggagccaccgatccacaccgagtacttgcgctctgggggtgcgatgatcttgatcttcatggtgctgggcgccagggcggtgatctccttctgcatcctgtcggcaatgcccggatacatggtggtgccgcccgacagcaccgtgttggcgtacaggtctttgcggatgtcacgt

SEQ ID NO: 484419 - DNA, 244 bp, Homo sapiens
  misc_feature (166)..(166): n is a, c, g, or t
tccctctctgtctcccagattccagtttactgaaatgaaatgagaaaatctggtacttgttttatgttacattacataaaatggtatggataaacaccaaccttagggccttgccactgctacagtaacgcacttagctaactacatccttcgcctcctccctagncctcctttgagcttaaacaatccacaggcttcctacttcctcacacctttgccctagcaactccttaactacttcttc

SEQ ID NO: 484420 - DNA, 114 bp, Homo sapiens
  misc_feature (73)..(73): n is a, c, g, or t
agcgactggtcaaacaatatactgcctgggaacacccaaagggatgagagcactccaagtctctgccctgagntgaagtgaggttgtcctccatttccaggtaccaccccctct

SEQ ID NO: 484421 - DNA, 228 bp, Homo sapiens
caggacaaatcacctgagctcactactagtcatcatagaaaacagaccgaaaccaaataattcaagcactgcttataacaatctaactagggtcactattctaccctcctacaagcctcagagtacttcgagtctcccttcaccatttccgagggcatctacggttcaacatactttgtatccacatggttccatgtcgttcacgtccttattggccctcatcgacgt

SEQ ID NO: 484422 - DNA, 146 bp, Homo sapiens
atttatcttaaggaggtggacgtacattaggcgtaagtagaagtagaggttacggcgggtgatggtgcgctatgactggtgaggatgatgagcgctattgttttcttgtgaattcttcgcatcatggcccatttggagcaaaaagc

SEQ ID NO: 484423 - DNA, 870 bp, Homo sapiens
  misc_feature (13)..(13): n is a, c, g, or t
  misc_feature (106)..(107): n is a, c, g, or t
  misc_feature (126)..(126): n is a, c, g, or t
  misc_feature (138)..(138): n is a, c, g, or t
  misc_feature (140)..(140): n is a, c, g, or t
  misc_feature (157)..(157): n is a, c, g, or t
  misc_feature (163)..(163): n is a, c, g, or t
  misc_feature (169)..(169): n is a, c, g, or t
  misc_feature (174)..(174): n is a, c, g, or t
  misc_feature (184)..(184): n is a, c, g, or t
  misc_feature (187)..(187): n is a, c, g, or t
  misc_feature (197)..(197): n is a, c, g, or t
  misc_feature (199)..(199): n is a, c, g, or t
  misc_feature (205)..(205): n is a, c, g, or t
  misc_feature (210)..(210): n is a, c, g, or t
  misc_feature (231)..(231): n is a, c, g, or t
  misc_feature (277)..(277): n is a, c, g, or t
  misc_feature (281)..(281): n is a, c, g, or t
  misc_feature (284)..(284): n is a, c, g, or t
  misc_feature (286)..(287): n is a, c, g, or t
  misc_feature (297)..(297): n is a, c, g, or t
  misc_feature (358)..(358): n is a, c, g, or t
  misc_feature (424)..(424): n is a, c, g, or t
  misc_feature (449)..(449): n is a, c, g, or t
  misc_feature (474)..(474): n is a, c, g, or t
  misc_feature (538)..(538): n is a, c, g, or t
  misc_feature (615)..(615): n is a, c, g, or t
  misc_feature (670)..(670): n is a, c, g, or t
  misc_feature (675)..(675): n is a, c, g, or t
  misc_feature (684)..(684): n is a, c, g, or t
  misc_feature (735)..(735): n is a, c, g, or t
  misc_feature (765)..(765): n is a, c, g, or t
  misc_feature (865)..(865): n is a, c, g, or t
taccaaagtgaanaaaaaaagatactgtcaaaaaagcacagtggacataaaaactgacaggagaaatagagcacatttgtcttgatccttttatattaccacatcnngattcgcagtgggaagagntcagtgcatggnantctaaacagaaaacatngaactnagactnaaaanaaaaaagggnagngggaggaccngncaaaanccaancacaggataacaccacaagcnaaaattcacatgtcccaaaggcgaccacactcaagaagtgacgtanaganacncnngcaggataanaggcaccagtttagaaaggggacccacttccaacctttgcacagtccaaaaacaaaggcanttaaatgatttaaaagcaattacatacatatctacctacttgtttgtttagaattatttatagtcnatcgggggtttcatgtacaaaattngtctctaaatcatgtacaaaaagcngcattttgaaaaagtcaccacatactgtacaagtttacaaggaagagatcccgttattttctcnagcatttttggccttgccggcttgcgtcacattatgagaatgattgtgtaaaccttatactcttaaaaaaaaaaggnaaaaaaaaaacccaaaacatagaaatctttacaactttctctaaatttgcctccnatgtnaagtcaggnaaatcatagctttacttctagttgaagtgatgtagttggaaaacagaagcnataaatatgtcacaagcttcaatttttgtnatgccccttctatttcctgcatagcaataagcctgttaatacattaaatgtttttgctttctctttaaaatgccaattattttacatctgtttcaaaaanaaatt

SEQ ID NO: 484424 - DNA, 221 bp, Homo sapiens
gggggtggcaaccaaggattggaaaaagggggacccctttttcttgaatggtgggccaagaggccctgccgttggcttttaaaaaaaaaaccattgaccggttggggggtaaacccacccatgtcaatgtgtttgttgttatgggggagggggggggcccctgttattgagccgcccgcctgtccccccccctgaataaattccatgttcccccaagcaga

SEQ ID NO: 484425 - DNA, 361 bp, Homo sapiens
aaaagtatgatgaaatactcagaagtgacagaataaaacggtcctaatgttagccattttggatcataggagccatgtggagtaatgactgataagggggacacaatgagaaaaattcttccaaagaactcagtcaggcacagttctcacttaaacacaggagaagcagggaaatattcagtagagagtttagaaagaaaataatagtaaaaaagtacaggtaaggaaaattactagaacaaaactacatgtattagaaagaaaaaatgagagaatcatattccagctaagtgtgagatgaatagctagcaactactcagctgtggcaatgaagatgagaagacaaatcttaaagtcttct

SEQ ID NO: 484426 - DNA, 577 bp, Homo sapiens
agcggggggggttgtcttgttttatgatggccaatgtgttaacaagagttacagactcgtatttgatatcaaatgtagcagctataataccttttaaaaactttaccaaaaaaaaaaaaaaaaagattaagagaaaattcccttgggaaatttccacctggagcaaaagaatcctagctcctgaggtccagcatactccatctgggacaagacagtgcggggcaaataggaaaccggtgggagaacgcaggcagatgtttctaagtacagcttggtggcaggaatgacctgtttgacaaaaacccttggaataagtgttggtggacctttaacgggcaatgatttatcgacatgagctataatggtaatacagcaatttaacagatacgggacatacggtgaaacacgagaagtgtgttttccaactgggcccagtaatcacctgtggagactgcagagcaggccaccacggggatgcagacgtaccctggagcctgcaaggtactgggcttcagtaataccctttcaccgtgaagagtgccaagctcccctacgctgtttcaagagcaccacctaa

SEQ ID NO: 484427 - DNA, 416 bp, Homo sapiens
taaacaattacaaaatgcacagaactaaatacacacacacacacacatacactacatctaatctcggtgaaatctgaataatcatgaatgtattgtatcaatgtcaaattcctgtctttgatactgtatttagctgtcccaaatgtccccattggggtaaatatgggtgaaagtgcatacatagatctctgtattatttcttacaactgcacgcgaactacaagtaatctcaaaataaaaagtcttttttcagaagacaggccacaagctgaaatttataatacacatacatactagactatcgggaacaaaatacaaaaaatacctataagctatgacgacacaatataataacaaagggcgaaagggtacgagctcgggattcacagaagaggaaattcgcagcttataatacc

SEQ ID NO: 484428 - DNA, 605 bp, Homo sapiens
  misc_feature (169)..(169): n is a, c, g, or t
atcgtggttcagtgactacgcagactctgtgccctgaccctgtagtgccctgtattgtgtggaagtggacacgttcatggaggcatatgaccagaacgatcgctgaggaagaagctaagggcgcgaggggaggaggagggggtccctgacgaggatgggctgggctgancgcgtgacccgccgggggccggctggcctgtgctcccccggactgaggcaggccaggcttgcgggtgctggagagggagagacggaagctgcagccgaaaagagctgcgtcgaacttcatacgcctggcagcgagtcggaggagagcgagaggatggagcatctagcgcagctgcgcaagaaggttcgaggaggacaatgcagaggatcgagctgctgctgggcccagcgcaaattccgaccgtactgagctgtgagaagccgcaagatgaatggctggaggtgcagggccaggaggaggcgatggcagtggcctgcaagcggtcatctgaagaggccgagcatcatggccaactgggccccaggttgaaggccaacgagtccaacagccccatcagagtccacaaggccaggagggaaggaccagggccacccct

SEQ ID NO: 484429 - DNA, 230 bp, Homo sapiens
cagtgggtaaggtggagggccactgccagaggctgcctgccagtgcccctcctgggaagtgcccagggaccctccagctgccagacccaggggatccccaatccccttatctctgcctgaaaagtggctattgctgcttcgttatcctcccagtgctcacagggaatgcctgtgccctgcagcacatcccacttttagttttttttttttccaaacctgctcactcactc

SEQ ID NO: 484430 - DNA, 302 bp, Homo sapiens
agccagtatctactaaaactcaagaaaattagccagacgtgttgcattgtgcctgtagtcccagcacttggggaggccaaggtgggtggatcacttgaggtcaggagtttgagacctgcctgaccaacttggtggaaaccccatctctactaaaatacaaaaattagccgggcgttgtggcaggcacctgtaatcgcaactacctgggaggctgaggcaagagaattgtttgaaccccagaggcgaaggttgcagtgagccgagatcgcgccattgcactctaacctgggccacaagagcgg

SEQ ID NO: 484431 - DNA, 188 bp, Homo sapiens
ctcaacctcatctccttggacatgattttctcttttcaacttcttgagcttgcgtcattactggatgtgcgtcctgaatcttgtggtccgcccaccccctgttggccctcactatccttggagtctgtactagggaaggcctcccagcatctgcgactctcagagtgggcagcccctctacctcctgg

SEQ ID NO: 484432 - DNA, 288 bp, Homo sapiens
aactcacggatcctcgatgttgtctacaatgcatctaataactgagctagttcgtaccaagagcctggtgaagaattgcatcgtgctcatcgacagcacacctgtaccgacagtggtacgagtcccactatgctgctgcccctgtggccgcacagaagggagccaatgctgactcctgcaggaagcacgcacattttaaaccaaaaaacgatctaacaaaacttcagaagcaaatatgcatgaaaggacaaacgaatgccacacaatcagcatgtctcctagcaggag

SEQ ID NO: 484433 - DNA, 324 bp, Homo sapiens
tataaattcgtgtccatgctaggacttcaccagcaaagcgaactattatactcaagtggatccaataacttgagccaggcgtgaacgagttaccgctaggtgctaacaggcgcaatccgtattctagagtccatatcaacaatagggttacgaccgcgatgtaggagtcaggacactcccgactggtgcatgactcgctattcaaaggttcgctcgttcaacgatgacagtacctacgctgatctagtactcagaacggagtaagtccaggtcggtttctatctacttcacgttcctccctgtacgaaaggacacgaatgttca

SEQ ID NO: 484434 - DNA, 1011 bp, Homo sapiens
tatcgatgataggaataactctaccttatatggtagagtatcctatcatcgataatatatatggtatatatagagagcacgtgcctaactgcagattgatccacttcagtccactgtgaatggcgcctcctggaggtgtgccaagtactgcgcccagaacacaaggtccacacctcagtacaacgactctgataagactgacaaacatacctttgcaagggacagtgcgagtctgacaatacaagaacaaaactacacagctaaatacacaaaaacacaaaatgtactaacgatccataaagccaaatagacaagacacgaccacatacggcactaccataccaatacaacccaaaaaacacacaccaaaccaaaagccaaaaaggcacccgtagatccaacagaaacgtacaacacgaaccctgatcctagaacatccaagaaagagacgaagcctagaacctaaacacctcaactacgtgctatggaacaggcaaccagactccgcgggcgcaacaaacacgaacagacatagccatccgaactacccagccgcagatccagaggcgcaaacaccacggccgaacagactcgacctagaccacactacgagaccaacctccacggaagacaaatacaccaagaaacatcactacggcaccacacaaccaccatcagcaaaaaccaccgcaccagcaaccgcacccgcactgataggaagagcacacagaacgccgacgaaccattaagcccagaaacacgccgcaacacacgtagacaaagaacggggcaaaaagagaaacagaacaaaagaaaacacgaaagccaagcaaccaaagatgcaacccacacggagcgccgccgccaaaaacaaacaggcaacaaaaccacgagaagcgaagcaaagaacgaaacaacgaaaacccgccacagcgcgaaacaacgtgagaagagacgaacagaaaagagatcaccagcgaagagaaaatgaccagacgaaacaagagaacg

SEQ ID NO: 484435 - DNA, 442 bp, Homo sapiens
  misc_feature (9)..(9): n is a, c, g, or t
  misc_feature (89)..(89): n is a, c, g, or t
agggttcanccggagaagcaggtgatatggatttaattccatcttcctccaaaatatactagagtcctaacctccaggtaccccagaantgtgaccttatttagagatagggttgttacagagttaatcagttaaaatgaggttattagcctgggccctaatccagtatgactagtgtccttattaaaaggagaaaattggaagcagagagacatacacacacagggagaatatcatgtaatgatgaaggcagaggttggggcaatacattatctacaggccaaggggcaccagtgactgtcagtaaaccaccagaagctagaggagaggcttggggcagactcctcgtcacagccctcagatagagccaaccctgctgacaccttgatcttggacttctagcctccagaactatgagacaataaatttctgttgttctaaa

SEQ ID NO: 484436 - DNA, 449 bp, Homo sapiens
tctctgctcccagattcaagtgattcttctgcctcagctcccaaggagctgtagctacggcgggcaccaccacatctgggtaatttttttttggtattattattggtatagacgggttttgccatgttgtccaggcgtggtctcgaacttttgacctcaagtgatccacccgcctcgggcttccaaagtgctgggattataggcgtgagccaccggacccagcctgtgtgttgcccggccttctaagcactttacaaataaccaactcatcaaatctctgggaggaagaagaatacacaaaaggaacagacagaaaatcaaagtagacccaggagaagcccagggagacttgtagggtgaacagtattgggtccacatgtgcacattaaacaaacacagatgtatctattatccctatgtatatcctctgtactcaggccaaagaggtc

SEQ ID NO: 484437 - DNA, 358 bp, Homo sapiens
tcagaatatgttgcacatggtaagagtagttactgtttcattaaacttgtctcaatgacaaagtaagaaaatttactttgacacccagttaaaatggaaacgaggccaggcgtggtggctcacacctgtaatcccagcactttgggaggctgaggcaggtggattgtttgaggtcaggagttcgagaccagcctggccaacgtggtgaaacccccgtctctactaaaaatacaataattagctggcttggtggcccatgcctgtaatcccagctactcagaggccaaggtgggagaattgcttgaacccaggaggcagaggttgcagcaagccgagattgtgcctgtgtactccagcc

SEQ ID NO: 484438 - DNA, 398 bp, Homo sapiens
agtttttaaaaggaagatttatttaacaagtttcacttagtacaatacatctaaatggaattcacaatacaaggtaaggtttaaatcaaagccccagaattccatacaaataacatgaccaaactcctaatgtattggtatcacatctcaaaattgttccggatctttaaaaaaaaagtgaaagtgtacactcacgtgccttacaggatattaaaccaaaaagctagaattaacaaacatgccaaatgttgtcactttgaatcatagacacagctcctatatatatttttttttacagaaaagcatgtttttcaacatgcatctgaagttttcgatgtattgtggtataagagcaacatttaacgtaagtgaaactggctttaaacctaaatatgctt

SEQ ID NO: 484439 - DNA, 177 bp, Homo sapiens
  misc_feature (14)..(14): n is a, c, g, or t
ttggaatgttttantctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttc

SEQ ID NO: 484440 - DNA, 153 bp, Homo sapiens
  misc_feature (71)..(71): n is a, c, g, or t
gtcgacgtcaaatacatgagacacatggacaactacatcagacacatggtcaactacatcagacacatggncaactacatcagacacatggtcaactacatcagacacatggtcaactacatgagacacatggtcaactacatcaaacacatg

SEQ ID NO: 484441 - DNA, 489 bp, Homo sapiens
actttttccttggaccagccggggggcaccgtggatttgaccctgatccgtgcccgcttccagaagaagttgtccccccttacagctccccacaggagtttgcccaggatgtgggccgcatgttcaagcaattcaccaagttaactgaggccaaggcagaggtgcagtccatcatgggcctgcagggtttttttaaaaggggcatgaaaggggccttgggtgaccccaagttttttgttgtgttggtggggccccccccgatgagcctgcctggggtgggcctgagttcccaggagttgtttggtggccctggtgatggcccctgaggttggagcccccatggccagcccagccgggttttgttttttgtcttgtccccccatcccccctccccggggggcctgattccccctccctgggggccccctcccccagttcctcccgatatggtttttatttttggggttttaataaaaatttccccggtta

SEQ ID NO: 484442 - DNA, 128 bp, Homo sapiens
gcaattgactgagtgatcaaaatcttttggtgatatttgaagactttaccacaaagtttggttttttttaaccagaatgcaatcggccgtgtagatgattggaatagtcaaaacaaatgaaaatcccc

SEQ ID NO: 484443 - DNA, 955 bp, Homo sapiens
agcgggccaagggtcctgggggaggcagccggggcaatgggggatggtggctgtgggcagagtgcaaggcactgaggcaggaagactgctggatgccgattggacttcctgtggagaaaatgtctgtgctgtcgcctgtgtgatctacagaggccccgacaggaacagaaactcgcatcaacccactgggggcagcacaccggtgtgacaggacaggccagaccccgggaggaagcaaacggagcgcagggactcaagagaggaaaccgagtgtacgtagcccgatcacccaacaaagtgggctacacaggggtgagcgaagagaaaacgattccctgcaagagcaaaattcaaaggtagaaaagagcaactacctcccgcctggtggcgtactaccggccagaggaaacatcgcagggtcggaaacccttatccgagacatcaaacagacaccaagacgtagcagaaagcaaggaaaaagacaagcccactggtgaaaagagagttcccaagaggggcaccacctgggagggcaaaacccaataaaaggggcgcaacgataacccgcggggagaagccgggaacgagtgccgccaccaccgtacttaccactaggacccaaaggcagcccacattgagaagaacgccatagggtgagacggggaaaatgcacaaggaccaaagtggagtgagtcgacagcattgtgataagcacgcgcaaaggtcaactggggccagaggacagaagagaaaaagaaaacgacgggaagggaaacagcgaactaggtgggggcctagcactagtcgtacagacgacacacgagcaacatcatcttccgcttagcaaggtcccgcactgagcctagataaaagcacataaccagaatgccaagcagtgaagatagaaccaaaccggcaaacacaaacgacagcgaacgaagcaccatgaaagcca

SEQ ID NO: 484444 - DNA, 902 bp, Homo sapiens
ctgcgtctggacctggctggcgcgggacctgacttgactacctcatgacgatcctcaccgagctcggctacagcttcaccaccacggccgaccggtataatcgtgcgtgagataaaggagaagctgtgctacgtcgccctgaacttcgagcaagagatggccacggctgcttccacctcctccctggagacagagctacgagctgcctgacggccatggtcagtcaacacatttggcaactgatgcgggttcctgctgcccatgaggcacctcttccattactttctcttcactggtgcactggatgtcctgtggcatccacagaaactaccttcaactccaatcatgaaatgtgacgtggacgatctcggcacagtaggaccgtgtacgtccacatcggacaggtgctgtctggcggcaccacgcagtgtaccctgggcaattgccgacagtgcatgcagcatgcagcatcactgcccatggacaccctagctgcaatgaaagatcaatgatcattgctcctcctgcatgcgacaaagtactccgccgatggcatcggcgcgctccatcctgtgcctcgacctgtgccaccttccagcggatgtggatcagcaagcaaggagtatgacgagtccggcccctccattcgtccaccgcacatgcttctagtgcggactatgacttaggttgcgtcacgcccctttcttgacgaaaacctaacttgcgcagcaagcccacgatgagattggcactcgctgattaagcctttgaccggagcgctaggcgcaccacaacaccgagggcctcacccggattccagcgcggcggtctccgggcccccccgtgggggaatcccccacagttagggggcggagactcttccccctggtggttactccccg

SEQ ID NO: 484445 - DNA, 228 bp, Homo sapiens
caaccagtgtgctgaagagctaacaatgtcagcttggctcttccaaggttgcaggagcgagactcccagtgagctacgtactgtctagggggctgacagacaggcctaggagggacaaccagccaaggggagggatagtctgagaccaacctagagtaagtgccaccagcgcccccgcgcgtaagggccagcagaggcgtaaggggcaggcgcgtaagtggccagcag

SEQ ID NO: 484446 - DNA, 446 bp, Homo sapiens
agatagccctgccataccgtgggaattcaagatgagattgggtggggacacagccaaaccatattacctctggagcccctagaaacccaaggtcagtcatttagggcaactgctctgagctggagaaaggaggatctgaaggcccttacttgatgctcagtcactgcagcaccagccaacttagtcatttttgttctcccatttgccagcaaggcaattccttcatacattatctctagggggtagcttgcatcctcagtgattatatacttagtggttataattttatcagccacagatgaaattctcaacctgcaatcatttttatgtttgataaaagtagggaaaattgtataatgaggagtaagatgttcttctggtccccaagcagtcagtgtgctttacatgcaataaatggtgtaaaatgcacttgtgcgcactgaaat

SEQ ID NO: 484447 - DNA, 1436 bp, Homo sapiens
caaaccaaacttttattctggaaaaactgggctgtacaatatctaaaaaaaaatgtgacattgaaggaagcaattctacaactttccttccggcttagcggtgcagtgcattgtgtggtgtacggtgcacggtgttgtcacggtgttctgcagtggtggtgggaactccgggggcgtggcaggtgtggagctatacacggagcaggcttgagcgggagaacgccgagacgatgtgggcgtggagacgccacttggggcatattggagaagatcccgtggacgcgtggacgggggaccgtggtccccaggccttccgtggatatccccccaaaaagggggaacgtgccgcatgagtgtggggagaccgggggaccaaatgtgtcgcggagggaagagaactcgtggacaaacgcgacatgggaacgggtgggggcacctccctttgggcccttcccccgtgttgggggggagaacgttgaagacaccagcgaagtggtacctttcctggggaaccactccaccaggggaacacaaagacggggacgcaaaggcggctagggggggagtgtagccagagtgaggtagagcacgaggggagcaaaacccacaatcttggaaccaaatagggggctgggcacacgcctcgggggagcaccgcggggaggtagagtaaaacacgggggcaaaaatccgcgggcggcgtggggacaacccctggacaaccgggagaggccccaaaagcgtcgcctcagaaggcggaaccagggaaccctagcatagaagggtcggagatagagagagcagcataggagcaagagcaacgaatcgacacactttgacccagtaacaagctgcggcgctcgggacaccgaacgggggagaaagcgtcccagatggaagggggacgcaacgccccgacacaccagggacgacgaaccacacacaaactgtgcttcttggagacaccaagggaaacaggtggcccaaatggggacagagcccaagggaaaaaccatttagagagcaacagcacaagggggcgttgacgacagaggcacacaacggcctggtagtggggccccatggcgacagaaaagcaggatacacggcaaatgggagcccggggcggctaggaagataaaagtggcgcacaccacagggggccaccagggagagtaaacctgtcggctagacaacagcggtcgaagaaaccacacgccgtggggccccgcagcagcggttgacaccccggtgggatagccaagaagaaagtaggccacagggagcaccacggaaatcgtgtgcggaaaaggagaccacagagaatcgacacaccaggaaagagggcagcacacactagcctaaaacgagacaccaacggcgtacccaggagaggccacaaagcaggcagttgccaacacacgggaacaagagca

SEQ ID NO: 484448 - DNA, 144 bp, Homo sapiens
  misc_feature (9)..(9): n is a, c, g, or t
  misc_feature (22)..(22): n is a, c, g, or t
  misc_feature (96)..(96): n is a, c, g, or t
gcctttgcnttgcatattgtgngtggatgtgtgtgtgtgtgtgtgtgtgtgtgtgtgtgtatgtgtgtgcttctgtgtgtgcctaatgctctgtcncttggtcactgaagcatccaaataaagaatttccctcaaaaaaaaaaa

SEQ ID NO: 484449 - DNA, 562 bp, Homo sapiens
tcgacagtttctgcaacatgtagactggtgagacctgtcgtgtaccccactcagtcccagtgtggcccataagaacttggtacatcagtcaagaaccccaaggacaagaggcctgtctggttcggcgagagcgtgaccgatggattccatgttcgagtatggcggtcagggctccgatcactgcgcgatgtggccatccagctgaccttcctgcgcctgagtgtccaccgaggcctcccagaacatcacctatccactgcaagaacagcgtggcctacatggaccagcatgactggcaacctctagaatgccctgatcctccagggctcctacgacatcgagatccgcgccgagtgcaacagctcgcttcgagctagcgggcgtcaggtatcgatggctgcaacgagtcacaccggagcctggggcaagacagtgattgaataccacatcaccatgagctcccggctgcccatcattgatgtgtgcccttggacgttggtgccccagaccaggcattcggcttcgacgttcgtcctgtctgcttcctgcttctgccccaagc

SEQ ID NO: 484450 - DNA, 141 bp, Homo sapiens
agtaacctgtcttatataaaaatgcttctactaaagaatgcttattcctaccccacactacctatcactataagagtataacgtactaccccctaaagtgcatttctcaaggcatatacaacacagcactagtgattatgc

SEQ ID NO: 484451 - DNA, 817 bp, Homo sapiens
ctgttcttcaggcaccacagtgtcatcgtagtctgtgttccacggatatctgcggtcctcagacatactgcaggggctgatggcggaatatgctggttcctgagctgccctagtcggtgatggctggagacggactggacctggttggagcgggtgatggtcacgcgcatgcctgtgtgcatgagggcgcctaccaggtgcggctgtgcaatggacggcgacgtggaccacggtgctaggtggactgacatgctagcccgtgtgattgagtgccgggctagacctcgctctttctcgacaggctgcacgcgtgaagcatgctgtgggtgagccctcatcgatgaagtgcgctggccaatgctgcactggctcctactttgcgctccaggcggagccgagccatcgaagggcctggtcactgctcacctggtgccccctgtgagagccttggtgctgcgagctcagctccactagagccccgcgaggagcccgttgactactgacctcatctgggccaaaatgctgagttctaaggaggctgggttacctcatgggtgcctcctgtaggcgggggcaacatgaagggtggacgattcggcctacgagagcctgggccttggccccggcattgcctactccatcctggatgtccgagatgtccagggcaccaggcttctgcggctccgagacccgtgggggccgaaactcctggaacggcaggctggtccggacgagtaggcacactggactggggcacctgcgttgggaagctcatgccgcacggcaagcagtgagggcgtctactggatggaagtag

SEQ ID NO: 484452 - DNA, 493 bp, Homo sapiens
cagttctctccaagtattttagctcactgatggagagcatcaaaagactgttttcaaactcagttggctcctggagcaagagctgctaatatcctgtatctccagcttattttggctccatggaagaggagatgcaaatgttttgtggttcatgatggaaagctggtatgcaattagaaattcttcattctttcattcaacatggtatttattgtctttcatgtaccaggctctttgctaggataaaagagtaaaatacatcccctaaaagactaatagtctagtagaaagaaattgattatgaaacagagaagatgactataaaacactgtgataaatgcagtaataaagaaacattataggagcactaaagaggcagtcatttactaatccatcctatgctgaagtgagatggaaggatttgtcatggagggctgcgttgaagggtgttattcaagggacaaaaaatgaagggcattccaggtagaaagag

SEQ ID NO: 484453 - DNA, 556 bp, Homo sapiens
  misc_feature (13)..(13): n is a, c, g, or t
ggtcggccccccnttgatgagggtgctcaggacaggagccttctgaggattgcagaggggactctggggagaggaacatggtggccacagctggagtgaccgcagtgtacagagatgggatgggagcaggaaacccaagaagagccggccctggaaccaggtggaggggaggcagcccggccatgacccagagcaggtgatatgatttggatctgtgttcccacccaaattttaggttcagttttaatcctcagtgttggaggtgggtcctggtgggaggtgatcagatcatgggagtggattctaatggtttagcaccattccctcggtgatgtcctcatgatggtgagctatcatgagatctggttgtttgaaagcgtgttgcacctcccctgactccctctcttggtcccgcccctgccatgtaggacacctgctccacttcaccttttgccatgagtaaaagctccctgaggcctcccaagaagttgatgccctgtgcttcctgtacagctgcggaaccgtgagccaattaaacctcttatctttgtaaatt

SEQ ID NO: 484454 - DNA, 123 bp, Homo sapiens
  misc_feature (44)..(44): n is a, c, g, or t
tccatgttgggcatactgtgtttagtaattagtgagctgtgggnaggatagtgtctccctgggtctgtaagggctccagtctgaatgatagaccgagactccatctcaaaagaaaaaaaaaac

SEQ ID NO: 484455 - DNA, 432 bp, Homo sapiens
  misc_feature (143)..(143): n is a, c, g, or t
acaggacggcctcaattcctctccctcactttttttaaagagcagttactatataacacactgctcttcaccaaaggtctgggctttgggtctgggagttaaaattgagtctgctgatagaagaaaatgatttctcatacatnaaattactaatcctgtggtgttttagggacaatttgtctcacacctatattagaaagcagcaaatatttctgttacttatctattacttagagatggggtctcagtctgtgacccaggctggagtgcagtgacacgatctcggctcactgcagtttcaacctctggggctcaggtgatcttcccacctcagcctcctgagtagcttggaccacaggagagcaccaccacgcctggccaaatatttctactttgatctacaaaatacgaaactctcttcaaagcgcagat

SEQ ID NO: 484456 - DNA, 499 bp, Homo sapiens
  misc_feature (349)..(349): n is a, c, g, or t
  misc_feature (432)..(432): n is a, c, g, or t
  misc_feature (468)..(468): n is a, c, g, or t
  misc_feature (473)..(473): n is a, c, g, or t
gccgaattcggcacgaggctgtctccagaatccagataggcccactgaatgtttttgctgctttcttggtggtgggaagggtcaggtgcaataatttattcttcacttagaaggaatatctctgtaggccgcaccactggactcctaagaatttcattgaggtagaaggccctttaattttgattggatttattccctatcctctgatatccatgtgttaccaacaagtccaaagtagttgctacttcctgctcatatatgctgtttaatgtctccttaaggtaaaactttgaatgtattaccgctggtgcttgtcaattggaaagcaaattgtttctggtggggattnatggacagggtattggagaaaaagacatttgttggatcaatagcaacataccatgtaccaggagatgtgttaatcttgtcaangtaaggttaccattctggtacagcagttgatttggngtcantacttaaattggaggaggcaacctgt

SEQ ID NO: 484457 - DNA, 383 bp, Homo sapiens
tggcaatccacgcatggcctgagctcgggagttcaagaccagcctgggcaacatggcagagccctgtctctaccaaaaatacaaaaaattagccaggcatggtggtgctcctgtaattccagctattcgggagcctgaggtgggaggatcgcttgagcctgggaggtggaggttgcagtgagctcagattgcgccactgcactccaacctgggtgacagagtgagaccttgtcctcaaaaaaaaaaaaaaaaaaatgaagagtctgagtagggtggccaaatttggcaattacaattacaaggtctcccaattaattttaatttacaattcaccaacaaacaattttttcaagtataagtatgccccatgcgtgaatggccag

SEQ ID NO: 484458 - DNA, 467 bp, Homo sapiens
  misc_feature (424)..(424): n is a, c, g, or t
tagaggaccctgtgacggtaccaacaccgggaagtacccatagaccttccatcagaaccaaggtgagagccgggccccgcggccggggaaagcaggttgagtgcccagccttgtgggcaagtcctgggccggccaggcctccacaggctgcagcctccttccctccgtctctatctctcattggggttggggaccaaagaggtgaggatgcctcagggggctagccccagggggttgactgggctgggaggcactgggcacagttcctgttctcacgggccacccttacacagcagcactccctcgggaaccctggggacagagcacagccctggggacacggcagcagccgggtgtacttaaggggtcttcctattagcctgctctccccattgcctggcggtgcctgtagctcttgcctgtnagaggggagcctggaagggctgctgggggctttgaagccgttc

SEQ ID NO: 484459 - DNA, 328 bp, Homo sapiens
cagaaactgcctgccatagagaccaatgagaattcatgaatgagctgggcatggcggcgcatgcctataatcctagcactttaggggctgaggctggaggatcactagaggtcaggagttcgagagcagcctggccaacatagtaaaaccccgtctgtactaaaatacaaaaatcagccggacgtggtggtgcgtgcctgtaatcccagctacttggggagcctgaggcatgagggtcacttgaacctgggaggcggaggctgcagtgagctgtaattgtgcaactgcactccagcttgggtgcagagtgagacactgtctctaaaaa

SEQ ID NO: 484460 - DNA, 424 bp, Homo sapiens
ggagtcagagcacaagctcaagtcacttcagtaaattccactctgcaagtgcagcaatgtacaaacaaaatgtatttttgaatactctaaaattgtaaatagccatataaattcatattactatatgctctgcattgttgtacacattatatttatatcgagagtggcttaaacatgcctgctggattttatgggcaattttcaatgatattttaattgtgtacaattttcaccttgtgtgttggatttagaagctgctccctacccaagagataataacttgagtgtagctgtctcaggccagacctctagaaagttccattcaaggccgggtgcagtgctcaagcctgtaatcccagcactttgggagcccaaggcaggtagatcgcctgaggtcaggagtttgagaccagcctggccaaca

SEQ ID NO: 484461 - DNA, 257 bp, Homo sapiens
cacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaag

SEQ ID NO: 484462 - DNA, 1213 bp, Homo sapiens
  misc_feature (548)..(548): n is a, c, g, or t
  misc_feature (1020)..(1020): n is a, c, g, or t
  misc_feature (1024)..(1024): n is a, c, g, or t
  misc_feature (1049)..(1050): n is a, c, g, or t
  misc_feature (1052)..(1052): n is a, c, g, or t
  misc_feature (1054)..(1055): n is a, c, g, or t
  misc_feature (1057)..(1057): n is a, c, g, or t
  misc_feature (1059)..(1059): n is a, c, g, or t
  misc_feature (1062)..(1062): n is a, c, g, or t
  misc_feature (1066)..(1066): n is a, c, g, or t
  misc_feature (1076)..(1076): n is a, c, g, or t
  misc_feature (1082)..(1082): n is a, c, g, or t
  misc_feature (1092)..(1092): n is a, c, g, or t
ctgctagactggacctatgtccgatggtgtgaccccaaatcttcttttcagagagtagctgggagtgtaccttattcatgatcactctggcgagctagactgagttgaataccttacttctggaagcatatcttcgtgttccaacgtccatgtcactccacttaagattggtggtagaattctctttattggtggcatcacagctcccagcagtgagacagtactacgcttgaccgtcaccgacacacagtgcaagcgcgtaggaacacaaatgctgggtgtctggggctcattggtttcctggcaggccatagattgtgcataaaattgggacaagatctcttctctaggagcccaagatactctatgtggtgcttggcttctttgcgtggcttgcaccactttcctctgtctgtacggcatgattcggtatgcagaacactatggtcaccgagaaaagacctactcggagtgtgaagatggcacctacagtccagagatctcctggcgtcacaggaaagggacaaaaggttctgaagacagcccanccaagcatgcaggcaacaacgaaagccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggggcgcgtcaggccagatccttcggccggggggcccttggccacgcttggggctctctctctactctctcagactcttgatgtgcggtcaccggtggcagcgcggtgtgtcgaccgggaccccggtagctattcattcacagttgccaagagcagctccgcgcctgctggatcgtggatgcagcgtaaacatcttccttcagacgaggcatnaacnccatggttaatggactggtcaccanntntnntntnatnttangatctacctntccttnactgatttcncgttcaggccacttttctgtcttttattccggttactgtagtcatatgttataacgttaggatgccttttaacagcctttagaagccgctgctgaaattgatactgggggacaggttccac

SEQ ID NO: 484463 - DNA, 239 bp, Homo sapiens
gttgtagtacttttttttcatgttatcataggtatcttgcgtgatgtgtgacttgattgttcgtgctctggtgctctttgcgttactacgccaacttctctcccccttcacaccccctccgtccagccacgtcccccggcgttcgcctgagtcggccgagcgtccccagctccctggagaaccctgaggaccggccactgcgcccagacccgtgccgcggcgccccgccccttacccgc

SEQ ID NO: 484464 - DNA, 84 bp, Homo sapiens
acgcggaatggcaacgtgcctgagaggcgcggcgtcgcaaccgtgccagaagctgaggaagccggcgccagttcgcggggctcc

SEQ ID NO: 484465 - DNA, 377 bp, Homo sapiens
tagttttcatttggggctggatcattctttgctgtggagctgtctgtgcactgtaggttgtttagccacacccctgttctccactcactgggtaccagtggtatctactcctcttttgtccagttatgacaccaaaaatgttttcagatattgccaatatccctggtgaggcaaaattaccctcagttgagagtcactgtcataaacctactgccactgctttctacattttatttcacaaacttttttgggtactttctgataagaagaacctatgagacactttggacgagtagggaaggtgggctccaagttctttatttgttatgtacttggttgagtgaagcacacagttttcatttctaggggtggggata

SEQ ID NO: 484466 - DNA, 276 bp, Homo sapiens
cctgtactggaaacttctgcccattccctctgcttatgcctcggatcaaacctaacagaaacaggcaagacaaggtgggaaagatgagtgcagggaacacagaggacttttagggcagtgaaaatactctgcatgatactataatggtggaatacatgtcttcatacgtttgtccaaacccacagatcatgcaacaccaagaatgaaccctaatgtaaactatgggtttcaggtgctgtggctctgtcagtgtaatgtgggctccccgggcggccg

SEQ ID NO: 484467 - DNA, 200 bp, Homo sapiens
gctaccagtgtaaagccagagctgaggttcttgatagtccacaatggggtgaaccacagcaagttagtgcacttccaccaccctccaatgccaatatatcaagggattatacgggatgaaaatattcaggagggcttagctcccaggcctcccccctccattaaaaggcacagttacatgatgtttggcattcagttcca

SEQ ID NO: 484468 - DNA, 388 bp, Homo sapiens
acagcgtgtactgcacccaggacagcggtgtgtcatcctgccccgtctctctgaaatctcacccaggcaacagggtacggacttccacacagagcttatttcccatggcaaggttagtgccatagacacgcctcacttcggggtgcttcgaaaaacaacgggacacgggacggaaaccgaacacggggtcttctctatctaggtggacaggacgggggcccacagcggttctgcccttgtcctgggggaccggaggacctctgactgggggccccgggcgaccccactccactgcacatgatgtgtgtcctcccgcactgcctcggactcactttgccacgtgttctcccttcttcttcagggagacacctgtccagccacctccctc

SEQ ID NO: 484469 - DNA, 1380 bp, Homo sapiens
gtgtattccccctcctctctttctttgttcttcctctcttatagggggggggccgcttcttttgagttgcgccccttccttttttttgtttttcacccgctctcgctcggttctactatcattgtttgtttgttgttggtttccttttctctcgctctctttattattatttatgctttcgtttttgttatgtaatgtgttgtggttctgttgtttttgtctgtgtcatcacttgtcgtgtttctcccttcattatttctttcccctcttgtttggtgtggggccgttgtttttttttcacccttggtggtgtgttttcgcaccttgttgttgtttgtggggttgttctctcttgcaggctctccccttcctgcgctctctatgtagcgcgcctccttcttcattgtttttgtgggggatgttatctcctctttctttgttttgtgtctcctccctctcctcgcaagtgttttttgtttttttttccccacgcaggttgtgttttgtttgtgcgcgcactctctttttgcccgcactcgtcgcgctcgtctctttgtgtcgctctcttctctcgctccccccccctcttcttttatgtagggagagcgccgctctgttgtgcgcgcgcgctctcactctctgcgctcacatcactccccgcccttctatattattctccctctctcagaaatattctccaccctctctctctcatacacacaacacacacctctctctctatatatatctctctctcctctcacagcgagagatgtgtctcacattcatcatcacaccctcgcgagcgtctctccagcatctcttattttattatatatatagagagacacacacacaccactcacaccactctcacactatatcatatatataacacacacacatcgctgtgtctcttactacacacatctctctactctctgctgtgtgtctctatatatttatactacacacctctctcacaacacacacactctctcacagcagagtgtgtcttgtggagtgttcgctctctctcttaccccgtctctcttctcgcagcgcgcgtacttttgtgtcgcgggcgcacacacactcttttgtgtggtcgcaccacacgcgtgttgtctcccgcgcgtgtcttctctctcgctctctcttttgttgtggcgacactctttctctcccctcacatattgtttttacacccctccccccatcatataatttctctctttatacacacacccacacacacaccacaccttgtggtttaaacacccccccccgaagatatactgacacacactttttaaaatatgtggtgtttaaatattttttttttttctctcctttttggtgatggggggggtttatata

SEQ ID NO: 484470 - DNA, 1245 bp, Homo sapiens
ggtgcaaatggtactgctattcactatgacccggagaaccccacgaaatcatgcaaatcaagaggttccaatcttcgtgtacactatataagaacactcgtgaacctgcacaggccatacaagggtatgcatcatacgaaaagccacgacgtctctgaacagatgtcacttatcacagcacaacagtagtgtacccattccgacgtatccacatggatggcagttaggccaggtgtgcgcaggccaaagcaatggcggcctaggcacaacacagggtcggctggaccaacaaaacagagtagctaggacattacaaagcgtgccaaacatgcatataaaccaacgccagcagagtcaatagctgcaacattccagcggtctcaacatgtagcatacatcatggtcaaacggaggcaataatccaacagtgaaacaaaaggacaacataaaagaatgcggccggccgggcacacaaaccagcgactcgatggatcagggatacaaacccaacacaatgaagcatcaaccccagacaacagtagcaacatgaatcctgaacgggcaacacagggaaaacaagacaacgaaacactaaaacgaccagacacagcaggaaggggtaggcccagaacagaaagaagcaagagcagccagaacaggagagaggcacaccacacagaagaacacgcacgggccacgcgcaaacatacaacgccagacaaaacacaaacaacagtggataactaacaagaaagggacgagaccaaaaatacaaaacacgaaacaaacaagcgaaggagcacaataaaacaacaagccccacccaaaacaaaaaacagaaaaaggaaacagaggacaaaaacaaaagacggcaaacaagaataaaaagaacaaaagcaacaaacacgaacggggaaaaagcaacaaaggaacgccacaaaagaagaaatagcgcaggataaccgcaaaaaagaaaacacccaagaggaggacaacaagaagcagagaaggagaagaggaccacaaaaaagcaagagaccagacgagaaggaggaggccgcaggaccggaagaagaaacgaggcacgcaaggaggaagagagcagaaaggagaaacgcacgaggagcagagggcgacagaaaaaagcagaggcgaagagaagggcacaagagggcaacgcgagggaacggagccacgacagcgacgggacggcgagacacagccggaagggggacagaaggacga

SEQ ID NO: 484471 - DNA, 202 bp, Homo sapiens
ttagacctctctgagtgtggacgtcttcataagcacccagtgaactcatgatccccatatgacagataaaggaaacgaggctgtgacagagtgagggggcgaggtcacacaaagtcacaccaccagggaacatgagcacagcctccataggtgtacagcagctcagagagatgctgagctgcccgagcagcagggaaagaca

SEQ ID NO: 484472 - DNA, 610 bp, Homo sapiens
acgagtgcagtatggagccccctcttagagtgcgtcatcgcaggccacgagagcggagagctcaaccagtatagcgccaagtctggagaggtgttggtgatcgtaaaggaacactctcggcagatcaatgacatccagttgtatagagacatgaccatgtttgtcgctgcatctaaggacaacacagctaagctcttcgactccacgactcttgaacatcagaagactttccgaacagagcgtcctgtcaactcggctgctctctctcccaactatgaccatgtggtgctgggaggaggtcaggaagccatggatgtgaccacaacctccaccaggattggcaagtttgaggccaggttcttccatttggcttttgaggaagagtttggaagagtcaagggccactttggaccgatcaacagcgttgccttccatcctgatggcaagagctacagcagcggtggtgaagatggttacgtccgcatccactacttcgacccacagtactttgagttcgagtttgaggcctaagttctgggtctccatccacaacagagaagctgctcacagaaggttttagactcagaaataaattagtttgttaaaaata

SEQ ID NO: 484473 - DNA, 251 bp, Homo sapiens
aaaaaaatgccttttttttttttaaaactgtgggccgggggaaaaagaggggaaaaggcccgtttggccccttttgtctttttttcccttttcccccaaaatggggtttttgccccttgtaaacccccccccgggcttaaacaacaaaaaaaacccggaaagggtccattgcctttccccgccccccccccccagggttttccacattccaacccccccccccccccgggggaaaaaaaggggttttggga

SEQ ID NO: 484474 - DNA, 162 bp, Homo sapiens
cgcatacacgtttattctcccatacacacacacacgtacattccattcacatctacacacacatcacacacatttgactgtagcattcatgtcacacacactcacatgcagtcacgcatccacacacacactcatccacactgttacacacacacaatccgg

SEQ ID NO: 484475 - DNA, 794 bp, Homo sapiens
ggcgcctctcgcgccgattcgcttggtgatgcctccctactttgcctagaaggattaatactatcgatgtcatagtagctattctcagtaagcctcaagaccatttctctctgagcttatatggtgcgtgaatggcgagtacgtagtctgtgtggctctgcctgcagagaggcagaggggtggggtctatggcaatagataggtcgacaagagtcgtccgaaatatgtttgggtataagacataggggacgattagcctagtacactaattgtaaataggtaaagattaagttcgtgttccatcaaagttatctttcggttagacaattgagggtgatttttccaattgatagtcgtcattagtttgtgcgtcaaacagcaagccagctccataggcctaaatttactcacgtggtctagtcccttcgaccttattttgatttactcctatagttcatacagcgatccccttactataggcttgttgcccaataactattattccgtcggagccctcattaaaaaaacgccacttcctaaattacgtaccacgtaattgtgtgtattctttaactaccttgaaaaaattcaatttggggacattcataaattgcgaattttgaattccagggtggaaccttattattcaacgggaagggaaaacaaacgggttaattttagggaagccatcatttgttgctgctagcaagcctggaggctcttctggataatgttttaaaaagattcacagtcaggtataggcacgaagatgaaggcattttaggatagccagt

SEQ ID NO: 484476 - DNA, 555 bp, Homo sapiens
  misc_feature (89)..(89): n is a, c, g, or t
agtctataaggtagcatatgataccggtgaggaaaggatggacttgttaatacaagtggttaaacgttaaccacttggagaaagacganaatgaatctgcacttcataccatacactaagacaaattccaaatgggtcaaaagtactaggaaaaagtgaattccttcatcaccggggagtgggcaaaatcttcttaaatatgacttaaaacccaggagtgataaaagacaaaatgtatactgggaaaaaagttttataacatagcacattttcaaagtgtcggtgacttgagtgggaagcagggcagtgactgtcggggactgagggtggggggatggtgttgaacgggcgcggggtctccttctggcgtgatgaaggctttggaagcacacagaagtgatggttgtacgttatgaatgtattaaatgctgctaaattgtagactttaagagatggttaaaatggtgaatttttttaaccatctataggactctgataaaaatgttgttttatgtatattttacctcaataaaaattataacttaaaatgaaaaa

SEQ ID NO: 484477 - DNA, 177 bp, Homo sapiens
tcaatatcaagctttcttccacgaaatccgatgtcgacgcaacttatgcagttagcaacatattctcatccagggttcactctagagaagggaaatccagcccccctcgtggtgctcagctttttctgggtacagcgaaggacacacacctgactgatacaattgtcatggcgaacc

SEQ ID NO: 484478 - DNA, 730 bp, Homo sapiens
ggggggcccaagtccttctgatcgagaccatcctggccaacatggtaaaactactaaaatacaaaaaattagctgggcatggtggtgcgcacctgtaattccagctactcaggaggctgaggcaggggaatcgcttgaacccgggaggtggagattgcagtgagctgagatggcaccactgcactccagcctggtgacagagcaagacaacgtctcaaaaaaaaaaaaaacaagggtggtgcccctttctttacgtgtgttaaatagccttttcaaatttctgtgaagagtgcctcctctttctctccaagagcctttacttcaaggctaaattacctcacatgttgggtggctctccaaaaccttctttcccggggttaccctgtggtgtcaatggcgcttctataaaggtgaacgtccttgaaacccgggacacactttttgtttggaccaattagaccctttacgattgtgtgaggcatatatctacatgtgctcggaattatttcccaatttaaacccttatttagccaaccctttcgctgtgtagcttaataccccttcttctttacacaacttagcggaacctgaagccaagaagaggaggggggtaacctatttttacccggggttttctcaagttatgggtctgacccaagtaaggtcacagtaagaatggtcactctctagaaagcccaggtgtcttgtcgttaaatttgcaatttaccta

SEQ ID NO: 484479 - DNA, 327 bp, Homo sapiens
atgaagtgtgagatgtttctaaaatctctacatgggccgaccacaacctgctatcttctgctactgtgtgccatgctagagctccccctaccctgagggtggggggatggtgttgaacgggcgcggggtctccttctggcgtgatgaaggctttggaagcacacagaagtgatggttgtacgttatgaatgtattaaatgctgctaaattgtagactttaagagatggttaaaatggtgaatttttttaaccatctataggactctgataaaaatgttgttttatgtatattttacctcaataaaaattataacttaaaatgaaaaa

SEQ ID NO: 484480 - DNA, 574 bp, Homo sapiens
  misc_feature (573)..(573): n is a, c, g, or t
caccactgagtcaacgtgggctgctatccctcgagcatgcgagtcggggcaacaaatgccaatcaataaatgtgattcatcacataaacagaactaaaaacaaaaaccacatgatcatctgaatagatgcagaaaaacctttcgataaaattcaacatcctttcaagttaaataccctcaacaaattaggcactgaagaaacatacctcaaagtaataagaaccatctatgacaaacccacagccaacatcatactgaatgggcaaaagtgggaagcattcccttagagaaccagaacaagacgaggatgctgaccctcaccagtcctatttatcatattactggtagtcacagccaaagcaatcaaacaagagaaagaaataaaggcatccaaatagaaaacgaggaagtcaaactatttgtttgcagatgatatgattctatacctagaaaatgccatagtctctactcaaagctcctaaatttgataagcaattcaaaaaaggttcaggattacagatggacatacaaaattcagtagcatacctaataaacattaatgtccaagctgang

SEQ ID NO: 484481 - DNA, 793 bp, Homo sapiens
  misc_feature (734)..(734): n is a, c, g, or t
ctcgcgccgttcgtttctcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcatggggcattctcttctcccaccctcgggactttaccccagtgtgcaccacagagcttggcagagctgcaaagctggcaccagaatttgccaagaggaatgtcacagtggatgtgccctttcaatagacagtgttgaggaccatcttgcctggagcaaggatatcaatgcttacaattgtgaagagcccacagaaaagttaccttttcccatcatcgatgataggaatcgggagcttgccatcctgtgtgggcatgctggatccagcagagaaggatgaacaagggcatgccttgtgacagctcgtgtggtgtcgtttggtcctgataagaagctgaagctgtctatcctctacccagttaccactggcaggaactttgatgagattctcagggtagtcatctctctccagtgacagcagaacaaagggttgcaccccagttgatttgcaggatggggatagtgtgatggtccttccaaccatccctgaagaagaagcaaaaaacattttcccgaaaggagtcttcaccaaagagntcccatctggcaagaaatactccgtaaacaaccaagctttagtcttggagaattgggcg

SEQ ID NO: 484482 - DNA, 932 bp, Homo sapiens
gctgtgactttgtctgacgttctaacacctcgaaatgtgcctccagcgatatcgtgcgtgtggtggatgagcagctgggggaggagtcagaagaaaggggtgaccatttattaccaagtgtggattgcagctttagtatgtccagcgtcttcctcagtcccccaaaccaaagctagacgagccagatttctcaagcagtctcaactccagtccctcagtctcgacccttactattgctcttgctttccagttggcttttgatgtgcatcttctcactagtaaaactgccttccctttgtttccttattgtctggtttcttctctagagaggtacagtgtgtaagtcagcagttaatgatacatagggcctgtgaagggacagaggcttatgcaatgtctcttgagactcagccagttacaagtaggcatatgggcacaactggtgtagcaggctcagtggccgttggtcatttaagcacattttcacaagtttgggagacggctggcatttctttagattaaaacaatgaaatgccaagagaaggatgatttagtacagggctggatggcttccatgttgtatccggtaccctatagtagcctccatgaaaatctggtatatcttgctgcttgggactacctttgcagtgattgcttgcgttgccagtcccacgtactctccgttgtaggtctgagcctggagaatgttctagaattgcttttcccacctctgagattaggtccgggagcatgtgaattccccatttacgggttttcggtccccccccctctttgtggcgctgggggcccgttagctggatgcgccacagaaggggtgtctgccgctagcaaggctccaaacccggggggaggtcctgtcgcaggtccagggccctcggggggcgggttcactgaggagttccgcacatatt

SEQ ID NO: 484483 - DNA, 332 bp, Homo sapiens
atcgagctcggtccccctggcacatggtgagactctgccttaaataacaacaaaaattatccaggcattacggtgcacacctgtatgtcctagtcttctcgggaggctgagataggaggatcgcttgagcccaggagttcaaggtctgcagtgaactataatcacaccactgccactccagcctgggcaacagagtgagaccctgtctctaaataataataatagccattctaactggggtagaatgatatctcattgtggttttgatattcatttccctgatggttagtgatatcaaccgttttttcatagacctgttggcccttatcgag

SEQ ID NO: 484484 - DNA, 478 bp, Homo sapiens
tccacatgtaagtgagaacatatgttatttgtctttctggtccttacttatttcacttagcataatgttctaaaattccatccaatttttcacaaatgtcagaatctcttttgtttttaaggctgaatagtattctattgtgtatatataccacattttctttattcatctgttaaacgcttaggttgatttcataacttagctattgtgaataatgctgcaatgaacatgagactacagacatcccttcaacaaactgatttcagatgtttggggtaaatacccagaagtgggattgctggatcatatggcaattatatttgtagtttttttgaggaaccactatactgttttccataatggctgtaccaatttacattcctaccaatggtgtgcaagggttcccttttctccacatccttggtaacacttatctttcatcttcttgataaaagatattcagacaaatgagaaatga

SEQ ID NO: 484485 - DNA, 351 bp, Homo sapiens
gttccgggttttttttattgggttttgaaaactttgtccctccacccctgggggggttttgccggggggggggggggaaatgtccccgcatccgggcctgttttcccaaatggggcccccccccggtcccccccccggccggggtttcttcttaaccctttccccccaggggccggggggggggtttcttcccccccggggggggccccaagttcctccagagccccggctttccccgccccctttccgcccttgttttttttgcccccccccccgcccaaattcatttttgttttcccagggggccccctttccccctcctgttgaaaaaaaaagcggggggttgtccta

SEQ ID NO: 484486 - DNA, 1145 bp, Homo sapiens
  misc_feature (252)..(252): n is a, c, g, or t
  misc_feature (377)..(377): n is a, c, g, or t
tacggataccggtttttttacccaaggcaaattttaaaacccccccgggacttcgggtaaaaggaggagggcgcgaaaaaccgaccgtgcagaacctgcaagaggggagccgtgatccggggcccacgtgggttccccaccagaacaagcagcgtacataagaagaaggaaacggtggcccctcacaggcgagggtgtgcctgtgccacacaagcagctcagacagagggggtaaccaagaagtttcccagncgcagaaaacacaggtggggggacaggggagaggcccaaaaacaaacagagcagcgtgaaaaatatacacagagaaaagaggccgagggtgtggtgtaggaacagctaaatgcacgacgccactncacgtgtgtgtggcggccacaaaattatcgcagggttgcaccgagttagagagtgccgaaagaggactcttctccacaaacgaggcgggggagaaatcatgtggatcacacaacaaggaaataagaggcgcgattgaaagagaaacacgcgcatttgtgagagaatatcacacaagtgtgcgtggggaaccaacgttggcatatcaacagcctggcgaaaaaaaacacacagacgcggtgggagccccgcgactcctccacaggggagagagaaaacggcgtgcaaggagaaaagactccacagagggggtctaccagagagaacccccccagggagaaaaatgcacagacgccccgatgagtctcccctacaccagggagggtgagccccaaacatatggggggcgcagaggccacccggggagaaaacaaaccttcaaagaaaaagggctacagtggggagtatcaggagaagcggggacatggggagatggggcccccgaggagccaatagaccaagagaacaaaagagcacaatagcccgccccacaaaagcgctaacgggaagacgagttcgacaaacaatctatcgccaagctggaaccatgtatcagacacaagcgagggggtcaaccaaaagaaaaacgtatgcaaagagcgagtagacaaagagcccacacaaagtgtgagtagcgacagagagagccagatgggtgtagtaggtacagccccccaggaaggggccccggagaaacaccaaatagagaa

SEQ ID NO: 484487 - DNA, 115 bp, Homo sapiens
gcatagcaatatgtcagcggcagacgggtgagtaacgcgtgggaacgtaccttttggttcggaacaacacagggaaacctgtgctaataccggataagcccttacggggaaagat

SEQ ID NO: 484488 - DNA, 226 bp, Homo sapiens
ccccatggagacctaacccagtagactaactattgattcttctctcttttcttctttattagtctggccagtggtctattttgttaatcttttaaaaaaaaaaccagctccgggattcattgatttttttttttttttggggaggggtttttcttgtccttcagtttcggctcggatcttagtttttctgtgttctctcggcatagctttggaaatgtggtgggct

SEQ ID NO: 484489 - DNA, 943 bp, Homo sapiens
taatagtcctagagttggcagctggtaaaaccagaggctacatccagtatactgctagagacattcttcatccaccattgttggtctgtatgaaaatggtgtactgtatacttataacatgccccatatttgtgtatgggagagtacaataattgtaaatcctaaaagcaccacttatttttaggtataataaaagaaagtccaagagagttcctaatattagatatccagataaattcgtttcttgtgataattgtgtaggcttatgggtaattttttttacgaaaattcaaggttccatttatttattgggtaccaaaaataaagggcttgggattaaccacagactatatacttttttaactttttacaaaaacctggtggagaccggcttgactctgggtctttaaaacatgatagtcctttaaagtataagggtcttagattaaaagaccgttgccctaatatctgttgggcaaggaccatggtccagaccttctcacaaatctccttatttatatgtttccttttttttgtttacatatgcggaacccatgttactaggtcgtgttggtcccgtggggggttcctaccccacgacagctgttctcttttttcccacaccaattttttcaatggtcttcaccactttttggtcatccattcccaggtccgcgacggtagaaactccaggtggaaagcctgggtgggccaggcctcaggttttgggccaaccccaaacaccaggttgaacaatggccggaaggagtgcccaacgtaccctcggccgaacatcagggggcgcgcaccgggcgtcaagggcgacacccacaacagcattgggcgagacacggggcaaagtggtcacaccgggggtcacaaggggaagagtggttcacgaccatagacactccagtgcggacaacaacagagcatcagcacg

SEQ ID NO: 484490 - DNA, 269 bp, Homo sapiens
gtcgacccttgcctgaagcaatcctctttcgttgggggagggggtggggggaacggagtcttgctctgtcgtccaggctggagtgcagtggcgtgacctcagctcactgcaagctgtgcctcctgggttcatgccattctcctgcctcagcctcccaagtagctgggactacaggcgctcacaaccttgcccggctaattttttgtatttttagtggagacggggtttcactgtgttagctaggatggtctcaatctcctgacctcatg

SEQ ID NO: 484491 - DNA, 144 bp, Homo sapiens
gttcaagctcaacacccactacctaaaaaatcccaaacatataactgaacttctcacaacccaattgggacccaatctatcaaccctatagaggactaatgtttagtataagtaccatgaaaccattctcctccgcataagctt

SEQ ID NO: 484492 - DNA, 355 bp, Homo sapiens
acagcacaatcacatgtacatcatgggcatccctacccaaggcatcctggccatatccaccagagtgaaacgaccgataggtaggatcatcctgacgatatccaaggggtatctccctgggcaccaatatcacagtccaagatcagcagtctcattccaagccattggctctgttctgaagagagcgctggtcagcctcaactcaaagccgtcccttgtcatcttgtggctagacctcagacattcggaacaaaacagcagctgcatactgtcgccacaccttcattcctagagtgacgtacctctgtcagaggagctagtggctccctcagcttcaatagcttcagcatgggga

SEQ ID NO: 484493 - DNA, 286 bp, Homo sapiens
ccttgtaaccttttccccccagagcaagatttgtgctaatgtacggcatatatatgtgctctccttagtagtcacagaattctctcacactagataacatggatagttctcagcgtccgctggcctttctgcaaagaccgtcgtgcctttggaaagcctcaggttccctgttttgcctcaatgctaactaaaaagctgcatttctttccaaaatctaattaattaatagaggctatctaattttacactctgtattgaaaatggctttctcagccaggcgtggtta

SEQ ID NO: 484494 - DNA, 167 bp, Homo sapiens
aaagtcaatcttaacaatttttgcaataccttatataagcagaccattggatttatgaaactgcactctcggtgtaatttatgggatgcacatgataggttccatgaaccgtttcaagtagtaaactcctagaccctttattaaaatggacctaagtaagtgagaaa

SEQ ID NO: 484495 - DNA, 516 bp, Homo sapiens
  misc_feature (6)..(6): n is a, c, g, or t
  misc_feature (79)..(79): n is a, c, g, or t
  misc_feature (82)..(82): n is a, c, g, or t
  misc_feature (88)..(88): n is a, c, g, or t
  misc_feature (91)..(91): n is a, c, g, or t
  misc_feature (131)..(131): n is a, c, g, or t
  misc_feature (135)..(135): n is a, c, g, or t
  misc_feature (138)..(138): n is a, c, g, or t
  misc_feature (142)..(142): n is a, c, g, or t
  misc_feature (155)..(155): n is a, c, g, or t
  misc_feature (192)..(192): n is a, c, g, or t
  misc_feature (194)..(194): n is a, c, g, or t
  misc_feature (198)..(198): n is a, c, g, or t
  misc_feature (205)..(205): n is a, c, g, or t
  misc_feature (209)..(209): n is a, c, g, or t
  misc_feature (313)..(313): n is a, c, g, or t
  misc_feature (318)..(318): n is a, c, g, or t
  misc_feature (321)..(321): n is a, c, g, or t
  misc_feature (350)..(350): n is a, c, g, or t
  misc_feature (384)..(384): n is a, c, g, or t
  misc_feature (418)..(418): n is a, c, g, or t
  misc_feature (428)..(428): n is a, c, g, or t
  misc_feature (430)..(430): n is a, c, g, or t
  misc_feature (455)..(455): n is a, c, g, or t
gtgggntccggcagggtgggggtggggggaaacccctcaaaaggggggaatttgaggggggtgggggggacccgggggntantgttgnggngcctgggtgagcgcagttgggctggaaggagaagccctcnttgntgntgtncaggacagacggngccacgtatgtgaagcccaggaaggcctggttggcantntcgntgagggntgtntcatcaggactgtccaccggcgtctgccgtgtgaagcgggtatcaaactggctcacgtcctcctctgactgcagacagggcctaaaaagggggtccccccgccnggccnganggtcgtcccaattcatgtgccggaaaaanggatgtctctgcacatcagcagcatcccctgggncacccccaatccgctggctgggattccgtttcanaaactttttnanaaggtcccgggcatctggggtgaanaaagggggcagtgccagcttgcccctgatgatcttatccatggttttcttccggttctctg

SEQ ID NO: 484496 - DNA, 224 bp, Homo sapiens
ttaaatttagggggcccccctgggaaacccccgtagttttacccagccaaaaaaatttccttccccccgaaaaacggggggggggggaaattcccccctcccaaaccccccaaaaattttcccagggcccccctttcaaaaattaaaccccgggaacccaaaaattcggggggggttcccggttttggggaaaaaaaaaaccgccaaaaaaaggttttttttta

SEQ ID NO: 484497 - DNA, 442 bp, Homo sapiens
  misc_feature (189)..(189): n is a, c, g, or t
cgacgctagaggaccccttcgattggcgggcacttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagtanaaataattaattgggactaaaaactaacagaacttcattcccagaatttttttactttttggggcaaatgttacacttccaattaagggggaaaaggtagacccagccaaattgagtgccagtggcgggagaaaacctgctcacattaattctccatctgggggtaatacacgggcaagtcatttccaaatcctctggagatacagagcatcagaatgacctctatgattccttgtttaattggcccgcaaac

SEQ ID NO: 484498 - DNA, 95 bp, Homo sapiens
gacagggtttcaccatgttggtcagggtggtgtcaaactcctgacctcgtgatctgccaatgataccggccaaataaaaacctcttcctttttta

SEQ ID NO: 484499 - DNA, 600 bp, Homo sapiens
  misc_feature (1)..(1): n is a, c, g, or t
  misc_feature (122)..(122): n is a, c, g, or t
  misc_feature (140)..(140): n is a, c, g, or t
  misc_feature (144)..(144): n is a, c, g, or t
  misc_feature (149)..(150): n is a, c, g, or t
  misc_feature (155)..(155): n is a, c, g, or t
  misc_feature (169)..(169): n is a, c, g, or t
  misc_feature (173)..(173): n is a, c, g, or t
  misc_feature (193)..(193): n is a, c, g, or t
  misc_feature (233)..(233): n is a, c, g, or t
  misc_feature (356)..(356): n is a, c, g, or t
  misc_feature (416)..(416): n is a, c, g, or t
  misc_feature (423)..(423): n is a, c, g, or t
  misc_feature (535)..(535): n is a, c, g, or t
  misc_feature (567)..(567): n is a, c, g, or t
ngaaagactgttatttgcaaacttgactcttcaattgaattacccaattagtacaggccactgatttgactgacacagtcgataacatgcagcctatccagaaggtgtctgttgggaaagtntaggataaaactttttcnttanttcannccttncctggccaagtccnaaangaattggtgtttgaattccnttaagaagaaagaaaatacttcaatttggtgctcctgatncactgaaagtaataacctcagcactttaatagccgtccacaggcataactgatgctaggccccagattggtgttgcccaggctctttaccatcatcttccggactgtttttgtttcctggttncattttcagtctggcccgctctacataatggggccagtgtcagctccaagtccacatccntactatncatgattcaaaagggaagagagagaacttcctttttcagggtccacaaatcaaatctataaaaggactctggtcttcccaggatcacctgcccttgcattggaccagtcccngtgggaagaggggatgggggcctgtgatcttngggcaggcctgggctatctatctgcaatgtcat

SEQ ID NO: 484500 - DNA, 214 bp, Homo sapiens
  misc_feature (5)..(5): n is a, c, g, or t
taaanctgggaggcagaggttgctatgagaccaagatcatgccattacactccagcctgggggacaaaggaagactacttctcaaaaaaagaaaaaaaaaaaagtaaacttcaaaaaacatacatatatttgggaaacactcttgctctgttgcccagggttgaagtgcaatggcagaatcagtggttcacttcagtcttgaagctccttgaag

SEQ ID NO: 484501 - DNA, 737 bp, Homo sapiens
taaggtttgagggggaatgctggagattgtaatgggtatggagacttgtcatataagtaatgctaggtgtgagtggtaggaatgtttttcacataggaggtgtatagagtgtggccgtagctggaatcgggggtatgctgttcgaattcataagaacagtggatggttacgaagtagggtctgggtgacaaaatatgttgtgtaagagttcaggggagagtgcgctcatatgttgtccctaggaagatttgtagtggtgagggttgtatattataataatggtttgggtgtatacacggctatagaaagaatatggtgccgaatgtgtggcctgcggacgatattcgattgttgaacgccttgaggactatttctggattcccccttcggcaatggtcagacaggtgggtatcggtttggctctctgctagttgtgggagactcaactccataattagtggccaaaggtgtcactagaatgcgcaaggagtacatcacgcacgcgtgtcaccttagcagaacggtcgcacacacgggcgtggacgaaacgggcttacaaagtgatgccccccacttacttaacatctattgtctgacacgtctcccaactgactggtgcctacgggctgacttcacatatatgcgcaattgtttcggggccacactgccccgcattgtgcccgaaccaggggccgtaacttgcagtttgtatgcctcaccccttatatcccgggcgt

SEQ ID NO: 484502 - DNA, 818 bp, Homo sapiens
gggaagcccaaccaggggggcgccccaccaccagggggcccgcacagcaaaaaagacattggggcggcgcaagactgggaaagagtcgcacatgtaaaccgatggatttcgcccgaagaacgcctatggtagagaccaaaggtggagggagtcgcaaaaagaaggccctaagcaaaaatgtttgcgcccctgctccccgaaggcatctcaaggacaccagcgcgaggttctatgtgtgccacgccgaagcggcacagtaaatagaaggccaaagacacatgttggctcgaacagaggcggcaagaccaacaccccgcgtctcattagtgtctttgaacaataaggggaaaagcactggagtccacaactgtggcgagctctcccttcatccagtgcccaaacccactccgcagtggatgtgcgcgtctcggttcgaaaacaccgcacgctgcccctattcgagagagagaccctgttggcacagagcaaaagatgtagcgcttctctgaagatcttcccgttctactcacagcatggaatacactctctctccttccctctagaaggatattcactcgtctatctccctttggtacaaagattctcgcctttctatccaatcatttacaggcacccctcgccttggaaccaggctttcctaatattgattgattatatacataaaaagaatctagtctgttcttataccagtcccatcgagcataataaagtaggaaaaataacaacccttcgaggaacagatacttattgcactaaaaaaaattcaaacaaaaccctcttcctgtgccccatatcca

SEQ ID NO: 484503 - DNA, 137 bp, Homo sapiens
tctttttgatgggggggtttttttgtgactgagccagtaaactcccactaaaagcttttttgggtttggccgttccttcccccccccccccagttttttcaaatttttttacctttttttaattaaactgttttgga

SEQ ID NO: 484504 - DNA, 1301 bp, Homo sapiens
  misc_feature (34)..(34): n is a, c, g, or t
  misc_feature (128)..(128): n is a, c, g, or t
  misc_feature (148)..(148): n is a, c, g, or t
  misc_feature (166)..(166): n is a, c, g, or t
  misc_feature (181)..(181): n is a, c, g, or t
  misc_feature (293)..(293): n is a, c, g, or t
  misc_feature (301)..(301): n is a, c, g, or t
  misc_feature (807)..(807): n is a, c, g, or t
  misc_feature (839)..(839): n is a, c, g, or t
  misc_feature (843)..(844): n is a, c, g, or t
ggcgtggcgtcagcgcaagatggcggctcggcancggtgttctcgcgcttgcgaagcgggctccggctcggctcgcggggactgtgcacgaggttggcgacgccgtcccgcctcgggccccagatcanggccgtcagagatcgggcangccgcgggagcactaagngcgcaagggccacangtcagcagccgggctcagagggtcccagctatgccaataataagttgcgctctggcttgctgggctgcttggacgctggtgggactgtgacgcgtcggtctatactctttgngaaacaancccggtggacgaacacatggtgccaagcattcctgatgagttcgacaatgactccaattctggtacagcagttgcgccggacatacaaatatttcaaagattatagacagatgatcatcgagcccaccagacccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgctattccgggacgccacaagatacatggatggacaccatgtaaacggatatttcatgtctgaatcgggacccagctcgagtagtagttgtggactgcagaaggaagccttccgctgnaccctataacgggttgccctgcggccctgggncggnnactctgatgaccggtcttgtggatctgtctgccttcctcaagaccattgcactgaatggtgtggaggacgtgcgaaccgtgctggagcactatgccctggaggatgacccgcgtggcggtttacaaacagcggaaagccgggtagagcaggaggagcagcagtgcctggcgaggctctccaagtccaaaaagccagaacactctttccttggctccctcaaccatgcgcttgttggcctcgctccaaaacagcctgaaactctgggctcctcaaaactcagtgacttgggtccagggccccagttgcttccaagacaagactttgggccacaacttgtccaataaagtacatcccagacgccacacctgttgtgttcccgagagtctccaacgatggggggcatcaggttgacggtcccggggacttcttggggtcacatcgtcccaccagtggtcg

SEQ ID NO: 484505 - DNA, 693 bp, Homo sapiens
  misc_feature (34)..(34): n is a, c, g, or t
  misc_feature (199)..(199): n is a, c, g, or t
  misc_feature (231)..(231): n is a, c, g, or t
  misc_feature (235)..(236): n is a, c, g, or t
ggcgtggcgtcagcgcaagatggcggctcggcancggtgttctcgcgcttgcgaagcgggctccggctcggctcgcggggactgtgcacgaggttggcgacgccgtcccgcctcgggccccagatcaggatatttcatgtctgaatcgggacccagctcgagtagtagttgtggactgcagaaggaagccttccgctgnaccctataacgggttgccctgcggccctgggncggnnactctgatgaccggtcttgtggatctgtctgccttcctcaagaccattgcactgaatggtgtggaggacgtgcgaaccgtgctggagcactatgccctggaggatgacccgcgtggcggtttacaaacagcggaaagccgggtagagcaggaggagcagcagtgcctggcgaggctctccaagtccaaaaagccagaacactctttccttggctccctcaaccatgcgcttgttggcctcgctccaaaacagcctgaaactctgggctcctcaaaactcagtgacttgggtccagggccccagttgcttccaagacaagactttgggccacaacttgtccaataaagtacatcccagacgccacacctgttgtgttcccgagagtctccaacgatggggggcatcaggttgacggtcccggggacttcttggggtcacatcgtcccaccagtggtcg

SEQ ID NO: 484506 - DNA, 624 bp, Homo sapiens
ccatcctcctgatccgagcttaacatctccctgtacaactttgctcccctacaaagggcacccgatatgcaaggcttcacactagtacttctctcgacaatacttcatcatgtgcacagaccgatcagttgcgtcagcgcctagagtatgatagtccttatcctcctttaggagctatgtgcggcttggtgtctcattcactacttcgcttccaggccgtcgcagtcatctcttctgcatttgaggtcatcacgtttctataacgcacatcttctcgcacgtcagctacaattgtcatggcaccctagtgttcgtacgcagtgcttggtcagaaggtcctactgcagtacagactaatgatccagccgttgaatcctcatgccaatacagtctatgctcacgactcttcaggttgtcttccaactggatcccatctgccccatccagttgactgatttctgtgcaatgtctgcttggagagggttcaggatcatagacactgccatagcagatggtgtaataagaatgtgctggagtctcgtcatccgtcagccctatggttctctgggtcctccagttcccagtagcgtatgtagtagcccctgtagagtccaaggatgcacg

SEQ ID NO: 484507 - DNA, 177 bp, Homo sapiens
ggtatacatcatatctgtgcaccagctatcaccaaccgcaagcctccacaaaaaaaatgcaaagaagagagagtgatattgtagggagaatcctcaacctgtaacattttaacaaacaaagcccagctgggctgatgtggtgcgtgcttgtagtcccagctacttggtgcgctcgtg

SEQ ID NO: 484508 - DNA, 272 bp, Homo sapiens
agggcaggattcacgaaagtacacctaagtaggccccgttacattatagttcaagcaaactgaggcccagagagcagctgcaacaccaagattggccagaatacagaagacctacgcgtctagcagatccaggcgctggaaaggtagctggtccccctatctggaccatagaccccgcccagcacgtaatgtgccaggcactgtgcttaacacttaataaacatggttctattgaatcttcataataatcctggaacaggaatattccttat

SEQ ID NO: 484509 - DNA, 297 bp, Homo sapiens
tgtagcacgaatgtcgtggatagcgtaagcgctcagactttccagccttttccaggacaaagccacggatatctcccgcatcgtccttaccccgacacacgaacacatccgcaaatcggactgttggtgatccacatcttcgcgccggtcaggctgtagccgccatccattttgcgtgcacggggtaaatcattcgcccccggaatcgcaaaccaatggttggggctcggtcaagccccaaaagcaaaccggattccatttcacccagagggcccacgttatgggccaaataccttc

SEQ ID NO: 484510 - DNA, 133 bp, Homo sapiens
gaaactgactggattactccggtctgaactcagatcacgtaggacttaatcgttgaacaaacgcaactttaatagcgggtgcaccatcggggatgttccttggagttcccaacatcgaggtcgtaaaacctat

SEQ ID NO: 484511 - DNA, 411 bp, Homo sapiens
attccattctgtcttattgcatggagttctctgagaacaaaacatagcaaaaggacaagggtcctatgtaaagagggcatttctggtggaaaaattccttgacctccttagctcttgcgttgaactctatcaacaaagagctatgttttgagccttgattacaaattttaaaactggtaaataacaaatacatcttgcctctgattgcttcctcctctgactacattgagatatctttattagacccttaatattttcattatcttcttatcttagactctaatcactttactctcatttcagtgtctgcaagttcttttcccattagtcttctctgtaccaacccagcaagaactctggacccgggatgaatgttacctggacttttactggccatcaagcatttttggg

SEQ ID NO: 484512 - DNA, 972 bp, Homo sapiens
ggcggaagtgcctcgctgcagcttcccggagccggagcgcagcgcctgggccgcccgtgccccgccgtcctccttcccgcgcccgtgagggacaccgggctcgccgtaagcggaagctgccgaggtggcaggccccagcccggaacccaagacaatggcaccccttcaagggaggccttcatctagcagggcagaacacctttggcacaatgtaacccagaaagttacagaattgtctggaaggggcgcccagttgtggggagacgctccggtcccatgggaaggccttccgcttggttgtaccagtatttttccacaaggatgttgcgcccagatttatcagtcccgtggggctaagaaccaaaggtcccaccacccctaaccacgggttgtgtccaaatgtgtgtccgatggaccaccttgcggctctgaagctttggtcctaaccaattgatgcgagttaaaccgttgctgccaagggtggacaccttttgtggaccctaattggccttggggggaattctacccattctaaaatcttttatcataagcttttttcttttcccccaagaggtgggtctccttccctataagtgtgaagactccagggattgacgggtccttcgtaaacccacccaaaaaagaaggaggaaattcccgccccttattaattcggaaggggcccccggatgttataatttgtggcactgccggctccaacggccattccttgggacaaatgggacgtgtatttttcttccgaacactttacaacgccccggtgttctggccgatctgggatgtacatcacatcatgccctctgttcacgcatgaagggggatactccagccactgaatagtaccgggaactcccgtacccttggagagaagctacaggaggatatgcggaagcttccacaaaacggaaagaggcccctgtgaaacatttgcctttaaaacacttgtcaaac

SEQ ID NO: 484513 - DNA, 345 bp, Homo sapiens
cagagatagagagccacagcaaactctcatatagcgctccgacgttacggagcgactattctttgcccttcgtggcacacatgtaccgtataacgccatgttacctagcgcactctgacaactgacttcttacctaacactttgacacgctaactccaatgtgcaccacagaaggagacacctgcctcacttatgaaggcttggaccgccaacttatatcctttcgggcacccgctacggacaggcacgcctatacacaccgtaagtatctcccagaagacttttgtaacggccttgagcactgaggttttttgggttcgaccttccggctgtgagcacagaccc

SEQ ID NO: 484514 - DNA, 348 bp, Homo sapiens
gtgcaacaaggaggtgtgcttcgccgagagggtgacctctttgggcaaggacgggcatcggccttgcctgaagtcagagaaatgtgggaagacggtgacctttgggggccacgttgagcatgaaggcaaaccttgaagcatacacgcctgattcgcaaccatgcctggcccttcagcctccgtcagcgttggcagcgaagcattagcaggaagacctttcatcgcaggtttctactccaaaggccgcatcatgggacccgcaaccatatcatacccgaccgcgggaagcctagtcgcaggatttctcattgctaacaacatttcccccgcatcccccttccaagcaac

SEQ ID NO: 484515 - DNA, 157 bp, Homo sapiens
gtagggaagccgtggagcaggaagaggaggaggaaggggcgcatagtagcgctggtcagaggctggtgtgcagccagtggactaggcaggaagtctgggtggcaggtccagcagggaggggaccaggatctcttgctccaagtgccccttagaccca

SEQ ID NO: 484516 - DNA, 156 bp, Homo sapiens
tagaggaccaacctcaggcgcgagctgctaactcaggggcgagctgctaactcaggggcgagctgttaactcagggccgagctgctaactcaggggcgatctgccacagtattacaaaaataaaatgacagttagttatcagctcgcccctgatgt

SEQ ID NO: 484517 - DNA, 246 bp, Homo sapiens
ttacaccccatcgatcacccttttctaccatccagaggttacttttcttatatttttttcggaaacggagtctagccttgtcgcccaggctggggtagcaatgacttgatatcggctcactgcaacctccacctcccgggtcccgggtacaagcgattctcctgcctcagcatcccaagatagctcagattacaggacttgcaaccaccaggcccagcttcattttttttatcatttggatactct

SEQ ID NO: 484518 - DNA, 217 bp, Homo sapiens
tagtagagacggggtttcaccatgctagccaggatggtctcgatctcctgacctcacgatccgcctgccttggctcccaaagtgctgggattacaggcgtgcgaccgcgcccagccagcaatatactcttttcaaagatttaaatgtacctagtttgacattttattgtttgaataggtattacatttacatggttcaaatttagaaaatgtaaaag

SEQ ID NO: 484519 - DNA, 281 bp, Homo sapiens
gacgcgatctagcgagatctcgcactcaattatattcgaggagctgccgtgcgtggaccgatcctcaagccctgcaaggatatcttcctggtgcgggacactcggtagctgcagctggaggaggagttgtacgccaagctcatcttcttctaccgctcaccgaggaccatgatcaagtgcactcgtgagaaggagtaggagctgctgctgccggccagagagggaaggagccgtgctgctgggcgtcgtggccacaaaagaagagcactcgctggtgctct

SEQ ID NO: 484520 - DNA, 258 bp, Homo sapiens
  misc_feature (121)..(121): n is a, c, g, or t
  misc_feature (242)..(242): n is a, c, g, or t
ctcttcacaatatactctccggacaaggaaccataaccaatactaccaatcaatactcatcattaataatcataatgggctatatgcaattaaaatctaaggaattagcccctctttcacnttctggagtcccaggagtgtggcccaagggcaccccttcggacatccgggccggctttcttctcacattgacaataaacatagcccccattctcaattcacattaccaaattctctctctnactaaatggtgcggaa

SEQ ID NO: 484521 - DNA, 116 bp, Homo sapiens
ggcgcggggagagatttaatttacatagcagccacttggggtccagtcagagctggggcagagggggaatctcctccccagagggttctccccagacccccacccccgggagacct

SEQ ID NO: 484522 - DNA, 861 bp, Homo sapiens
ggaaggcgtcgctttaacatgttttgccgggcttgtggcggctcgtgccattctgctggctcgccaacattgtcgtcccgccgaagttttccgacccgttttggtgcccatgtccgcagaagtacgaggtggagcgcagcgcctgtaaaaccggcatggcggcctacctgcgctgctcatggtagcgcggcttgcctcttgttgctccggcgcctgggtactgcaccggccgttccaagaccctcagcgttccccgtgaagtactcaagcgccgcgggcgggcccacaggccaccggcgactacgacaagaaggaactacgtctgagggcgctgggcacggccgggcccctcctgccagccaacgcctgcgaggcgttggataagcctggggatccccgcatggaccgcggcttccgccgggtagagcgggcgagcaggctcctcggaacgtccgggcatctgcgccccgacggcggcatccaggaatccgctccagcctgcgcacgcagcatgaccttcgtcctgccaactagcccggcccatgccgcttaacagacggaatgaagtttccttttctgtgcgcggcgctgtttccataggcagagcgggtgtcagactgaggatttcgcttcccctccaagacgctgggggtcttggctgctgcctgacttcctagaggctccatgctagacttccggaggggcggatgcagagcccagggcccacaccggaagatgtgacacctggtctgtactcaatcggcagggcccgacgcccagggacaagtgacttggcctggacctccaggtctaactccagatctccccaggcaaggctataagcaccgagctgagagaggt

SEQ ID NO: 484523 - DNA, 136 bp, Homo sapiens
  misc_feature (118)..(118): n is a, c, g, or t
ggctgaggcggcgaccgggagcgggaacttcggggcgggggagtcgaggcatttgcgctgggcttcggagcgtagcaagggccctgaagccttttaaagcaaggaggaggggaagganaaaattggggcttcctct

SEQ ID NO: 484524 - DNA, 129 bp, Homo sapiens
  misc_feature (55)..(55): n is a, c, g, or t
  misc_feature (73)..(73): n is a, c, g, or t
  misc_feature (95)..(95): n is a, c, g, or t
ggttcacggaggtggggtaccctactctactctgtaagttttacccaggactcanatgttacccaatcctttncttagcactatggtcccctcanagttctcactggcctggctataaagccctccagt

SEQ ID NO: 484525 - DNA, 139 bp, Homo sapiens
tttcctttcttccagaaagggataaagaccactgctgtctaaggaaggagttccccctccccccaaagtgctgggattacaagcatgagccaccgcacgtagatgataccgggtttcttgatgggggagcccaaaagag

SEQ ID NO: 484526 - DNA, 342 bp, Homo sapiens
gcagcagccctctctttctctaacatatttatttatttatttatttagagacatggtcttgccatgacgctcaggctggtcttgaaagtctgccttaggcttggcgtggtcgcacgcctgtaatcccagcactttcggaggccgaggcgggtggatcacgaggtcaagagatcaagaccatcctggccaacatggtgaaaccccgtctctactaaatatacaaaaaattagccaggcgtggtggcgggagcctgtagtcctagctactcgggaggctgaggcaggagaatggcatgaacccgggaggcggagcttgcagtgagccgagatttgccactgcac

SEQ ID NO: 484527 - DNA, 108 bp, Homo sapiens
ctcctaatgtcactagagagaggcgctgcgagagaggtctaaaaacagatacaaacaccagacaaactgaaggaaaccctaaatgactgtgtgtaattgataaacatt

SEQ ID NO: 484528 - DNA, 489 bp, Homo sapiens
tcagctcaactcaacagggctttgttgccatgccaggcacccagcttcaattcacaagcaccacaaatttaacacagtgcaaacacattcattttgggcgtgtcacaaccactgcaacacaaaaaatcttgcaatctcatgcttgttttataaatgtgatcccatggtttgaagtagtgggttacatgctgtccacagaaatcagttgcatcaatgaattcaggatgatgtttggctacttgttttggcattggttgtttcattcaacatgtgttgccacgtccactcagccaaaacgacagcgacagtgtaagcctgaatctcttgcttttcatcatcattttaggatcaacactgtatgttgcaactttttatactcccacaaaggcatgtccccagagtgaggcaatgccttggtcaaacttgatagaagcaaactgtgtcctaaatctcaagataatcaatatcctgtgtgagtatgtaagaaga

SEQ ID NO: 484529 - DNA, 895 bp, Homo sapiens
gccctccagctctttcctccttccatggaacctgacgtagctgcaaaggacagatccagggactgaagccaaagttatgcaagggactgtgtgtcgccacaggacatcagtcagtattctccagtctccaccaggaatcctcttcagacaagtgtgctttatgctgaaacagaatactgttcaaggagccaaaagaggggggaagatcaggtcaatactatctactctcctcatctctacaccacgtctcacggtatctcttgagcatttaaatatagatgtaacataggtttgtctttaactgtcaaaaagtttggtctctgtgtctgtgttttaataagacgagaggacgagcgattgaggtgtatggagagaaaacagacctaatgctccttgttcctagagtagaagtgcgagggagggtggcctaaagagtcgagctctcggaactgcatgcgtgctggacagtatcagctgtctttcctagatggcaggtcacgttgaattccatttttcaaacggtaaattcttgtgctctaaatagcccaagaatgggaggtggacctcagatcgtgacattgatctccttcctggttcctgaactgtgggggtgcacatgctctgcgttgagtcaggttagagtcgaggcttgagagaacccgttgggttgagaacatccaaaatctaataatggccccgtcataatcattaagggggactctaggcaaaggtttactttggctgggaaatggggatggctggcaggaaaaggtgaaacctctttcgagacacaaagggggggaaaattttggataagactgcgctggcacaaaaaaaataaaaattttggcccggctccaaaaccaaaacatgggggccccgaaacaacataata

SEQ ID NO: 484530 - DNA, 174 bp, Homo sapiens
attgctcgagctcccagtccctttatatggatgctctttccgtcaaatgtcgttgggtctgaatggtgtcttgtatcagggctcttggctcaaatgttactctttcataagtgcttccctaagcaccctccccacatccacttgactccccatctccctggtaggtatgatgaa

SEQ ID NO: 484531 - DNA, 327 bp, Homo sapiens
tgtggtccaggtacttgtaaaacacggatgatacaagatatatgatatatacatagttcttatcctcagaggagcgtctagagtattgtggtcgaagcagacattgagaccaattggcaggcaattataattctggtctcaaatagttgatgagaaacagaccaacttgtaaaatagtctccaatcataacatgaaaggcatattttaaatccttaacaatatcatacacgaccttacttaggtctttcctctgttctatgaccagggtggagatcttcattatcaagtttcctgtaactaaaagggaacagatcgttgagaagctt

SEQ ID NO: 484532 - DNA, 164 bp, Homo sapiens
agagaatgaaactggatcctcatctctcaccttatacaaaaatcaacctcaagatggatcaagggacttaaatctaaggcctgaaactaaaaactgtagaagataacattgaaaaaaatccttctagacattggcttaggcaaggatttcatgagccagaaccc

SEQ ID NO: 484533 - DNA, 269 bp, Homo sapiens
gggactggggatgtgtaaaaaatacaggtcccacactgggtgctgggggacttggctgttcagccagagaatcaaagatcaaagcagttggaaggcagcccgtctccgcttgggttcgcacccccaatcctggagagaggagcaccagggcaacggtaccccagcccggctgcaggcacacacaccaagtgcagggaggatcctggcctgctggaaactggggagcctcagtgaccctttcaagtacaggccaaaaggcccctggaggc

SEQ ID NO: 484534 - DNA, 379 bp, Homo sapiens
ggctagcatcgaatctgacgcacagctgaggtgagccgtgatgtcctgttgtctgcctcagcctctcagttatgggatttcaggcactcccactacatccagtttacaaggcgggttaacagtggctacaggaacacatctgctttctctgatgggagaaggcgagtaagtcagatgtcctataacatcattatgggtcaaaatccccgtgacaaaggtcccatatatactgactttgattgatagctgaaagttgttttattgtatttatattttcatttagctactaccagtaaattagaagttttttacatgtatattttgatatgtggcctttggggatcctgtgttcaataaaaaggtggttttttttttaaaa

SEQ ID NO: 484535 - DNA, 243 bp, Homo sapiens
gctgcctggcatcatcactgacccgatcccagcttttggctgtgaactgcttgcttcccaggggggaactcatcaggtgggctgtctttgaggcacaggcaggaggtgtgtatcctcccagggagcacttccacgaatctaagcttagagatttctaggacccttccacccccaggtgatagggaatgaatattgggctagcagtcaccatgaacggctggacaagtggataggagctacctt

SEQ ID NO: 484536 - DNA, 124 bp, Homo sapiens
gtaatggagtgatgaaaaacgtcatagaaggatctgggtttaggtgtccacaatcaagccttgttcttccgggtggtcaatttgtatttgcaacattctgaaccagtctgaaagaacggccttc

SEQ ID NO: 484537 - DNA, 161 bp, Homo sapiens
  misc_feature (112)..(112): n is a, c, g, or t
agttcttcccttggtgggtggcggtaaaactactgtaattaatacgcttctgactgcttcagataaagtttaagccttatattttccattttgattttgaatattcagcttnaagtttggattaaaagcatggggtgggcacccaatgggggaagaaactt

SEQ ID NO: 484538 - DNA, 1220 bp, Homo sapiens
  misc_feature (915)..(915): n is a, c, g, or t
gcagaaaggtcgggcatgggctgggtatgccgaaagctctgtctcccactccgtgctgtctgagatgcaggtgattgagcaggaaaccccagtgagtgcaaaatcctctcgctcgcagactggacttgtatgacgatgttggtactttcgcctctggatcccctgaagttacaaggcacaattcccttttccttaggggaaagctttgtgctcccgctgggatacagaatgctgccgtgggggtactggacagggtagaggaggaagtgagcacaagcataggttgagacattcatctaagcatcacgtgcactatttcgaggatacaggagccacagaaccggagtggaagttggagtagctcggagcatcaggccctcggagtctatgatgaggcgcgtcagaaattcgcaggagccaaagccatctcatctgacatgttctttgggcgggaggtggatgcggagtactgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggttgtcaagtctggggctgggaaaatggctgtgctggccaatggtgtgatgaataccttgcaggatcgctacggttcctacggatccgagctctgtgactcatgcgttactacttggtgacggcaacagagaacgtccacatggttcccagagtctggggactgctatagccttgtggaagctggggaggatttgttacttcggtagtgtgtggtgtgtgtgtggggtggcctttgaggcgctcactcgctgtgacggggtaatggtcacgtaccaggcccttgtcctctgcctgntgtgactgagcccgtttattgcccgtctcgacatccacaccctctcggtgatagttgaggacttcttgggtccttcgtgtccatgccccgcacagcgtgctgctcacttatcgctgccatactgggaaagggggttcccccacgatgtgcttattctgggtccagactttccccaggtagggaaagcggaaggtagaaggctttttttgctggctctagggttcttctagttcgaggccttgggtccccatcctctggaaccagggggaggccttgaaatgagttcactgtagacccgtccctgg

SEQ ID NO: 484539 - DNA, 217 bp, Homo sapiens
tacaataaagtggtcttaaactcttcaccttatcacaaacaagaacactctgattactcctgtgcatcatgacccttgtgcataatatatgatttatcttcacactagcagagacattgagtactatgaaaatgtgcagaacaagcgcaagttgcgaggcaggcttcagtgcgcttgaccgggtacccgagctctgaatatccggaatcataggtcc

SEQ ID NO: 484540 - DNA, 134 bp, Homo sapiens
ggtatcctccttgtgatgatctcacatgtgaccaacctcaaagaggattgccaatggccgtgaacgatgaatgtcctgcaacgtgcctccttgctctaatgtcaacctatgagttggctcctgtgacctgagtc

SEQ ID NO: 484541 - DNA, 114 bp, Homo sapiens
ggtggagagagtataaatatttaacataggttttgatttatatgtgtaattttctaaatgaaaatgtaacttttcttacagcacattctttctttgggatgtgggatgcaggcg

SEQ ID NO: 484542 - DNA, 99 bp, Homo sapiens
tgatggccgtaccggcgcgcccgttcagccgctgggcgagtgggacccggtgaagatcgatgtgcgtgatcgatcagatctccggtttcatgttccaca

SEQ ID NO: 484543 - DNA, 280 bp, Homo sapiens
taacaactctaactcgaaaggccggttatatacgctgacagctcttcacaaaaatagctatgaacggtcagtcacagtgctaagttgctgtacagcgaacccaaaatccccatattcggtggtccagtgaaccaattgacatttctgctccatatttttttatatccagactatgctctgaaaccttgttccatcaagctgaacccccacgttgaacagtgaaactgaatctatctgtaatgtgccttccatggggtcctctcgctatgaactagcggtc

SEQ ID NO: 484544 - DNA, 415 bp, Homo sapiens
  misc_feature (34)..(34): n is a, c, g, or t
  misc_feature (42)..(42): n is a, c, g, or t
  misc_feature (81)..(81): n is a, c, g, or t
  misc_feature (109)..(109): n is a, c, g, or t
  misc_feature (144)..(144): n is a, c, g, or t
  misc_feature (223)..(223): n is a, c, g, or t
  misc_feature (388)..(388): n is a, c, g, or t
  misc_feature (391)..(391): n is a, c, g, or t
gtgaaaaaattttttttccccaggcccaaccctnatccccgnaaaaaaacccctttttcctagtggtattttttggccttnaatcccagaccattttcccagtccagtnaccccctgttgtcaactgtctctgtgaagggcatngctgcttcctaaagacttcacctatgtgtgggctgggatggaactctgggcagggaatttaaatgcctgtgcacttacngccttaacacctccagcttgctgagagagggatcctgttttctgtagcactcttgtttctagtggaatgatgcatgagtgccttgggtacattggtcagccttccatgttggagcttctctctgaacactctccagttattcagcagctctttgggaacctcatnctncgtgcttggcacagttgtgtatat

SEQ ID NO: 484545 - DNA, 857 bp, Homo sapiens
ggtccttgtcgagtgaaacagcctcggttgggaagtcagtgcgttctctcctctcctctcttcttgtgtgaacatggtgcggactaaatgactagtacagtgtatccaggctagcttacctctaacacaggtggtgtggctgtcgagcccccataaaggtgcttggttcttccacctctgccactaattgcgacatcagtttcatcgaggtaaagctgaaaattgaatatgtcagggagggaaacccgtggcgtgcgcccaaatcccaagtgggtaacaaaggaattgagaattctttagggtggtcccctaagagattctgaaaaagagaatcagattcctgaagaggcaggaagcggtggcgttaggaaaaggaaagagaatagcatgtacttgtgaaagctgatgacacgaatgaggagagaacgaatagagactttctcattcatctttgaataacgtgtcctgtttacccgtggtattctagaatgtaagttttcggtaaatgtgtgtgttccgattagtgggttgagcaggctttatgaagcatgaggtgtaagtgagatgtcaaaagtggttgtgacattgacacttgtaccaagaattcggctaacttagcttagtgttcctatatgctgtgtgggtttctttgacaacttagtgtctagtcctgctactccgtctggctgtgttcgactaccgctgtgtccctggaacgccaacgctgactgggccctcagggggcatgcaagggcccatggcccctctgggaacgcaatggcccaacagttttctttccacaaaacattttaaaaaaaggggcgccaaaagcggcagaaaggagtaaccaagtttct

SEQ ID NO: 484546 - DNA, 219 bp, Homo sapiens
  misc_feature (9)..(9): n is a, c, g, or t
ggcagttangatttatatctagcgggggatcagctgacgctccgcattgcacactgcggagtcagacggcgctatgtacgccctacttacctcctggccagcctcctgggcgcgcgtctagccggcccgtccttggagtgaaagaatgcaccagtggctcggcagttgttggtgcccagaattgtgaagacggcgtccgacttgcggggcagtgaagca

SEQ ID NO: 484547 - DNA, 324 bp, Homo sapiens
gggaggggcggcgtgcccccctcgctttgtctgggggggtcttgtggggggggggtgggggtgggcttggctagggggtgccatcggtgtgtcgcgttggggtcgggggggggtgggttagctgcggtggggttcgtgggtcggtggtggttggggcgggggttggggtggagggtttgtgtgtgtggggtgccgtggtcgttcttggggtcagagtttgtcggcagcgggggtgaattcctcgcaggtgtggtttgctggcctcgtggcctagagtggaagagtagagagttggtgtgttgggtgggttcggggggcggcgtg

SEQ ID NO: 484548 - DNA, 282 bp, Homo sapiens
tcttgaggatccctgacgctccttgaggagatggatactgatgcgactgtgagtgcgtacgtagtttgaacttttctattatgacgaaataaacaataaaggcatccaatagaatattcaaaattctaaatattacgactgccaaactagaattcttggactatatagttccctaagaactaactctgtagaccagtctgtagaggtgcttcacgaagcactgtgtgctcactaatccccagcaaccataagtttgaacttctcaataattctgggatggga

SEQ ID NO: 484549 - DNA, 865 bp, Homo sapiens
  misc_feature (1)..(1): n is a, c, g, or t
  misc_feature (84)..(84): n is a, c, g, or t
  misc_feature (150)..(150): n is a, c, g, or t
  misc_feature (306)..(306): n is a, c, g, or t
  misc_feature (310)..(310): n is a, c, g, or t
  misc_feature (444)..(444): n is a, c, g, or t
  misc_feature (477)..(477): n is a, c, g, or t
  misc_feature (488)..(488): n is a, c, g, or t
  misc_feature (567)..(567): n is a, c, g, or t
  misc_feature (570)..(570): n is a, c, g, or t
  misc_feature (604)..(604): n is a, c, g, or t
  misc_feature (662)..(662): n is a, c, g, or t
  misc_feature (768)..(768): n is a, c, g, or t
  misc_feature (777)..(777): n is a, c, g, or t
  misc_feature (795)..(795): n is a, c, g, or t
  misc_feature (861)..(861): n is a, c, g, or t
nggaaagaggtttgcccattgtgacctgcccccggcaacagtggccagatgggcttctagtaaagcccaattcaagtttgctcntgagcggcaggagccaccgctgttgctcgataccgcgctgcgaattctgcaggcggttggtaattnaaggcgctgtgcggccgcgcctcgttgtaatcctggcgccacgccgcgatgacagcgctgtgcatgggcaaggctcgtgaaccagtgctcattcaggcattcgtctcggaacttgccgttgaacgactcgatgtaggcattctgcgtcggtttgcnagcntgaatcaatttcagggacacgccgctggcgtatgcccactggtccagcgctcggctcgtgaactccggcccttggtccgtgcgcaggctttggggtagcccctgaagcgcgccgcatggtccagcgctcgtgcnacatataagcctgagatgccgtggtctacgacnatgtcgatcgnttctttcgtgaagtcatcaacgatggtcaggcacttcaggcgacgcccattggacaacgcgtccatcacgaagtctatngancagacctcgttcggtgcggccggcagagccagtngctcgcgctcgacacatcacgccgtggcgtcgccgccgacgccgcacagccaagccancctcgcgatataaccggtgtacgcgtttgtgattcgcgtgcagaccctcgcgctccagcagaacgtgcagtcgccggtaaccaaagcgccgacgctcatgcgccantccaaccanccgcgctttgagtatctngtttcctggcgcagtttgcgcttcgtaatgcagcacgctgcgggacagcccgacaagccggcaggncgac

SEQ ID NO: 484550 - DNA, 288 bp, Homo sapiens
ggagtcgtagggcatgacagtgccccaaagttcgcactgggttacgccgatccctcgggtttatcacaaagaataggactgggataaagaaaggggacacttaaataagctataaattatatggtcctggtctagcaggagacaacggcacaggtatactaccagcgttgggatattgatatatacatggcaaactctgacatactggttttactgacgacggccgggcaacggggtacaaacaccaaacttgaactccgacaccatacggactacagtacgggacga

SEQ ID NO: 484551 - DNA, 318 bp, Homo sapiens
ttttttttgagacagggtcttactctgtcacccaggcaggagtgcaatggtgagatctcggctcactgcagccttggcctcccaggctcaagcaattctcgtaccctcagcctcccaagtagcctgggactacaaaggggcacaccaccacgcccagctaattttttgtattttaggtaaagacagggttttgccatgttgcccaggctggtctcaaacccctggggctcatgcctcggcctcccaaagtgctaggattacaggcgcaaacttttctttaagtatgaaattattttcaaaatagaaaggtcgtcgacg

SEQ ID NO: 484552 - DNA, 115 bp, Homo sapiens
tgcgctccatcaggatccacgttactgtggctgtggtgtaggaaggcagctgtagctctgattcaaaccctagcctgggaacctccatatgccgtgagtgcagccctaaaaagcc

SEQ ID NO: 484553 - DNA, 239 bp, Homo sapiens
cgtatcgacttctgctctagcaaagatacgtcatctggcacaacagctgcaatcggaacaagtatttggtcaagtttatgagagtccactgtcaccctccaagactgtctgctttttcagagcaatcgtggtgttgttaaattggcgcattaaacaggatcatccctggcacgggtgcgagtggctcacgccatgtaagtcctatgcactattgggacggctagaggacgtgtgggatc

SEQ ID NO: 484554 - DNA, 750 bp, Homo sapiens
  misc_feature (1)..(1): n is a, c, g, or t
  misc_feature (82)..(82): n is a, c, g, or t
  misc_feature (197)..(197): n is a, c, g, or t
  misc_feature (204)..(204): n is a, c, g, or t
  misc_feature (213)..(213): n is a, c, g, or t
  misc_feature (263)..(263): n is a, c, g, or t
  misc_feature (266)..(267): n is a, c, g, or t
  misc_feature (299)..(300): n is a, c, g, or t
  misc_feature (304)..(304): n is a, c, g, or t
  misc_feature (313)..(313): n is a, c, g, or t
  misc_feature (326)..(326): n is a, c, g, or t
  misc_feature (328)..(328): n is a, c, g, or t
  misc_feature (330)..(330): n is a, c, g, or t
  misc_feature (338)..(338): n is a, c, g, or t
  misc_feature (346)..(346): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (365)..(365): n is a, c, g, or t
  misc_feature (369)..(369): n is a, c, g, or t
  misc_feature (382)..(382): n is a, c, g, or t
  misc_feature (384)..(385): n is a, c, g, or t
  misc_feature (389)..(389): n is a, c, g, or t
  misc_feature (392)..(392): n is a, c, g, or t
  misc_feature (400)..(400): n is a, c, g, or t
  misc_feature (405)..(405): n is a, c, g, or t
  misc_feature (408)..(408): n is a, c, g, or t
  misc_feature (427)..(428): n is a, c, g, or t
  misc_feature (433)..(433): n is a, c, g, or t
  misc_feature (436)..(436): n is a, c, g, or t
  misc_feature (444)..(444): n is a, c, g, or t
  misc_feature (452)..(452): n is a, c, g, or t
  misc_feature (463)..(464): n is a, c, g, or t
  misc_feature (476)..(476): n is a, c, g, or t
  misc_feature (597)..(597): n is a, c, g, or t
  misc_feature (611)..(611): n is a, c, g, or t
  misc_feature (618)..(618): n is a, c, g, or t
  misc_feature (644)..(644): n is a, c, g, or t
  misc_feature (650)..(651): n is a, c, g, or t
  misc_feature (658)..(658): n is a, c, g, or t
  misc_feature (660)..(660): n is a, c, g, or t
  misc_feature (662)..(662): n is a, c, g, or t
  misc_feature (672)..(672): n is a, c, g, or t
  misc_feature (742)..(742): n is a, c, g, or t
nttggttgtggtcttggtattgcaaataacatgtcttggaaatgtttagatgtagagagagaaataaacaaagtcacaaggncgaggctttaacataccactctaagaaataagtacacatagccaaaaacaacatactattacagtattatacagtattctgacacagctaggtttcagaaatcattatacttganaaaaagnataatttanattctttttaaaatcccatgtaacaattacaaaaatctctttagtaacanagnnaatctctcgccattctcccacgtcgtcttttnntgcntggcatttnccgcccacaatanancnctagttgntggccacncgccaganaanggnataanacgngcctacctgtttngnnatgngcncttttctnctttnctnggtttggggggggaaccgnnccttncgntttttttnggggcctnttgcttttttnnctttcggggganctttgttttcgaatggcggctattgttgttttgtgggttctttgttttcttttccctccctgggggtacagatttcgaataaattttgtcctatttgtatttcctcggtcttgggagcggntttttacagtccanaatattntgatatctatgatcgcatttcccagnggcaannatttttngnangatttcgtgntatagtagttatctccttaattatgaataaaataaatatatttatatttaatggtttaaaaattttaganattatgta

SEQ ID NO: 484555 - DNA, 424 bp, Homo sapiens
tcaccgatcgtagaactaggaatcaatagtcgactcgtcatttccccacataaactatgtagaactgttacagtgggtaagaaagaggaactctcagatacagctggctaggacatgcgaatcagtacagccattatgagaatcagtacagacgttcctcaaacatattaaaaataagatctatcatatgatcgagcaatcttcaccctcagtactgggtatatagacgcagaggtaagtgaaatcagtgaggttgacagagacatgtgcactcccatgttcatgggagcactattcacaattgtgagcatatggcctcaacttaaatgtccatcacgaagtgaattaacactggaatcgtggaatatatacacgagatatgaatagtacagagccatagtaaaacttaaatcctgtgcatttg

SEQ ID NO: 484556 - DNA, 106 bp, Homo sapiens
gatgcatgaatgtgtatgaagctggaaggatgcctccccagaagtccaagagtaatggaaatgtggagagaattgaagaaagcgcacttttcactcttaatgggag

SEQ ID NO: 484557 - DNA, 461 bp, Homo sapiens
ggtcagccccgacctcgggccgacgatgtcagaagctccgggggtgggtccagaagatctgttttattcaatcctctaggtgattctgtatgctcgctagaggttgataactactgctattagaatgtagtcgtataataaagtctctgacaaggccttattcagaatatgcaagaaaggttctgtgattcactttggcttctgtggctggaaaaaaacttctctggaacccacacatcaagtgcgtagttggtatgtgcccaggcaagtcctgacatcttcatgtccccctctgctagagggcggctgtaggatgttcacatgtctgcgtatggtcagacatcatctccttggcggcccttaggaaccaaatcatttgcgctggggatcaagtgctcaattggcattagtgagaagcccatcctatcccttgagatacttaatcatatatctctccagag

SEQ ID NO: 484558 - DNA, 226 bp, Homo sapiens
cacatggcatgggtcttggcagcatcattcattctcacagtgcaagtgcactccaggcaatggaaacaccaagcgtcgtgtgtactccactcctcaagtgggcagctcacagctgtgcaggatgcacaaggccataagcactgcatacaatggcacttatggggcattatgggggcacatgtgggcaggggcgtgcagggcatcacagactcaccccattgggctc

SEQ ID NO: 484559 - DNA, 275 bp, Homo sapiens
gacctgcgctaagccccacccagccccccggcgcccggcttcctgccccatctgctcagagagagatgctgccgagacttgctgaagagcttccctcctttcccatctgcagagtcccgcggcccacagagagcagggcgcaccgggagacagcatgcagcggcgcgagaggcccaggctgctgtccggacagtcaccctctgttctcgctacatccctagccccatgtccatatactgaagcgcccataggagcccttcacccccaaaaccagc

SEQ ID NO: 484560 - DNA, 169 bp, Homo sapiens
  misc_feature (169)..(169): n is a, c, g, or t
cccgtccgtaatatgtaacatgcagagcatagtatctatatgtattttgaaaattttccttgttactcattgatacatagttacttaattacatgtgattccatgtacactgaaaacaatataggaaatatatacatctaagacttctacttgggttacatattacggn

SEQ ID NO: 484561 - DNA, 864 bp, Homo sapiens
ccgttggggaaggaacccgcccttgctgcggggccacccggtcgaagtgttttcgccggcacacaggatgggtcgctcttcgccggccggagggatttattccgcgctccgcaagaaggggaccccaccgcgcatgcgtggtttttatttgcacacacaggttcgggggggcacccccagagcgtttactcatgttttattgggtcgcgccgctgcaagccgcgccgcacaccgcccccagacagctggttctgttcattgagaaaatgggtgcgcgctaaactttggatggtatgtagttgtggtatgtccaaccctggtcctgcgccacacccggtggttctaacggggcgttaaagacattggcgccacatcaacgcagagtcttttctatgcgcgcgttcaaagtcttttagggtccacggaccgcggagacctcgccaacggaaggatttagaaaaataaaggtctgcgcgtttccttccacggaagttacattctccttctgagacagtgcgggcgctcacaaagtacacattgggagatacaattgtgtaagggctcagattaaaagaggcggtgcccctcttctgtggggcgtagttctcacctaatataaatgggcgcttctttcgtgtgcagaacaacacaggggtgatccctgagcaccgggacaacagtggtgtactgtaaacgttagaccctttttttccagtgtcgggtaatatacgtggtggaccacgcagcgtaccccgcagtgtggtacccctagtagtgagggccgtcagttctccccgcagtcgtacgggggtgtgtatttcttcttgccaatctataggtcatcaagttacaccccaacataac

SEQ ID NO: 484562 - DNA, 167 bp, Homo sapiens
  misc_feature (4)..(5): n is a, c, g, or t
aggnnctccttcagaacaccgtggtgacataaatacccttgtccgtctggtcttcagagaagggattcggggaagggtccgggtcgattccacctccaaggctgaaacccaggattaagttctcacctgtgacgcagctgtgtgaatttcaacctcttggcaccact

SEQ ID NO: 484563 - DNA, 106 bp, Homo sapiens
aggagatttaacttaacttgacccaccacccatctctgaccatgaggacacctgaggtgctggactcggggctttttacccttccgggagaaaaacactaaccctg

SEQ ID NO: 484564 - DNA, 486 bp, Homo sapiens
  misc_feature (377)..(377): n is a, c, g, or t
ctcgggacttaccttttgcctgattctgggccctctgcttttgcctggttctgggcccttctacctttttggctggatctgcagcccctcccgggatccttaaccctctagctttgtgccctgattagcaacgaatctgcctttttgccctggatgggagctccctctcctttttggccttggtagggactcctttctgccttttggacctgagccccttctgtctacatttatacaccctgattctgggctccctctccttttgggcccagggttaagggcccgggccggaacccttaacgtataccaaccttggatatcatcaacggatgaggccaccagccagaacgcctgaacgcaggcacatacttccaatnctacaacctagtaggctcccttcccctattcatcgcactaccttacactcacaacaacctaggctcactaaacattctaactcctcactctcactggccaagaactatc

SEQ ID NO: 484565 - DNA, 156 bp, Homo sapiens
gatcccgtgctggtgctcaggtcattctcctggaaggtctgtggacagggaaccagcatcttccccagcttgtccatggccacaacaactgacgcagcccagcacgaatcccttagcaccagcacgaattcccttagcaccagcacgaattccctt

SEQ ID NO: 484566 - DNA, 1751 bp, Homo sapiens
  misc_feature (504)..(504): n is a, c, g, or t
  misc_feature (531)..(531): n is a, c, g, or t
catgctgcccgctcgtctaccgttcagggctggctgagtcctatatttcttctgtggaatactcagctacctcacggataggcgcagtccgatggcctcgtaccgtgggagtccgcttcctggagaagggatggtcgcgtctgaccggtcgtcctcctttccagacactcatcgcagtcgtgggaacggcgagcttgccattattgagccccgttggaacaacggtacggggcgttagtgagaaaggatggatgaacatgcaggtgagcgctttgcttgtatcccggtatgtgtaccagtcctgcgagtccgagagcacgacaagccttactcgcgacagaaaaaagctagacgagacaagagaacgcattccaatggcaagcatggcgagggcacgtgacgtggatggagacagtaccatgtatgagtccaagaccaagctgcgaccgcgagtaaagtgaaagaccgtgtcgggcaactaagcgaaagaaatccgtaaagggnggacccatgggtgcgcccagacgatgnagtgcgtaacaccccaggggttcccggtcaggtaggggccacccgcaagagaaaatccgccgcgacgattttaggggtcaaggctcctccgaaggcttgtggacggtttgcaaaacttggagactcacccggggacctatagtcgcgtggggggcccttatgcacctcattaagtctacttgggtcgctaggtggaactaggccccggcggtaaagctttgtcacctcatgttgtctttaaacactataggatgtctgcgccacgaaaaggaaaggcaatagagggtttaccctaataaccctggtcgagacgtgtaggacagcggcagctgggacccaagaaaacccgcgggctcgcgtggcccttggggagcaaacgggggaaaacccacgagttgggattgcgcccaaggagccgaccgttgacggttgggtcttataggcatgggttctgagccaaccccaaacagcaggtggggcaggccggcagtaccgttaattaggccccatgtggcaaaggggattggaagaggccccatggatgggaagggacaaacgattatccccgttgggggaaacggcccttaggtggttgaagagccagccccggccagattatatggccagtggcgcgggggcacccagagggcaccccacgataccccccgtgagaggatatggagctatcacataaaccacgtttggcgtttgtggaaacccttttgggctaggggaaaatcacttggggcccccacggacagggagccccctgtggcgttggggacgccggaaaaagtgttagaggccccccggcggaccctaggggatggggggagaccccggcaaaacgaccaaagcattggagatccggaggggcctgaggggcgaaaaacaacaaacaaacggtgtgggaaaaccaatacgattgtgaccccagaagaagacagtggactcccactagggctaaccccgggggacaaaaaagcgcagtagaggtggaacgcgacaccatgcgtggggcacaggacacatgggttgcaccccgggcgcaccagaggagcagtcaccaggatgtagcagcccaggggtgtccacccagagagaggcccacacaagcagccccgggcagacgaaggagacacagccgcacacgcagcgggggacgagaaccagaaacaccgcacacacagcagcagacgacgagagaacaggcacgacgg

SEQ ID NO: 484567 - DNA, 140 bp, Homo sapiens
ggtaacactgagtgacgacgtatcctgtctctaacaaatataaaaattacctgggcatggcaggctcatagctgagggtcccagctgattttttttatttttagtagagacaggtttcaccgtgttggccaggatggtct

SEQ ID NO: 484568 - DNA, 158 bp, Homo sapiens
ttgccccccgggggaaaaggcccctttatttttaacccaaattttcaaaaggggccaatttttttttcaaagccgggggagggttaatttaaaaccccctttttccccccccctttcccccaattttttcccgggaaattttttggggtgggacccca

SEQ ID NO: 484569 - DNA, 1385 bp, Homo sapiens
  misc_feature (1031)..(1031): n is a, c, g, or t
tggctgcgtctactgcgaaaatgaaaacttttctcagccaactcagaacgtgtgtcgacattctccaaaaaatgtgttcgacatttacctctgaagggacgcccagttatctcggtgaagggccccagaggaacccgggcggagggactttcaactcacattcaagtgtagaactctcgagccctttctttggaaagagaaaacaaaagagagaggctctccgggtgtgtgcaccacaagtggggtggggttacacaagaacagaggcgacacggggcttcaccggtgccggacacttaattttgttcagcctctgtgttccccaagaacactgttgtactccgcgggcggggtcgttttacccgctgtgggggcttctcagcgggttacccagcaggagtggagagctcctgggtgctttgtgctctcaacttttcccctcttttcaaagcgtttgtgtgttttactccccgagcgagcgacacagtgggcgctccctctctgtggcgtgtgcgaaaatccgccggcgaaagtaattctctccgtggtgggcgtgttgaaaaccataataataaccatattccccgggagaaggggggtgtcctccggcgagtgttgacaagaacacccccgcgtcgcttcgcttgtgccgtcgtgtccctccccgacgctactattctttccaaagagggccccccgacgaaagaagaggtagttgtacattcttcaaaactccctcctgttgggaagcacgcgccacaacatgtcggcactccatttttagcgaaactccttcgtggcgttttcccccacaaccacattcctccacacggccgcggcggcccattatgagtcgcacatatctccagacggccacaaaagcgtccccccactccacaacacgccgactgtctgttcaccacccacaacacccaacgggggggcgactatcttccccgcaggcgacaaccaactttcttcttcgtcggggggacagtggggggcacaacattccatagagatggtctttntcctcccttcggcacaaaccacccacagacggcggcaaacgtccgtttggtctctccccacgccgcacggccggcccgtgagcactatgaacactatcaaacggcgacctctccttaacaagaagcgttattacccccgctagggctggctaatcccgcaaacacgaagcatacaatcaatcttgctccccgaggataggtgcacccccccttttaaaggaaccccaccttcccgtctggcgcacgacatactctctccacagctgtgtcgtcttgcgccgcaactcaaagacgacacccccttatttctgacgttgtggcgcgaccacaccaaacacccatccatacacatcg

SEQ ID NO: 484570 - DNA, 544 bp, Homo sapiens
acgcgtccggtcttctgtaagtaaataagtgaagagatactctgtgactatggccagtgaggctcaattctgtgactataggaagtgaggctcaattctgagactcaatattgtcaagatgccaaatttctggacatttaactgatgagaatgagtttcattttttggagtttacttggcctacccgggatgataagcactttctatgcactgtaccaggggatcgtcacgacagccctgggttctggtgccgccttgcaggggagaaggtgaaggtggagcggtaacccggggttctggtgccgccttgcaggggagaaggtgaagatggaggggtaaccctgggttctggtgctgccttgcaggagagaaggtgaagatggagtggttaggggccatttcgaacgctgcagtaagtgccaaatccacagtttgaatcgaattccagaaactccagagtttgccttccgaaccaatctgagaattatgctggtcctcacatgcagtcccacgcctgtctcattggtctcaagctatggctttg

SEQ ID NO: 484571 - DNA, 317 bp, Homo sapiens
gagacagtaatgactggtgcgaaatatacagctgtagattccccttatcccggtgcagacgctttgactagcagtggtgaattggcctgtgccttcgatattcctgcgtcacctgagcatccgcgtcctcatctcgtatgctggcgcggtggaagggattactcagcaggagatactcggtgtagagacatggttctcctcagtgaactggcaggaccagtgtgggcttacctgtgagcacaaggtcgaccttctccctatcagtgcatccgtccagtttatgaaaatgcctgcacagttaccccaacccctgacag

SEQ ID NO: 484572 - DNA, 106 bp, Homo sapiens
cgtaagcagagagagcaggaagccgcatgatgctccgagtgtcccagcagctgatgagcaggcgcacttgaacgcacgctcgtaggtagccgccgcacccatcgtc

SEQ ID NO: 484573 - DNA, 229 bp, Homo sapiens
gatctctgcaaggaatcagaatctaaaaagagcaggccgactataccaaaagggacagtatggcaaagaaggcacgattctatatgcctacaaggatactccaccgataactcatctagcccataaatcataggacacagaccccagcgatagtgcacgggtcagagactccacaccctactatggaaatgcctcatagaagctagcatagtcactcccctagatgctt

SEQ ID NO: 484574 - DNA, 1384 bp, Homo sapiens
ggcgagtcgtcggggtttcctgcttaccaacagtgcttggacggaacccgcgcgctcgttccccacctgccggccgggcgtccatagccagccctccgtcacctcttcatcgcaccctcggactgccccaaggtaccccgccgtcgaatccagacgtccgggtcagcgcaatccggtcggcgacgtgcgtgcgtctgcttatgtcgggctgccaatgacggacactgggttgcaccatcgacaggtgcgccagaacctaccaccaggactcagaggcccgccatcaaggcgtcagatcaacctggaagctctaacgcctcctacgttgttagcatgtccgatgtctgtacgtacttgtgtacctgcgcaggcatgtggcttatgcaacggaaccgtgggccatagagtaacttagctatctaccgaatgctcgatgagggaagcaggggaaccatgctgagcacaagtgcatgggaaggctggcagacagtcgaactgatgtgtgtgccgacatctttcgcttcaagggataatcagggaaatcgagaacgtgtgactagactggggaagaacgcgtggttgtaattgcaaatgggacgtgtagacatgaacattgtcgggaataaacatagtgtgacatctcccgatgcaatcagcatggtcacatattggcacaaaacaattgagcccggcatgtatagaccaaagatggagacccgctcacaacggagcggtgaaaccttaactcttggcagcgactcagccatttaatcacttgtactattgccctccacagcgctggagcaaacgcacaatcacgacacactaacattcggcataatcgaaactgccggtcggcaccccaaacgcgtaaggacgcacccacacaatagggccaacgacggccacggccagatcctcgggctccgctggcccgccagacccgagaatacctaccatcgattcgacccagatcggcagcagccacaccccttgtgcgggtcagcaccactcgccgcgttcatctcgagcacagcctacacaacaccacccaggcccagcgcagcgagaacaactaccccacgcggtacaacacaccgccgctcgtcagaccgacagacacagtccacgcgccccggcacggacgacgcaccacacagtgcacagccgcgacggccgacagtggcaccgacgtgatgtggccgcagcgtaacacccacacagtgagcactccaacacgtgcgcgagactcacgcagacgcgggcggacacgaccaacacacagcagtgcgcagagccagcaacgaacgagacacacggaccagaatgacagacacacgacccgcacagcacgacacacacacagcagaacacatggagaaca

SEQ ID NO: 484575 - DNA, 252 bp, Homo sapiens
aactttccaatatttgatggttggaaattatgcttcagcattgggaactggaccccatgaaggatatgctcatcctctctgcactgaggcagatgctgcgggccgcagatgatttattagaagattcgcctcttgaggaaactggtgcaattgagagagcgttacagcctagcattttgtggacattcatgacccggctttgagaagtcatagatctactcatgttgtaaagagttgtcttgaagaacacgt

SEQ ID NO: 484576 - DNA, 259 bp, Homo sapiens
atactaacctaaagaaagttgacaaagccacactgacattggatgaagtagactttaaggaaagaagcattatgagataatgaagcgtgttccagactgatttaaaaaggttaatcaggaagataaaataattctaaacttatcttaccaaataactaacctgaaaatataagccaaactgacagaactaaaagagacagatcaatccacagtcatagtgggggatcttaacttacccccttagtaactgttagaatca

SEQ ID NO: 484577 - DNA, 511 bp, Homo sapiens
agctgtgggttaggttctgtgaaaatagtttgtttctttttgctatgcgttttattttgggaccaatatataaaaaagaggtggcgctctagagaaatcgaaatgcttgttggatgtagatagcaagttgcttcatcatgttttgaaaacgttgattcattatagtgctagataaaacctgattatgcattcttgcacaacattataaaccctcagtttctgacatttgccttagattataaagtgctttttcatatagttgacatgaggtgtaaatactatttttgtattacaatgttaaaagttatggggttttatatccacaaaagcgtatattttgatacagttatggaccatcatcatgcagaaaagagaaagaaataatttcattataaaacggtttaaatcaggattaacattacacttttttgttttctctccatacctatcttgttcttgtgacattcctagctgtatttttctttgccctcaataaatacttgtttactga

SEQ ID NO: 484578 - DNA, 335 bp, Homo sapiens
agctcgctatctgtaacaggataggagtattaactactctgggcagcagaagctagtagacttcttcctccatccaagagactaagccatttagtaccctagtctacccaggtactgtagatgcttacctctgcctctgctcttcgatcctgtggcagtcttatcgaatcccagagtttggtctcctcaactataacctatagaagcaacttacctttcaccaggaatgtgaggtatagtcaggtactcctctttagttaccctccatacatctcctttgatccagatagaaagacactcagctccttccccaaaaatcatcacaagaggggaac

SEQ ID NO: 484579 - DNA, 96 bp, Homo sapiens
ggccgattcggcaagcaggacttcatctacatggctgtttcggacgaatattgatgccccgggccagatgctgacgcgctgcgttcctcagtggaa

SEQ ID NO: 484580 - DNA, 443 bp, Homo sapiens
  misc_feature (400)..(401): n is a, c, g, or t
tacgaatcatagttcactgcagccttgatctcctgggcctcaagtgaacctcctgattcagctgcctgagtagctggtaactacaggcgcatgccaccacagtaggctaatttttaaatttttttgtagagatggagtctctacaaaaacacctgggttggctgggcacggtggctcatgcttgtaatcccagcactttgggaggctgaggcgggtggatcacctgaggtcaggagttaaagaccagcctggccaacatggagaaacccagtctctattaaaaatacaaaaattagctggtggtggtggcaggcgcctgtaatcccagctactcaggaggctggggcaggagaatcatttgaacccagcaggtggaggttgcagtgagtcgagatcacanngttgcactctagcctgggcaacaagagtgaaactccatctca

SEQ ID NO: 484581 - DNA, 403 bp, Homo sapiens
  misc_feature (46)..(46): n is a, c, g, or t
  misc_feature (48)..(48): n is a, c, g, or t
  misc_feature (214)..(214): n is a, c, g, or t
  misc_feature (240)..(240): n is a, c, g, or t
  misc_feature (267)..(267): n is a, c, g, or t
  misc_feature (304)..(304): n is a, c, g, or t
  misc_feature (319)..(319): n is a, c, g, or t
  misc_feature (334)..(334): n is a, c, g, or t
  misc_feature (355)..(355): n is a, c, g, or t
  misc_feature (365)..(365): n is a, c, g, or t
  misc_feature (388)..(388): n is a, c, g, or t
  misc_feature (394)..(394): n is a, c, g, or t
cctgagctgcacgcccgtaatcccagcacttcgaaagccgaggcgngntggatcacctgaagtcaggagctcgagatcagcctggccaacatgcagaaacagcgtctctgctaaaaatacaaaagttagccagggagtggtggtgctcttctgtagtcccagctactaggggaggttcagtctgggagaatctctttgaacccaggagggcggnagttgcagtgagcccgccatttgcantccagcctggggcgacagagttgagantccatcttcaaaaaaaaaaaaaaaaaaaaatttcctncgggcccaaagtttntttcccttttagttnagggtttattttttagctttnggcacttggncccttcctttttttaacaacgtncttganttgggggaa

SEQ ID NO: 484582 - DNA, 206 bp, Homo sapiens
agagtccgtaaagaggtatctttactataaaagctatagtgtaagctagtcatattaagtatgtaggctcatggagtttgatagtaacttggagcagtgaagagtagagtagtagaatagtatagttgagcctaagggtagttgttgagtagtaatatagtgcgatagagtacggggaactggagcctaactagaggtgtagaata

SEQ ID NO: 484583 - DNA, 294 bp, Homo sapiens
ccccgggggccccccccaatttttggtttttgggcccgtttttttggggggggggggcccccggggctcccccccctttttttttggggtttcccaaaatggggaggccggccccctttttttcccggggggcccacccttggttgttggggttaggggcacccacgggccccccccaggaaatttggggggcccccccccccgggggggttttgggggggaaatttttttttttttgggggggcccccgggccgggcggtttcattaagggggcggggggcccgtccttgcca

SEQ ID NO: 484584 - DNA, 776 bp, Homo sapiens
acagagttcactataaatggtgtttttttaactagaatataattatcggaagcagtgccttccataattatgacagttatactgtcggttttttttaaataaaagcagcatctgctaataaaacccaacagatactggaagtctcgcatttatggtcaacacttaagggttttacgaaaacagccgtcagccaaatgtaatcgaactaaagttgaagctaagatttagagctgaattaaatctcaactcaggggtcgctaacgaagcgagcactgaccagatacagaatgctcggctctttcctaaatgcacgtgaattcgtgaccaagttataaatcaatgtcacttaaaggctcgtcggtagtactcctgcaaaattctatagctcagtcttatccaaggtgtaactctaattcccatttcgcaaaatttccagtacctttgctccacaatcctaacacattatcgggagcagtgtcttccataactgtataacacgaacaaggtagctccttacctaccacagtgtctgtatcggagacagctgatctccatactgttacactaagggtgctaacgtaatcatcgggaacacgtgtttcccataatttccttcatgcaatgacatcttccaagcttgacacaatcgttagtatcctaacatgtatcccaactcctataattccctatctctagctcttagtcgcagcaacattccgtggtccactaagcattgggtgggctaaatcaaccaacgtaaaatgccttctacaaca

SEQ ID NO: 484585 - DNA, 377 bp, Homo sapiens
tgcgtagcgctgaccttcattgaggtcccattaggaaccagatgtcttgattacatgtacacctatcctctgatgtaagtctcctcaccttgaggggtcatatagtaatgcatctgggtagcatctcaactgcaggtagcatttatctgacttggaaagttggagaagaggcattcctactggagaaaaatgtcagtgttttctctataagctctgtgtatagctattcattatatttgtgctttacagatgttccttcattcatcaactaggggaagtccagatgcgggttatcttgacagaaacaaactgacattctaggcagacagttgtctatgtggtctgagggtcagcagctgttagtctccttcctttgg

SEQ ID NO: 484586 - DNA, 358 bp, Homo sapiens
cctgcaaggagactcttgaggatacccctgcgctgaccttgacgctcggcctcccaaagagctgggattacaggcgtgagccactgtgcctggccacacctagctaatttttaatgtttttcaaatggagactctgtcacccaggctggcgtgcagtggcaccatcttggtttactgcaacctctgcctcccaggctcaagcgaatcttccgccttagcctgccatataggtaggactacaggtgcataccacaacaccgagctaactgttgcattttttgtagcttcttccctggccaagaagcttttttttttttcttgacacggagccttgctctgtcgcccaggctggagagca

SEQ ID NO: 484587 - DNA, 145 bp, Homo sapiens
tttctaatggcgtacatttgcatatcaaagcttgccggtgggggctcttctgctaggcaagaaatgtttcttgagctactttaaaagaaacaaaaacatggcaagacccctttttcgtatcctgccctaaaataaatttcttaat

SEQ ID NO: 484588 - DNA, 371 bp, Homo sapiens
  misc_feature (80)..(80): n is a, c, g, or t
  misc_feature (104)..(104): n is a, c, g, or t
  misc_feature (211)..(211): n is a, c, g, or t
ccgccgcgatctgggtttattttttcattttttaaagatgagtcaatacattacagtatattaaaaattatcactgagancggagggtggggggactcccatcnaaggggagtaatctatatctttacccctttaaatgaagctgggattgggggattcttttatcaacagaatgcagcagaagtaacattgggggatttctaagtctttngctcaaaagaccggggggggtgttgttttattggaacctaaagcaacaatgaaaagccgggtggagagagatccagctgtgccacgtcttctaggggttccagggggggctcatccatgtgagtgagaccaggatggtagatatcaatagccataggact

SEQ ID NO: 484589 - DNA, 379 bp, Homo sapiens
  misc_feature (332)..(332): n is a, c, g, or t
agcactttgggaggccgaggcgggccgattgcttgaggtcaagtgtttgagaccagcctggccaacatggcgaaaccccatctactaaaaatacaaaaattagccaggcatggtggtgggtgcctgtaatcccagctacctgggaggctgaggcaggagaatcgcttgaacccggggggcagaggttgcagtgagctgagtttgcgccactgcactctagcctgggggagaaagtgaactccctctcaaaaaaaagaccactctcagtatctctggatttctgaagatgtacaaaaaaatatagcttcatatatctggaatgagcactgggnccttaaaaggttttccagcaagttgtaacttatttttggctaaaatg

SEQ ID NO: 484590 - DNA, 149 bp, Homo sapiens
cctgcgaccttccgccggggcatatgagctggtatatgcagagtaccgcgacatcggctcatggtcatggacatccgcaatgcttatgctgtgttatagtacatcatccgtgaagaacttcgagaagctcttattgcccaggctggagt

SEQ ID NO: 484591 - DNA, 613 bp, Homo sapiens
  misc_feature (504)..(504): n is a, c, g, or t
gcgcgagagaacttgcatgacgctacttcccctatcatagtaacgatcataacctgtgatggacgctcgctcataagcaacatccatcacttgacaacagagacgcttaatgaatggagacacccggaactatggctgtcaggctgatactaaggctgatggctactaacattcttacgcattccttacagcgcagactgggttaacggtcaagtaccttaccaggatagtaatcgctgagcaatgtcactgaacgcacgcgcacaccgactacggccgtatgagcccaagatcttgcatacttagatcattatatcgagaaccaggcgatctgcgacatctatacgatgacataactgcatgactaactagcgtagcccccattcgtatactatacacataacaagacgtatcgcagtcatgagcttgccccacattctgcttaagaacagatgccatttgcggatcgttaaaccgaaccactagcaccgttacacgagcggnggtatctacggtcaatgctctgatatctgcggagcgaaccacaggtttatgcccatcggcctactaattggactacaagtgttgcaatacggcccgtacttacgctatg

SEQ ID NO: 484592 - DNA, 301 bp, Homo sapiens
taagcataaactgggggacagtgcgttattgctgcactcctttaattccttatacagagcccaaaaaatatagacaaaccctaaaaatgtagcagaagcatgtccgcacactggtgtccagaatctagtgggtgcagaaatgtttccacatagattaaaagagtactcttcagaagaaagaggcgagggctcgtcatttggtcacccttagaacatgctgcaactcttcaaggggtttccattgttggttgattgttataagctgttgacgtacagcgtgctccacaagttgatgctcacg

SEQ ID NO: 484593 - DNA, 128 bp, Homo sapiens
  misc_feature (46)..(46): n is a, c, g, or t
  misc_feature (48)..(48): n is a, c, g, or t
aatacaatcaggagagagtgtgcagtctgaaatttaggcaaccggntnaatttagagaactgggatatgtagagaacagccttgtccatttttctcttcaagaaaaggttaagtgattgttccccgct

SEQ ID NO: 484594 - DNA, 215 bp, Homo sapiens
  misc_feature (182)..(182): n is a, c, g, or t
cttgagcccaggagtttgagaccagcctgggcagcatggtgggaccctgcctgtactaaaaattttaaaaagcattggctgggcatggtggctggtacctgtagtcccaggctgacgtaggaggatggctcgagcctgggaggtggaggttgcagtgaaccatgatagtgccactgcactgnaggcctgggcaacagagcgagaccctgtctcca

SEQ ID NO: 484595 - DNA, 202 bp, Homo sapiens
ctccattaccctcaaagtgcttagcgtttacccagaggtctgggcctccaggtggcactgcagcgggaattcagtggcagcgccttaggccttcctgccatgaaacagaagccaaacctcacatgctcagaaggaatagcaagttacgactcaaaagagtgttcagaacgatagagccataattatgcatgaccacttaagt

SEQ ID NO: 484596 - DNA, 117 bp, Homo sapiens
gaggtcgtgctatgacctcagaaatatttcaacggtgtgtggagggaaaggaggcttgtgagagccgtcagcatcggaaggtccggggcggatgtctctatagctcctagtgacctg

SEQ ID NO: 484597 - DNA, 448 bp, Homo sapiens
cgactctacaggattttggacagacgccacgttgctgcatcaggagagtataaggaggcgcgcaggtcacagggcatgctatctcgtctgtccatgcacatgaagatatcatgtccacgcccagctgctgggagatctcgtcgatgccaagtactggcggtccaagtcacatacgggcaaagagcttcagctggtacctgcaggacagggaggactgtgaggacacggcagatggcagccgggaggctgctggcactgggcactagacttggtgaggactcagtaaagtggcaaagggattaggttaaagatgcgccagctgcaattctgagttagaaaggtgaacggaaaacctgtctgtgataaccagtacttgcaattctccccctcctggctaaggcgcagccaggacaggtcttcatgacgtggcgtctgtccgggtaccgag

SEQ ID NO: 484598 - DNA, 715 bp, Homo sapiens
  misc_feature (177)..(177): n is a, c, g, or t
  misc_feature (254)..(254): n is a, c, g, or t
  misc_feature (273)..(273): n is a, c, g, or t
  misc_feature (416)..(416): n is a, c, g, or t
  misc_feature (461)..(461): n is a, c, g, or t
  misc_feature (526)..(526): n is a, c, g, or t
  misc_feature (679)..(679): n is a, c, g, or t
catctttcctaaagcttgctactccagaaaaagcttcataagtttgagttggcctgtttggccaacctttgcccagagactgctgaggagtccaaggctctaatctccaagcttggagggacggtttgaagatgaggagctgcagcagattcttgatgatatccagacaaagcgcanttacagtattaatctccaaacatcactgctgctcggagaaaccacatccccaggcataacaccaccttcccactgtnctggggctgacttgcacanaaattctattgaagacagttgagaattcctttggagaaaacagcacagcttggcgtggggttaggttgctgtatcaaataactcacaggcccaggtgacatggaatcttggagcagccttgtgcagtggcagccagtggcttnctgaacgtgcctctgcgaagtgtgagatgaggggtcacataaacnacactattagactacctcatcctggttttggctcacatcatctttttcttatattcatgtattanttcaggtgttatacttttaaactagacagaagatagtagacttatagagaagacagtatactagatacaagagataacgctgtattaatctttttttttttaatgagaaggttatatgcagctgagagtcagtgtcatatgtatattacctcnactcaaactgcaagttcaattatattattatagggt

SEQ ID NO: 484599 - DNA, 227 bp, Homo sapiens
  misc_feature (142)..(142): n is a, c, g, or t
ctacccgctgaatgtatatgctggcaagtgcttataaaaaaaatggcataagccagtgtgtggtggctcacaccctgtaatcccaacactttgggagaccgaggcaggcagatcacttgatgccagtgagttcgaaaccagncctggccaactatggtgaaacctcacctctactaaacaaatacaaaaaaacaattcgcccgggtgcggttacgcttataaagggt

SEQ ID NO: 484600 - DNA, 157 bp, Homo sapiens
aaaaaattccccccccccccccccccccccggggttgggttttgggggggggttcccccggcccaaacccggtttttggttttcccctttcaggttttttccccccccccccggggcccccccccttttttaaaattaattggggggcgggggggga

SEQ ID NO: 484601 - DNA, 159 bp, Homo sapiens
tgtgatcagactctacgagtatcccacgtctttactcttacatgcaggaacactcagcacacacatgtatgctaagggccagagaagccagacccagtatgaaaaaatagcctatttactttaaagtaaccaacacattccattttaaatgtggggatt

SEQ ID NO: 484602 - DNA, 344 bp, Homo sapiens
  misc_feature (10)..(10): n is a, c, g, or t
  misc_feature (344)..(344): n is a, c, g, or t
tcctctgaancatcatactttgcttcaccagtatttatgaacatttcccatttcatcacaaaggacattaaaatgattcagattcagatcatgatttttttagattaatactttttactgcctcatcaaggagattcctaagacttttttttttttttaaagagatgtagtcttactctataacccagccgggagtgcaagggggtgatttggggtcacgggagcctcaacctccgggactcaggggatcaccacagttcagcctcctaagtagctgggactacgggcccgcatcaccatgccccgttaacattttgggttgtttcatagagacgaggtctccn

SEQ ID NO: 484603 - DNA, 240 bp, Homo sapiens
tatttccacaggggaaactggaacgtctttcgggacagtcagagagataacaggtttcctgaacatacagtcatgggccaccaaacatgactggacttcagtggttttttctaaacctgggtagacctatgggtgggaatgagtactctaatagtgggcctggtccttgctttattccttcaaggcaaccaggggcattcaccttcttctacaggttccacgtcccttgaagggaaattc

SEQ ID NO: 484604 - DNA, 212 bp, Homo sapiens
cttgcacaggtccctcgaattcttctgaggatccatgctggcttgggagagggcgcagctccatgccccagtgcctctccatacagggaggaactcctctgtgattcgtggcctgacggtccagccgagggtgggtgcgacgaggtcagccgctccatgttccgtgccagcacattccgagattgtcatcgaggctctggctctcgttggag

SEQ ID NO: 484605 - DNA, 775 bp, Homo sapiens
agcggagtggtgtcgcaagcttcatctgttcctggaagatacccgtagcctgccttccttcttgacaggctgatttaggggtgctccccacagaagatcaggactgctgaatagaatgaagaagaacttacttggcctaggatgtggctagagaacggagcgcactttcatgttacctggcaaggtggttctgcaagtttgccacggaagccttcccaggtccgctgctgaccgtcctcgcctaggtgtggagcgttcccgaccaggcatggggagggaatgtcctagctgggagccgtcgaggaccctctttagccgtcttgccctggcttgggtgcagctagcagtctggtactcgcccattctgctcttcttcatctccggattttctctctcacggaagaagaatgccattctcccatcccaggaaggagagtgccctgtgtgcctacgaaagagcccaggacccgactaggacaatatacgtcactggcagaccgtgtcattcgcctagcgccagtcccgatactctgaaatgctccaggcatagggtgccccggtccgagcgctcccagagctgactctttccgtgaacggtcactgcgcaggatcaagctacaatgaggaggagggaggcagtctgcgcgcaccgtcattttctaggaactgggaagtctcaccgacccttaggaagatcatgcctgtggaaccttgcccaggcttaccagcctttgctgaaggttgatctattgtccctccttgtcccatcaaatat

SEQ ID NO: 484606 - DNA, 894 bp, Homo sapiens
gccgcccttattttttttttattcaatggttcagttccctttaatgacccctaatctccctggaagggcaggtgcgggcagctaggtgatggcaagagatgtcacattgaaaatctgtgccctgattgaaggcttggcccacatgcgtggaaggccccctcccaggaaaagtactctcgaaaccagcgtcgtgggtctcctcgcgtgccaggatccagttatccgccagtggtgtatgactcgtagtccaccgtgccaatcgtggactcaggcggaaaggcaagctccgtggcctcggaagaacccaaaactccgaaaaatggcagctgctaattggtgggtctccaaaagaggatgcacactgggcgaaggcatctcttcctcaagcttgtccagtcgctggaactattccagtgatgagattgcagctcagtgaaggtctgagggagttctctcagggaaagcgatactcgtgagtcaccaaagggcaccagccgctccttatcagaagggctcccagaaatacatggccaggtgccacagaaaagtgtgtccctcatgggagtactggcgcttaaattcatccaaacacaagggtactctgggccaggtgaccaaaggggtccttggcctggggctcagcagccagcgcctgctcaactttcatccatctcctcctcaggagcaggggcaagcagcctttttcctacgtccttccgttcaagccgggggcttctggcttctctacccggtgaaccctttactcttcccgtgggtggtgtccttaacaggatgggggcctctggaaacttttaagcttaacgtgggccatcttttcacaagagttcactttccccagagaagccggaacggggctggtaaatgtaggttagg

SEQ ID NO: 484607 - DNA, 276 bp, Homo sapiens
  misc_feature (43)..(43): n is a, c, g, or t
  misc_feature (173)..(173): n is a, c, g, or t
  misc_feature (225)..(225): n is a, c, g, or t
  misc_feature (231)..(231): n is a, c, g, or t
cccctgaagtttaacggttggcaccgtccaggttgccactggnacacgaaacagcgttggtccccatataccggtaaactgaaactgcagcgaagagtttagcagaaccatgtatatcaggtctgtttcgtgtgctgaattgttgacgcatttatttattggtatcgcatganccccatcgtaattaatcggcttcaacggaagctgggctacacttttaatcancagganctgttgcagcaggcattaactcatcgtagtgccagcagtaaacat

SEQ ID NO: 484608 - DNA, 122 bp, Homo sapiens
gaactgggattaagaaatctagtcttcgcctcattctccaatggtcacgggaccattcaagaatccatacagagctccgagtctcttctgtccagccttcatgccagacccttgggactggg

SEQ ID NO: 484609 - DNA, 214 bp, Homo sapiens
tccacaccctcgtggtcgtcccataactgctggaaataacacggtgtgagccactgtgcccggcctccatagttgcttattttcttagataacctgtatgagtcgatagtaagtaactatatactgagcacttaccaggaattggaacccaattaatttcattctaacaataaattcatcagatggctatgctattgaaacttctaaaactagg

SEQ ID NO: 484610 - DNA, 426 bp, Homo sapiens
cccccccaaaaagggacaaaaagtgggggccccccccggggggcccccctttaaaaaaaagggacccccccgggccccagatttgggccggggtacccccccacaaaaaaaaggggttaaacccctttcaaaacccggtaaaccttttggtataaggcccaaaaaaccccccaagtttttttttaaaatttttttttaaaaaacccctttttgaaaaaaaaaggttttgggcccgggggcccttttttatccagggaccaaaatttgggaacctcccggggtttttttttttttttttcaatttcccaggggttcatttgggaaacccctttttaactttgggaaccaaattttttttttttggggggaaaaaggtaaacccctgggttttatttaaaaaaaaaaaatggtttaaattggggccca

SEQ ID NO: 484611 - DNA, 134 bp, Homo sapiens
ccgggaacggtggtgcatcccccaggcagctgacaaaaatggtcactcccgcgcgacttcgtcaaacatcgttgggccggaatatgtcaggcgctgatgcagccagcacctcgcgaacttcctgaggagtaggg

SEQ ID NO: 484612 - DNA, 232 bp, Homo sapiens
gtccgtttcccatgataatactgtcctattcatgcatacaaaacagtatctgtttaactatatatcatcaaaatgagactaataccagaaaaaaaattagacagtaatgagaatcaataacaaaacataacaatgacaactgttcttaagtaatttattttaaaattataagatttacagtgccattgattatgcacaaatagccataatggcaaattaaacccaaatccaa

SEQ ID NO: 484613 - DNA, 388 bp, Homo sapiens
ttcccagcttgcgccgttctgtctggtgtagcccatgaggtggccagacgtgggctaccattttctaccccagaaaactatcggctcgcccttatgacaacataagggtcgaatgtgaatttcagcagtaaactgagagtagcgtgctaagttaaacagggccctgaagcgcgtacacaccgcccgtcacctcctcaagtatacttcaaaggacatttaactaaaacccctacacatatatctagagaagacaagtcgtaacatggtaagtgtactgcacaatgcacttagacgaacaaggctcctctagagcggtatgaagcaccgacaggtccttagagtatcacagctgaggcatcgtaatgctctagcgagcagtatagtagat

SEQ ID NO: 484614 - DNA, 120 bp, Homo sapiens
  misc_feature (13)..(13): n is a, c, g, or t
cgtctgagtgtanacgacggcagtatagctgtttcgtgagtgtacacgacggcgagtatagcggtttctggattgtaaaaggacggcgagtaataccggttgcgtggttataaaaggagg

SEQ ID NO: 484615 - DNA, 213 bp, Homo sapiens
gagcagcgttatctgaattgttatgcgctgtggcaacgtttgctaagattctctgctccaatccaaacacaggagcggtgttatatgaacttccctccaacacacagtgggtgcttcgatattcagtggtgtccccgaaatcctgctagtcttatcagctgcttcgtattgcatgggcgtatccagtgtttattactcatccatgggtaggta

SEQ ID NO: 484616 - DNA, 1214 bp, Homo sapiens
ctttatctccttgtcttatctgtgttcctatttttagtgctactatctcctcctttattctcgccgctcttgtgctgttgtgtcccgtttgttttacaatttatgatgttatttactccctgtgagcttgttgatgtgtttctttgactctagttcgcgccaggtgttctccgtggtttcctcccacgtgtcgtcgtctttgaacccgaccgtgtcggtctagtcatcctcctgttggttctcacttcttacctcatatggtctggctgtttctttttcttgtttgctcttttcatattggtgttcctcttattattgtcatgtgtattgttttcctatttcttgttgtatctcgttcttttttttgtgtctatttttttctctgttccgtgttttgtatgtgatattgcgttcttgtagttatttttgttatgctgtctagtagtgtctcgttttgtgtatgtctctctatgtgttcatcttgttactttccttgtcctctgactattattattgatatgtatggcttgaagtgcgtgtatctttcgatagtatatgtcggtatcaaggacgtctattgaatattgataatgtttcctatctagccatttctaaattggcacaggctcactctacctttattttataatgctcgttctactatgccaagtaaatgacacactatgctggtatttctagaagatggtacctagccaggtccgttatagagccttataacatattttaatggcgatgttgtaaaacttcagacaataaaagcatgaaagacacttcaatacaggtaagtagtttcaagaccatcttccaaaagtaatgaccagtcacacaacgatttacctagtaatagtgctggatgaaacctaactacctacctagctagatcctgctgctacatatactataaatgctgaaggattccatgacatcttgccaaagtcctctagactacctttagactaatatagtagcatagtatagctaaaccatgtcttctcctcatttggatatgtaaaccttatctcagcctgggagatgaatacatcttccactcatggataactcaactcctgggcccatcagtcctcaaatttttcatagcattcatgaacattgaacaataggtaaaggaagtgacaccgaaaaaattgaaagaaaactgtcaaaaaggccactattgatgtatatctcagatg

SEQ ID NO: 484617 - DNA, 955 bp, Homo sapiens
gagagatttgcaaggtcggctgtgttggagcacaccgcgagtacgtcatagtgacaatgctctgccttatcaaatggggaagaaaggacgatgtcttgggagtcttgagccattctgctgctgtcgcgcgtcatctcagaggtacatggaatgtggcggagtacccgtgatgaccatccctagtgacgttacagcgtgactgtttcagccgactttctcacaagaactgtctgtgctgtgagagtgcactggcactgatggagtcccgcagcagattgtgtgaaataggcaagttgtttattaaaatcgggacaagagcaagtaatggcgctctaaggttgggagaacacaagaggttgcttgacatgattgcttggagggaacacaggatggaggggtaggaggaactgaaaatgtgcgctcagcgaacctggataatacgcagtagcatagaacttacttaaaggtagaagaccatcagaggacacagttgtgacccgaagtaactctcatctgcagttttgaaggaaattcagacacgtatctatgggtgaaaaggacgctatgacagggagactagtccatcgtcatggttgccagaacaccaaaagtgtggcactgtgcgtgcatgcatcacaggccaggtgacagcagacagtcccacattcaaaaccgggaccaaaaacacggaggaagaatacacggaaaaggaacatcaagagggtgcggacatgttgacccaacatgagccctgttcacaccgggacatgacacaccgaatggacggaaacaaagtaggatggcggcataaacttaacaacaaggccattagagaatcggaaggacgggacacacaacgccaggaaaccgcgacaaaggaaaccagggagagatagacagaaccacccgagaacaatcacacggggaacccacatgggacacccagagcaataga

SEQ ID NO: 484618 - DNA, 410 bp, Homo sapiens
  misc_feature (220)..(220): n is a, c, g, or t
  misc_feature (376)..(376): n is a, c, g, or t
tatcagcatatttctgaaattctctgttattctatttctactgtctttccccactttactataaatttgatctgttataaaatggctgtgtttagatagatacccgtgatgtttaggaaacaaatgatatagagactcccatttaaatgaatcttatctttataagaaacagccaaactgttttccagactggctataccatcttacattcccaccaggnatgtatgagtgatccagtttctctgcatgctcgccagcatttggtgttgtcactatttcttatttcaaccattctgtttatccttttcagtgaaatatctgttcatatcttttgcccatttgccaattgaggcaggaggatcacttgagcccaggngttcgaggctgcagtgagatatgatcactaaatg

SEQ ID NO: 484619 - DNA, 515 bp, Homo sapiens
atgacagaagagcatttgttagctttgctttgcttttctttcttttttgagacagcctcgctctgttgccaggcaggcttgagtgcggtggcgcgatctcggctcactgcaacctccgcgtcccgggttcgggcgattctcctgcctcagccccccgagtagccggtattgcaggcgcctgccacgacgcccggctaatttttgtatttttagtacagacggggtttcaccgtgttggccaggctggcctcgaactcctgacctcgtgatccacccgcctctgcctcccaaagtgctgggattacaggcgtgagccactacacccggccgttagcttttctttaaacaacataaatctaaaggaaagaaataagcctttgggaagagcaatacttgatgtttttgtaatataattattttgaaaacaagcaagcatggttaaacataagattgtgcaagtgtggatttacagaaattaatctgggccgggcgccgtggatcacgtctctaatacc

SEQ ID NO: 484620 - DNA, 972 bp, Homo sapiens
  misc_feature (694)..(694): n is a, c, g, or t
gctctactcggtcggcacttgatggggtgatgtgtctaccgtactagtgctccgctcccagcatcgatggggtactctcggcgttccgtgcctcggcagagcgacagagagccaggggattgtaggtcaaggatgtagagagacttcccatacagtgattgactcctgtccagatgccggtccaccgtctacattcctgtgcgtggcgatacaaaggacttgggatggacatcacaactcagtgtcggtgaaaagtcgatgaggcgcggtgattgctagagtgacacgagaataggcggtggatggacgctgtgatccactgagtatggagagggcacccatggctgtgtagtgggacattgtgtgcatacggtggaaaactgcgctcgatggcctactggatctgcagtgatttgtctttgctgagcggcatctgtttattagatgcaggggagagccggctctcataaagatctagacactctagtcttagaagagaggccttattccaatgttctgtaaagaaatggtgacggatggggatcgcgccagatgcctgattgaacgtaccgatcatcgattcatgctctgatagcatattacttgtccacacctttatcccgtgttccatttgctctgtaacctaagaagtgcagcccttggctttttcttctttgccgccaagcaatagtanggactcaaagcttgattgtggagatcccaagagtggacaccgaggagcggcacttgttgggccagatgaaaagcttggaagttggggccccggcgagtgaggggcttaagagacaacgcagagtacccgtgtggaactcacacgttgttttgcggcatttgattggacggattggattctgcaatgttcacatcttgggtgggactccatggtgcccacaggtgactaacacatatgggggttccacccaagttcggtttgagcgccacaacccaaga

SEQ ID NO: 484621 - DNA, 455 bp, Homo sapiens
tgacgtgacatttcatgggggtttggattggatttccctaaggaggagtgatgctgagcatcttttcatatgcttacgggtcattggtatgtggtcttgggaaaaatgtctattcaagtccttggactattttaaaaatggggttattagagttatcgtggttgttgactggtaggagtttctttctatattcgggatattaatcccctatcagatatatgattggcaaatatcttctctaataccataaggttactttttcacttggtggatggtgtccttggaggtatagaagtttttagtttggaaatagtctaatttatcggttttaacttgggtggtcggtgctttgggggtcatatccaagaaatcctggccaaatccaacgttataaggtacttttacggtctttgagttgtctaagtctatatttctgtactcacctttctttatcc

SEQ ID NO: 484622 - DNA, 1126 bp, Homo sapiens
  misc_feature (171)..(171): n is a, c, g, or t
  misc_feature (400)..(400): n is a, c, g, or t
  misc_feature (663)..(663): n is a, c, g, or t
ggtcccttgcaacgtgacaggccgatgtgtgctctgtgctggtacgcctcatccctgcagcccaagggcactggctagtctgtctccgacacctgtgcctaatgaagcgtgctcatgatggctggatatcgatgacttgcatacgagcactctaggacctcggggcatacnatcgtgcacacacacttgtgtcgaactatcagccgaaaggacaacacgtgttgaatgccgatcttctaatgaccttacatgctactcgtgacccccagacctcttggaagcgagacttgtattcatcgcatagcgtctgccgctatcatgaagttcacatcgaccacgcgtctcgtctcaagacccgacaagccaacgagtcatcctgtgcaggcaggagcgtctaggngcgtccaaagactcgtgcgatatcaaccagtagtcggttgctgctatagcgacgaatagaattgaaaccgtgacattaaggccgatgcacaagaacacattgacaagaataggaacatgcagacaagatcaatgacaaagggtaacattcaagactgcggtgtgtagtgccagtaacggaggagtcgtgtcggaaacaagaccgaagaagtcaggtttgtcaattagctactgaagcaggtccgggctgaactcccttcgaanactcaagtcacagatgcgtccttggagtgggcttgcaacggaaccactttgaagggagaattcgaacgaatgcacgacggcttcatacgtgcattggctgtgggaacccagggatataccacggctggccgttggcttacgcgggcacagttttcggaaggaacgtgacctgaagcttacctgtgcatgcgttggagacttgcctaagtgacttttcgtggcacagggaacgacaccttgtgttccaggggatgaccgttctgcgtttttcatccagcccagatcagggcgaagaaccgcgggacacccatccttgggcgcttgcgcttactggtaagggacccggggggctctacaccggtgggcgttcaaccaacacccgtggggcagatccatctctccgcgagacggatgggggatccaccttcaccgcagggccggaagtccgggttggtcaagacca

SEQ ID NO: 484623 - DNA, 333 bp, Homo sapiens
tggctgtttcctatgatcaaacaacttccctgaggatcctcaacaattgtcatgctttcaacgtgaagtttgattattctcaggacaaagcagtgctctagggaggacccctggattgcacttactgcttgattcagtttcactttcactgaggttcactatcctggatcaaggttcagagcatactgtgcattaaatgaaatatgctgcagaacttcactatggttgactggaacaccaaatattgggattttgggaaagctgtgtagcaatcttgatggactggccgttctaggtatttatttagaaggttggaaacgctggacccgggcc

SEQ ID NO: 484624 - DNA, 326 bp, Homo sapiens
agtaaagttttagggtgaccccagggggacgtaatgtttccgagaagaaggacagaaaaaagactgggagaccccggaactcgaaaaaaaattgcatacagaaaggctgtacctggaggaaggaagtgcggagccagccttagttgggagaaaagctccaaaaatgtgaaaacagactaatacattgtttccaaaaaaaagaaaagaagaagaaggaactaaaaaagaatttttttggaagcaaaatatttggaagcaaaaaatttgggtcctggctgaaagggttttgatccatgcatacattaataaacccttcagaaccatga

SEQ ID NO: 484625 - DNA, 888 bp, Homo sapiens
gatctctctcggggggaagtcttcggacagacatgtgtgcgcatgcctggggatatcaatcgctaccgtaggagtacaactctagtgggtctgcagtgtccatgatactgcactacgagaacactagaggttctacaaaaccactttgtggagaacgtggccctgtacgatgtgacgaatggcgagcttgagcttccatggatagtcataaatgcacgaatatcgattgcatgaacactcatggggtccacatggaattggcgctaaacaataaacatggtgcgctcgacacatttatggggaccacatacgagtatcaactgcccagggggtcatggtcactggaaaccccattcgctgttgtacttccactgtcaatgtgagagggtgaaagtgatttgtccctgcgcgtgcgagtaaccccgttgatcacgtggcggggggaccactggtgtttccctttccacccctagttcttaagttccccagaagaaagttggtttcgcacttaggacggcgtctggttgttaacttcattacctatccgaaaggaaagggcctaaaaacaggtggaacacgctggagtcaaaagtcacttggccaaggaattgggtgtgcacccatcaaagtttggaaaagatgtccctttaaaaagaagttggggttatcaatcccctctgggtgagggagaccttggtgaaactaaatgtggatgccaaattgtaactcgaacgcgggtgaacaggtttcgagcgcgtcattaaataaaaccggttgctgggggcttctccgggagatgtgtcccattcccatagctgggctcatatgatgaaacctgcgttaaaaaacaaggtcgccgtattgacactcttagaattccaatattgg

SEQ ID NO: 484626 - DNA, 150 bp, Homo sapiens
agaggatcccgagcttacgagattacatcgtcttaatatttctgaagtttaaatacaatctgcatagtaatgttactataaatgtaaactttcagtgttgttttaaatttcaaaatcacactttttatttttgggtctttttgtcttttt

SEQ ID NO: 484627 - DNA, 1093 bp, Homo sapiens
actgagtcgtggggtgatagtgtgtgtggatcttcattttgtgtgatcacttgttgtgctgtgttcttcccgtgggtgacgtgggctcttttccctgggtgtcctctatcattgtgtgctgcttgtaagcggtgcgctgctagtgggtttcacgggtctccaccgtgtttaaccaagtgggacccgtgtgacacccgtgttagatctcactttcttataaaagtccgcaaggcatattttttaaaagggtgccacccttttgaaatccccagttccaagaacttctttccatggacttctgtaaattcccaacttggaattctgctccaacacttttattaggtcacccctgtagttatttaatggttcttctcacagaaacacgtaaatcatatattgtaccacgttaacgccccaaataattgtccaccttaataatcttccagacaccagggtaaaggtattctttagagattatggaattctgtgtaactattcccctatattaagttaaccatctgttataataaatgactttttcccatgggtacacttgtttggaaaatagtccacttgtttccaccctatgttaaatatgctcgcccacgtcaccacctataaatattgctataggaagaagtggttctctttgaacctcaaggctttctcagatttcaccactcccaagatgtgaatatttccatccaccaactataaacttctcggtgatattgaaatatttatattaacaccagctcacccaaagagttaccaaataccctaccagttcttgtatcttaatagagcccatctcttgatgtgtgggtttgcgccaattaatgtgcctcccctttattgagccctatgttaatttctctttagcctgctctcccccttaattgaaatagtgatgtagtaaatattccgaagcgatatttcttttgccatattttacctaacccaggaaacgggcccacaccccctggtttagggatgttcgtgatagcttaccttcccagttttttaagaaatagcttcctgccactgctgtcaacccctgtattgtctttaatgaaccctgttgtatccccca

SEQ ID NO: 484628 - DNA, 234 bp, Homo sapiens
tggctcacggaagtagaataaagagaatcctgggacccactcacccgggcaccagggaccaacaagcaactcgtttgggaccgttcactcctcgcaactatggaccaagaaaaagttataatgggaccttaaagctccaccttctttacttgttatctaaatgatgactggtataactgtctcccatccctttcgcttgtggcaggagatggcttaaataaataacttaaactt

SEQ ID NO: 484629 - DNA, 113 bp, Homo sapiens
tcaaagctacttcataacttcagtctcagtacattattccacaatatttagcttacgtggagctaaaagagcagaaattataccatatacatagagtgacagtcactctccca

SEQ ID NO: 484630 - DNA, 164 bp, Homo sapiens
gcataacgcgtcgattaaagccataacaaatttgatttgatcacatatacacattcacgtcatggcccactgaatctggttgcgggactattaaccagaatgcgaaaaggccagaattaccgaaaatgaatgacatcatgggctaagcgttttcccatcagaaa

SEQ ID NO: 484631 - DNA, 815 bp, Homo sapiens
ataataatgactctaaggcttttattaagaaaacagcagaaagattaaatcttgaattaagtctggggggaaatggccactgcagatggagtttagagtagtaatgaaattctacctagaatgcaaaatgggtatatgaattacatagcatgttgtgggattttttttaatgtgcagaagatcaagctacttggaaggagtgcctataatttgcagtagcagagattaagattattattcttatttattaggagaaataagtttagagtctaaggggagagggtggacagagtggggggggggttgagaagattagggggaccgtgagtagagaacgtttataaacttctttctctttaataaagactgtcttacaccgggctgccatgaaaggcagcgggttctagagtttcaggtcacctaagttgcaacccagcaaaagcaatatgaatatggagatcttcctttacccctcaactttaatctgccaggttataccgtcagtgtgtagcagtactgtgatacctggcacaggccttcgatcttacgatggcctctgtacttgaccggacggaagactaaagagtacctaccctttacgaagtagaattcatagcctggatggtggtccctggtcacatgtccttgtcactaatggtcaagtgccaacggctctgggcgcatgcggtacctagggatagattccacaggcgaaaccgaacagtctaccaaaaccctcacaaccgcaacacagaccctccattggcaccacccggcgccaacacatgcgacggcccgacgccccacacacaacc

SEQ ID NO: 484632 - DNA, 408 bp, Homo sapiens
  misc_feature (273)..(273): n is a, c, g, or t
gcgccccagagcccaattctaatctcgtataggcggccagcgaaaaaacccgctaccctaaacccgcaccatagaaacgacatgggtgggattattcccgtaccggcagttgtgcgggtaatcccaaccacgcttgggccggcttaggggccgcccgggtggcttttgggttgggttcgccgcgtgtgtgtgcctgagcggtggcttgtgccgctattggtatcggcacgccacgtcttcatattcatctgtcacacgcttagggtcgactgngcgagagagcggtaatcgaaagtgagagagtatgatgggtccagtatagaacacatgtgaaacatgatacacccataaagctgtacggcgtgtggcgcgccagggtatgaggggtgaagggggggtaaagagggt

SEQ ID NO: 484633 - DNA, 951 bp, Homo sapiens
agccgagatgctggctggaaaagctggtagaggagtttgagatgaaggaggacgagccgtggtacgaacacctaggacctccagcaagatcttcaacttgctgctgagcttggagaagacattactggatcggaacacagagttggatggactctgtgcagcgagatgtatacaaccaattcaggagcagtctacatggaatatcgaggtatctgacgaagcaagttggaacgttctactggctaggtatgacacgaacaagacagtgcaaatggtttatgacacgaagttacgacgatcagcaggcacagggaactggcaagagaacaaatgtcaacaagctagtttgcgtgacgagcaaggtgcctcaacacgtcgaaacagtattcgtgcagcctggaactgagcaacgagttggaatagccatgccaaaacgcaagcgagttagatcgagcactccaaagaggcctaaaggtgcgatggcaagcattggaaagtcaatctttggccgaatggtgcacgaaaggaagcccgagggaaatgtggtcgacactaagtggaggaagatcctgagctagcctcgagggtcatatgttgcagatgtcagtggacacggaaagaccgattaagggggattggaaacactttagggaaaacgtcagaccccgaattgtccaaaccaggggggacatacaccccgagaagcatacaagaccaaaatagaagaacgagagattcagagtgttcacactgaaggggaagaataatagtggcagatattttgaaaacaattttagtggagaaaaaaagctattttcgcacagaagaagagtattatacgaggggcagatatataggaggaaattttagggatcagacgaaggtaagagaggaacagagagtgatattaagggtggagaaacatagagtgatgagtagaaaaaaagtaag

SEQ ID NO: 484634 - DNA, 287 bp, Homo sapiens
gcatcaacggcgtccatctcagatcttccccgaaccccaacacgcccagccaacagtgggactaccagcatgcaccacacacctggctaattttaaagtttttggtagagatgaggatttgtcgtgttggccaggctggtctcaaactcctgaactcaagtgatccgcctgccttggcctcccaaagtgctgtgactacaggtgtgagccaccgcacccggccccaacaaattcttaacatctacatttattttcttcttttccttttttgtagacaaagggaaaca

SEQ ID NO: 484635 - DNA, 625 bp, Homo sapiens
  misc_feature (409)..(409): n is a, c, g, or t
accttatcctatagatcagtgatctttgatgttatatagaaccaggtgtgccacaaagcatacccatataggatggcacacttaatcaattaatgttgaatgtgttctgactaatccaacaaccagccgtttccctgtctctctccctctcctagggcttccctattccaagacacagtaatactgcaatgaggccaattaataaacctacagtgcacaataagtgttcaagtaaaaggaaaagatgcatgtctctcactttaaatcaaaagctagaaatgattaagcttagtgaagaaggcacaggaaaagccaagataggttgaaagctaagtctctcatactgagcagccaaggtacgaatgcaaaggaaaagttcttgaaggatattaaaaatgccattccaggnaaccacaaatgaaaagaaaggtaaacacccttattgctgatatagaagttttggtggtctgggtagatcaaactagccacaacattcccatgggtgaaagcccaatccagagcaaggccctaattctctccatttctataaaagctgagaaaggtgaggaaactgcaaaagaaaagtcggaagttacaagaggttcgttcatgagattgcggaaga

SEQ ID NO: 484636 - DNA, 499 bp, Homo sapiens
tgtacaaggaaggatggagctgagttcgtcgaagtggcgttgtgtgctgaagattggggaacacacccgctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctgc

SEQ ID NO: 484637 - DNA, 359 bp, Homo sapiens
atgtctaagtaaaaacatgaattagattcaccatacattgaaaacatccaggtactacaggcagaattagttatacaatagtctaagtcctagaaatatcactccctatcccagccctagcaaattctaactttacatttgacatacggcattaacatcaattaaagcctcagtttaataatcagaatttaacatgaagtctcctgaagcacctctcttctgttgtttaaaaaaacacgtctcagactctgggaaaacattcagcacccacttctagctattactgaaataaatgattagaaagttacgttggtgagccgaagtaaaacctaaagctatcccctgaatctttctagcaa

SEQ ID NO: 484638 - DNA, 422 bp, Homo sapiens
ctggcttgaacaagtacatttagtgtgagctgcacacatctgggctctaaatgaattacaggtacagatgtatgctgaggtggagtatgcgtgatagagactgtgagtcacttaattccaactcagtgataaaccactgacattagggttgaatacggagaagttcccttgaatggtagcttcattggttattttaaccttacaggggagttcgtttggacttaagtgagtagcttgtcccctttttgctgacagaaagaagagcaggagaagagagaaacgaagatgaaataaataagttgtgttccacactgtaagggaaatgcagtgctctatttagcctaggcgggacaatacttgaattgaacattgaaactaaggggggactccctaatctttgggtggcttgcctttaaaaaaaa

SEQ ID NO: 484639 - DNA, 343 bp, Homo sapiens
ctcacactgagctccttgctgcacctctgatctctactatggtggatagatctagactaatcctcaggtgacaacgccaatgacgtggttattgactgtgcccaccctgatgggctctctagacctgaggtgttattaccatttcattctgacgtcttatttgtcggacattaatagagcatgtaaatggaatcaccaggcttagcagtacccatttgattagcatgaatgataggcctctgcatctggaagatgtctgcacgctgcaccgtacctgtgagagttgagtgctgaatgatgtcatatgccagaagcccctccataacatctcattgccaatgct

SEQ ID NO: 484640 - DNA, 969 bp, Homo sapiens
gacaacggaaaaagcataaatcgatggattggtggacgtcatgtctcccagtgatgaggcacgacatgtgggaagcacacgtgtgagatacaccaagatatgtcatataggcgtctgagatgagatgaatcgcacgtgtcacttgcccagtgcttggtgcaggtcgtagaccagagaagacagagtttgactttgaacgccaggactgtgtgagaatccgagtcgaggacgcacatcatccaagcccgtctccacaaaaaataaaaaaaattagccaggcatggtggcgcacgccatgtaggtcagctactctgggggctgaggtggggagcgattgcttgagcctgggaggtcgaggctgcagtgagccatgattgcccatgtactccagcctgtggtgaccaagcaagaccctctcttggaagaaatagaccgtttggtacagactggggttgttgactactttggcccacgcaggtcttcaaacccctgggttgcacaaaatcgtcctgacctcaggactgcgcacggcttgggattacaggcatgacaatttgatccgtggccgccatatttttggcaagactagtatggtgagcttgtgaaattcaataaaattcacattgtcccaggttcatcaatagagggtattgttcatgaacccaggaacgccaagtggcttaagttgtaaccccggtatcggttcaaggaagcgaccttattatttaaaggatgtgtactgcggaaagtgaaatataacacgtgagctttgtcaaataagtgcacgccagtgggtgccaatggaatcccacatcggaagcagggtgggtcaccctggatcggttgacccggccaactgtgacacgtttgtaaaaaaataggcgggaccgtaccaggggccgcaatcaacaaagagagagaaaagaggaaggatcacaaaaaaagtcgctgacacggcgtatacaggct

SEQ ID NO: 484641 - DNA, 126 bp, Homo sapiens
cgaaagcagaaatgatgcggcgacagcaggaaggatacaagggaaccttccctgctagcggtatatctaccacatgtagcacgtgatgtaccagtaccagtcctgataaaactacaccatgaatag

SEQ ID NO: 484642 - DNA, 243 bp, Homo sapiens
  misc_feature (171)..(171): n is a, c, g, or t
ccgaacatgacattgaggcagggtcttactgtgtcaccaggcaggcggagtgcagtggcataatcacggctcactgcagcctggacctcctggggctcaggtgattctcttacctcagcctcccaagtagctgggactacaggcatgtgccaccacacccggctaattttngtattttttgtagagacgaggtctcgccatgttggccaggctggtctggcactcctgacctcaggtgatcca

SEQ ID NO: 484643 - DNA, 603 bp, Homo sapiens
  misc_feature (164)..(165): n is a, c, g, or t
  misc_feature (190)..(190): n is a, c, g, or t
gaaaatttgaatttgtattgaattaagaagagagggacatgtgttattgaaggaggccaaacacagtgtaaatatcccagctcctcccccgtgcccccatcccaaatgatcttgagatttcttttaaagaagtaaatttgtccaagggctgtaaactataaacnnctgtaattaagtgcaatttcccctnggtgtcctctcccctctgcccggtatataaaaataaagggtctattagttttttttgtaaaggtcagagtcaaaatttcaaaagtgattggtcccctctcccctcatggagaaacatcctaagtgggaagtgaagccccttgtcctttcccgggggcttggacacttatggggacagcatcccttggattgactaccagctaactccagtttcctgacattaagacacacctttggatccctggggggggttgaatgtagtgggtcagagtaacatgccagcttcctgggggccaggagttcacccgggcactccctaagaaaccccagggcagggaaacgggttgtttgatagcaaaagaaaaagttgcagtttcagaaagccttccattaaaacaatttattttatcccta

SEQ ID NO: 484644 - DNA, 323 bp, Homo sapiens
cgttcccctgcccgccttctccgccaccgccgccgccgccttccgcagccgtttccaccgaggaaaaggaatcgtatcgtatgtccgctatccagaactcactctttcgaccctttgctgatgcagtaagggtgacgacctgcttctgctggcactgaggattatatcatataagatcacagagaacgcagagacctactactgtcaggatcgtgatgattacataaaagaactagtgaaggcttagaaagttgctgcatgtactgtatgagcatcgatatgagagtaattcagctacagggtacaacgagacatatccattc

SEQ ID NO: 484645 - DNA, 152 bp, Homo sapiens
ctactgcattggtaagtatcagaatagaggttatcacgcaaagcccccgtcgtcacaaatccaaagtacttccgataagtatcgtagaatcgcatatcccgtgcactgcgaatacgttggaaggcgaccaaatctggatcgttctcttcacg

SEQ ID NO: 484646 - DNA, 637 bp, Homo sapiens
ttgcggagccatggagggcggcttcggctccgatttcgggggctccggcagcgggaagctggacccaggtctcataatggagcaggtgaaagtgcagatcgcgtggcaacgcgcaggagctgctgcagaggatgactggacaagtgtttccgtgaagtgtatagggaaacctgggggctccctggacaactccgagcagaagtgcatcgccatgtgcatggaccgctacatggacgcctggaacaaccgtgtctcgcgccctaacaactcgcggctgcagcgggaacgagccaacatgtgaccggcgagcgcgggccacccaccctgttcatttccataaacgtgctttgagaggcggggtccgcatgtacgtacgtgcctggccccggggggcttaaggacgggggtgggccacccgggggtgccttgggaaccagcaccgggactggtgtcctcgccaagcgcccggcctgtcccccgtgcagccagtgcagctgtggatctcgggggtggggggcccttgtgccttcctgaagttgctggcaagccaggtggcagctccttcaggcctttgggggtattcccctagtgtgcccaagtcagcctcatattctgggcggacagtgtgtctggactt

SEQ ID NO: 484647 - DNA, 275 bp, Homo sapiens
tgcttatcacacatgcagtcaatgaacccctcacaaatgcaaggttcacatgcagttttcgatgaacacatcgttcgcatccagcagtatgtttgtattggaaaagtccttccatagcccccagtaatgaaaaggaatgtggcggggagcagtactggccagtaaaactaaaaaccccaggaagatcccagtgagatcagcagagccctagaatggcaaatccatgacaaaaaaaatttttgatgaataaaaacgggcctgggtccaggccagca

SEQ ID NO: 484648 - DNA, 928 bp, Homo sapiens
  misc_feature (29)..(29): n is a, c, g, or t
  misc_feature (85)..(85): n is a, c, g, or t
  misc_feature (92)..(92): n is a, c, g, or t
  misc_feature (114)..(114): n is a, c, g, or t
  misc_feature (127)..(127): n is a, c, g, or t
  misc_feature (131)..(131): n is a, c, g, or t
  misc_feature (135)..(135): n is a, c, g, or t
  misc_feature (156)..(156): n is a, c, g, or t
  misc_feature (175)..(175): n is a, c, g, or t
  misc_feature (200)..(200): n is a, c, g, or t
  misc_feature (232)..(232): n is a, c, g, or t
  misc_feature (248)..(248): n is a, c, g, or t
  misc_feature (257)..(257): n is a, c, g, or t
  misc_feature (294)..(294): n is a, c, g, or t
  misc_feature (299)..(299): n is a, c, g, or t
  misc_feature (314)..(314): n is a, c, g, or t
  misc_feature (332)..(332): n is a, c, g, or t
  misc_feature (413)..(413): n is a, c, g, or t
  misc_feature (450)..(450): n is a, c, g, or t
  misc_feature (462)..(462): n is a, c, g, or t
  misc_feature (489)..(489): n is a, c, g, or t
  misc_feature (563)..(563): n is a, c, g, or t
  misc_feature (587)..(587): n is a, c, g, or t
  misc_feature (592)..(592): n is a, c, g, or t
  misc_feature (814)..(814): n is a, c, g, or t
  misc_feature (821)..(821): n is a, c, g, or t
  misc_feature (823)..(823): n is a, c, g, or t
  misc_feature (829)..(829): n is a, c, g, or t
  misc_feature (832)..(833): n is a, c, g, or t
  misc_feature (844)..(845): n is a, c, g, or t
  misc_feature (850)..(852): n is a, c, g, or t
  misc_feature (856)..(856): n is a, c, g, or t
  misc_feature (858)..(858): n is a, c, g, or t
  misc_feature (865)..(865): n is a, c, g, or t
  misc_feature (869)..(869): n is a, c, g, or t
  misc_feature (872)..(873): n is a, c, g, or t
  misc_feature (875)..(875): n is a, c, g, or t
  misc_feature (895)..(896): n is a, c, g, or t
  misc_feature (898)..(898): n is a, c, g, or t
  misc_feature (909)..(909): n is a, c, g, or t
tcaggagcttctggggtgcctgtaggagnaaggccacagggcatggatcagcccaactgcttctcaagtgaactgtatagccaantcttaancttctcacggggcaagcctaanacagacccccttnagangctnaggcatactttttccatcccnattccactcttcggttttnacacgtcccttgcaaagtctccgcnggtgctgtgaagagccttccatggtagagatntctcttaagagtgtgntttctcatngggctagtaagggagattgtatacctgttgtcaacantcttnaggcagctccccagntctctgaaccccaaagtntcatcattggaaagagcagtaactgcgagagatggtggaggccgctaagcatggaagaggctagaggaagtctatcaacangcagttgtgttcccagcaattcctcccatcctgcatngttcacaccaanagaaccttcagatcctaccagcaaccntagcaccttccacccagggactcccagaagccagtaaagagaccaggagccacctcaatcagcagtgtttgcangggaggtgtttctgcctgtccctncctgntgtccctggtggagcaggtactccgggcgggcaagcctctgatttgcacacctgaaaatcgcggaattgagtttcgatagattgatttttaaaacttttttggagtagggggtataggggaatcatttaatttaaatcattaagattcccctgctcaaacccagattcctgtgtacagatgctatttagagggaatcagaaaaatgccaagccttttctctntgaatgngntatttntannactgaacttgnncatannnatananagagacncatnttnntntactaactggataaaaaaanntnaaataaaatgnagtgagataattttaggta

SEQ ID NO: 484649 - DNA, 323 bp, Homo sapiens
aatagcattagaaataagtgattaaaggcctctgctcacaacatggcaagtacagtactttgaattttagcacattgcatagtagtttaagtatgtctaatttaaacgtataatatgtacatcctgagacatcatgtacagaagatttttggtgtaatttgtatatggatatcttttacatattgtttagggaatgaattgaaggtacatgctggatagtgacatgaggcagcacgtgcacaatcatgtgccggcttatctgagttttcggtataaatatgtagataatggattttttttttttagataatgttgtcaagacc

SEQ ID NO: 484650 - DNA, 442 bp, Homo sapiens
ggaattcatgatcaaaaccgcgccgtaggaagggcctcagtgaagatgtgagcatcagcaaattcgttcagatgatcctatgttactggaacttgccaaacaggatgttgtgctcgaatgacccacatgtgagtgcgtggactcctgtgagctcctgctccctacagtgggctgcaactccagtatttgaagctgagacctcatatgacgtggccttcgtgttgtcagagagtgtctggaagatgctggtgccatcttgaagcaacgtgcacctatagcctgctcaagcttcagagccctcagtgagagaggagcatttggcctcgtggcttccttctgtggcctttaccgggctccattcccaaggtaaagagaggtgcttgggctcacagaaagagaaggggatgaacccaaggccctatcttagaatcactggatttta

SEQ ID NO: 484651 - DNA, 227 bp, Homo sapiens
attaaggctgcgattgccgctgttatctttttcaggacattttggtaatatagtattactgatccgtttgctgtgggccctatgttatttacatgtgtcaagtgggtcgtgtgttcgcagcttgaattcaaagatttcctttgcattcagagtaagattcagacagcagtactgtatgccgtgctcatgagccaatttgtacgtattaaagcaatttcggtgtgcat

SEQ ID NO: 484652 - DNA, 432 bp, Homo sapiens
aagatcatgccactgcactccagcctgggtgacagagcaatcctctgtctcaaacaaacaaacaaaacaaatttgtgtgtacctcacaacaaagcttcaaaatacatgaaacaaaaattggcaaaaccaaagagagaaagaggcaaaaccacaatcatagttgaatataacacctctatcactaattgacagaacttgtgaagaaaaaaaacgtcagtaaggatataaaagattggaacaccactatcaaccaacttgatccttggcatttatgaagcactacacatcactacagaatttgaaaaacagcaaaatggcagatgttagtccctccttattagtaattactataagtacaacaggattaatttactaactaaaatgtagacactggcagaatggttaaaaaaaacaagcaaaaattccaatgat

SEQ ID NO: 484653 - DNA, 307 bp, Homo sapiens
ggggggagtttttttttctccccattcccccccccccccctttttttcggggggggggggcggggtcccccccgttttttttccccggcccccttttgttttgtggggaaggggggggtttttttccccccgcccgggggcccccccccggggggggggggtttttttgggggcccccctggtttttttttttggggggggggcgttttttttttttgtttttttttccgccgctttttttgggggcccccccgccccccatttttgcccccgttttttgggccccctttaagggttttttggggga

SEQ ID NO: 484654 - DNA, 288 bp, Homo sapiens
  misc_feature (166)..(166): n is a, c, g, or t
tcgtcagcatcaaaaaaaaaagccctcagaaaatttctcacaaattaagggcaactaatggccggatatctcaaaatcctttacaaaagggagatagttctagtcaaggagtttggggtatgtaacttttttttcttctttttcttttcatcggcctccatcttangtgcaatttcttcagcggtaagagctcccagtttcttaattctgggctttcttaaccttttcctggatgcgggacggaggggtcacggagctcggaaatccggtaaatctatgggtctataa

SEQ ID NO: 484655 - DNA, 215 bp, Homo sapiens
  misc_feature (6)..(6): n is a, c, g, or t
cctacnttcaccttgcttgcccttctgccttccccatgtgaggatacagtgttcctcccctccggaggatgcagcaacatagcaccatcttggaagcagatggcagccctcaccagacaactaaacctgccaacaccttgatcttggacttctcagcctccagaactaaataaaatttagcttatgagaaataaagttccattctttgtaaatta

SEQ ID NO: 484656 - DNA, 672 bp, Homo sapiens
  misc_feature (367)..(367): n is a, c, g, or t
  misc_feature (454)..(454): n is a, c, g, or t
  misc_feature (483)..(483): n is a, c, g, or t
  misc_feature (613)..(613): n is a, c, g, or t
  misc_feature (619)..(619): n is a, c, g, or t
  misc_feature (629)..(629): n is a, c, g, or t
  misc_feature (631)..(631): n is a, c, g, or t
  misc_feature (636)..(636): n is a, c, g, or t
gaaggcgctggcgggcagtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggctgctggtggctctggtgctgctgggggcctaccggctgtgggtgcgctgggggcggcggggtctgggggccggggccggggcgggcgaggagagccccgccactctctgcctcgcatgaagaagcgggacttcagcttggagcagctgcgccagtacgacggctcccgaanccgcgcatcctgtcgcggtcaatgggaaagtcttcgacgtgaccaaaggcagcaagttctacggcccggcgggtccatatggaatanttgctggtagggatgcctccagaggactnggccacattttgcctagataaagatgcacttagagatgaatatgatgatctctcagatttgaatgcagtacaaatggagagtgttcgagaatgggaaatgcagtttaaagaaaaatatgattatgtaggnagactncttaaaccangngaagnaccatcagaatatatcagagtgagagagagagtacc

SEQ ID NO: 484657 - DNA, 1185 bp, Homo sapiens
gaaggcgctggcgggcagtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggctgctggtggctctggtgctgctgggggcctacctgcctgcgcacctggtggccctggcctgacaggcctgtccaccgcgtgcctggggccgcctgagcttgatgcgcggaagtgtgctgggcaatgatgcctggctggtgtcttggacgatgcatgtgacttgtgtgtcagacaggggcccaagggaccggtgctgctgacaacgcgtagcttgtgctgcttgcaccaggcactgtgcgcaactccgggtgggccctttcgatgagagcaaagttttaaggaatgggagcctgggcccttgaacttggcatgggttgcaagggaacaagccaaatgggagacacaggggaacgccccttctccaaggaaagccacgacaaggtcgacaggtcggggggccgccctaaaggattcaaagcggaggcaggtgccccatggcccgttgggccttgtacccaaccagttccaccatggatgtgggggctccaatgagttcccgcccagttgaacttctccttacgagttccgttctttttatggtggttctctcggcaccatgacagacccccaccgtgcgcttcaaccccttctagttttcccaaaacctgtggacccacgaagcctgcctttagagacggccgggagccgcaaggaaacttggcccaaggtcccccgccccagttggtcgatggccccctttgaaatccctttaggttaaggccagcggaaacagatttttgccatgggcgtggggcccagcttccgatttgctccctccgaacagcaagggaatttgcccaaagagccagagggttttccagcctttctcagcttaaccccaaggggacgggacagcttaaggccagaagccaggtttcccgggccccgcttccttccacggtacgccttccttaattagagacgccagcaactctaaatcggccttcgcgtgttacacccacgaaaagaacgggttggcggtggagcca

SEQ ID NO: 484658 - DNA, 519 bp, Homo sapiens
ggaggataggggcgtgagttaatgacacaggaatgctcgtatggaaattgactacggcagtcatgggtagtgagagctgcagagtaggaagcagatttagttgatgaacaagtatattcaaggggggcaacttgtattttcaaatgcagtgtagagctagatgaaaagcaaatctttgacatctactctgcccttgaggcaaagtcaccttgaacaaagaatcttaagggtttattaagaactctttattttcttcataccctgttctctgcagtgctttctaacagctactgggtgcagattttcttcggcatcctttggcactcagcttatgacaggtaggtagtgcttaagaaaagtcatggaggactaaagcctaagtccttttcacttttcctccatctgaaggtaggtgagttcatcctcttcatagtaatgctgttttaccaagactttatagcagatggacccagaaagaatttctgctattgtgttcactacaacaggatagggacatca

SEQ ID NO: 484659 - DNA, 342 bp, Homo sapiens
tgagcgagatctcagtgctggataatcctggatcgctccgtggcttttctatatacacgacggtgcctggctcctttttcaaggcctggcggctcggagaggcccggacaggcggcatggggtgcggggaagtgcaggacaacaagaccgctcaccaagatggaggttgcgctgacaaacgaaaaatgtgactctaactctacggaatctggaggtaccgccgcctcgacgactgcgtggagaggaaccgcactcaggtaagttccgcgccaggatgcaggacacatttctcaaccaaaacctgactgcctaacgggggcaaaatagataagtaaacggact

SEQ ID NO: 484660 - DNA, 306 bp, Homo sapiens
  misc_feature (34)..(34): n is a, c, g, or t
  misc_feature (132)..(132): n is a, c, g, or t
  misc_feature (136)..(136): n is a, c, g, or t
  misc_feature (186)..(186): n is a, c, g, or t
  misc_feature (230)..(230): n is a, c, g, or t
  misc_feature (238)..(238): n is a, c, g, or t
cgttcgggcaaagcgggcgtagacctgggctatnctcagttaggggttgcgggatccccgacgtgtgggcgggactgggacaccctttggcctctgtttgtccctttccagtcctccaccccacccctgganccanctgggagcgcaaaaccaagaagcggcagaacgcacctccggctcgcgacngcgaccgttgtgcacacagggacgccgcgctatctgcacggganagggacangctagatttcgtgtacaaactgtgtaccctctatatatatgttcatagaatgtatatatgttgggaac

SEQ ID NO: 484661 - DNA, 123 bp, Homo sapiens
gaggtcggatgtagaaaggttcttagagacaaagtcaggtattctgagtgggctagtggtctatactctgtggacatgtattttgtggtgtcttctgcctctagctaataataagtatcacag

SEQ ID NO: 484662 - DNA, 274 bp, Homo sapiens
tcttgcctactccccctgaaaaatctaaaatcatcgaaagatcattcaaggcaaggatgtgcactgactgatcaagcatggacagagcccatttcccatcagcgtcctcggaaagtgaggagtgtctcagcagttaatctgaggacccaaggacagtgcctgactgaatggcaggcgctcatagggtcatgtaaggatcaagaagtagactcaagctttacccaaaactattctttcccataattaccccaaaaagtgtcaaccaaggcctttt

SEQ ID NO: 484663 - DNA, 958 bp, Homo sapiens
ggatcaatggtctgctcaaggaagagaatgtcagagtgcgcggggcaagaggaatacttgctcgtggcgcagtcactatgtaatggaggtactgtaaccctcccgacaatattggaatgttctgagtcttcgaatagggcttataggacacaggtaggtcctgatcagacggatttcgaggtcaatctgcactgggatgaacagagaatgctggtctccaatgtgcggctgagtgagtgtggaggcggagtgtggatgctatggagaataggaacgatatgtgggtgacgtagtgatatcagtgtagttctagagaagcatatttggctgaagatgacagttttcaggcgagtggtctgcggagttcgtataatgacatgaggaaggaggtgctcctagtttgacatgatgggaaagggtggatcgtgtttacctagggtattatcttgattcgtactggaagtgtgaggtctggaaacctttggtagtgatatgaactggaaatggcgaagccaaagtggcattcatgaaaataatgtcatgtctataaaatcatgggtgaggggtcgacgaaggtcaattttggcagcccctgaatattggggtgaattgccgatgtgttggctcagtatggagaatgggtaaggatctgattatgggaagtgcgtgtcagtcaagagtcctgtaggaatttgtagttgtttcgcagtgtgagtaataagtgtagttcaaaagtaaaggatggtgtccagaatctaaaagttggttgaaagttgttggtgttaagccagaatatgtgaagggcattttgactgtgatcggaaaggggttcgaatggatggaaatttacaaaagagtggccaaacttctttggagaatatagagagaggacatcagaactggaggggattgaaatgacgcaaatttggcgggaaacatataaagggggagtgtataa

SEQ ID NO: 484664 - DNA, 727 bp, Homo sapiens
tgcggtggctcacgcctgtaatcccagcacttatgggaggccgaggcaggcagatcatgaggtcaagagatcgagaccatcctggccaacatgatgaaaccctgtctctactaaaaatacaaacaattagctgggcatggtggcatgcgcctatagtcccagctactcgggaggctgaggcaggagaatcacttgaatccgggaggcggaggttgcagtgagccaaaattgcaccattgcactccagcctggacaacagagagagattctgtctcaaaaagaaaaaagatatatatttccatggttacttcccagtactcagtttctggaagggtactagccccattcttcagggctcttacctcccaaagactccacctcatgtcataaacttggggcacttacgcatttcaacataggacatggcttaggggaccacaaaccttcaggcgacagcagaggctgctacatatggaaacacgcgatatctggctctgggagggtagccaaagatgccccgaggctgtggtttacaacccgtaccctctaagctgggaacgtcagaatcgagacctgcaaaaatacactgaccctacaagggaagtccagtcaatccataccagacagaaaataatactgacatggcccaaccctgcgccaaagcccaggctggggaaaaacctgataaagaacaccacaccgggccagactcaaatgcaccacgcac

SEQ ID NO: 484665 - DNA, 787 bp, Homo sapiens
  misc_feature (9)..(9): n is a, c, g, or t
  misc_feature (177)..(179): n is a, c, g, or t
  misc_feature (189)..(189): n is a, c, g, or t
  misc_feature (197)..(197): n is a, c, g, or t
  misc_feature (212)..(212): n is a, c, g, or t
  misc_feature (255)..(255): n is a, c, g, or t
  misc_feature (259)..(265): n is a, c, g, or t
  misc_feature (292)..(292): n is a, c, g, or t
  misc_feature (299)..(299): n is a, c, g, or t
  misc_feature (305)..(305): n is a, c, g, or t
  misc_feature (319)..(319): n is a, c, g, or t
  misc_feature (330)..(330): n is a, c, g, or t
  misc_feature (359)..(359): n is a, c, g, or t
  misc_feature (372)..(372): n is a, c, g, or t
  misc_feature (393)..(393): n is a, c, g, or t
  misc_feature (424)..(424): n is a, c, g, or t
  misc_feature (471)..(471): n is a, c, g, or t
  misc_feature (501)..(501): n is a, c, g, or t
  misc_feature (510)..(510): n is a, c, g, or t
  misc_feature (515)..(515): n is a, c, g, or t
  misc_feature (520)..(520): n is a, c, g, or t
  misc_feature (539)..(539): n is a, c, g, or t
  misc_feature (541)..(541): n is a, c, g, or t
  misc_feature (554)..(554): n is a, c, g, or t
  misc_feature (588)..(588): n is a, c, g, or t
  misc_feature (607)..(607): n is a, c, g, or t
  misc_feature (618)..(618): n is a, c, g, or t
gaggggtcnttacatgaatatgcttcatttaagtacatgctttcgggctgatttaaaaagaaaagttgaattatggtttccagagctttaggagtccatcttcactgtaggtagcaatcaggttctgatgagggtgatgtgcaataccaatcacatccttctcgtgcactgtcaaannnctctccagtntgccagcnactgtactgaaacantagagcacaaagtcctcccctacacagtagatccattcaccangggnnnnnnnggggcagcaaacaaagtccccaccttntcttttnccaganctggggcgttctgncaatctttacngtgccatcagggggtgcactaataatgtnatgtccatcttgngtaaatgttgcttcgttaacnggggggggttggccacgaaattccttcaggnttttcccagattttaaaccatgaattctaattgtctggtcaaaagangccctaaggatctgactgctatccttaganaagcttagncaggnggganccttactgtgtgccctctnanatctccttaaacnttgtccactctggatcttccacaccttggttttncgcatcttgggccccagtngctaacatttntgtatctctgctgaaacacatgcagaggacagcatcatccatcatcataaagttatcttgggcctggtacttaagatcctttctgatttttccagtagtaaagttccatacttcaatgaatccatcaacagacccagtgaccaaatactgggcatctggggaaaatcgg

SEQ ID NO: 484666 - DNA, 406 bp, Homo sapiens
  misc_feature (50)..(50): n is a, c, g, or t
  misc_feature (263)..(263): n is a, c, g, or t
  misc_feature (267)..(267): n is a, c, g, or t
  misc_feature (270)..(270): n is a, c, g, or t
  misc_feature (277)..(277): n is a, c, g, or t
  misc_feature (282)..(282): n is a, c, g, or t
  misc_feature (399)..(399): n is a, c, g, or t
caggcccatcatctcaaggtaacggcacattcttattaccacatgcattngtccatttctgcactgctataaagaatacatggaactgggtaatttataaagaaaagaggtttaattggctgacagttctgcaggctgtacgggaagcataacagcttctgcttctggggagacctcaggaaacttacaatcgtggcggaaagaaaaggggaggtaggcacatcttacatggctgaggcgggagaatctcttgaacccggaangcangangttgcangtganctgagatcgcaccactgcactccagcctgggcaacagagcgagactctgtcacacaaacacacacacacacacaaagaaataccatatcaggcagaaaagatgcctgaggatgtctnaaggacc

SEQ ID NO: 484667 - DNA, 371 bp, Homo sapiens
gacatgtgtccagatcagggctgattggagcgtggaggagcagctggccagcttcgctgcgagatggagcagcagaaccaggaatacaaaatcctgctggatgtgaagacgcggctggagcaggagattgccagctactgctacctgctggagggagaggatgcccacctgactcagtacacgaaagaaccggtgaccaccctgtcgggtgcgtaccacttgtggacagaggtccagtgatggcaatggtcatctcctccgtgcgagcagtgtcacctagaccaccctggtgaggactcagctaccccgtgctgtccacccatggaggcagggaggcagccgcccacatctgccccacagtctcggggcct

SEQ ID NO: 484668 - DNA, 262 bp, Homo sapiens
ttaacagaggattatgatgcgactgtgcagctgctcttcgtagttagagatatgctaggcagaatactaatgatgatctatagcccgtgaccgcgatttatgagaatgactgcgccggtcaagcttcaggcggtttggatgagaactggctgttactaccagggctatgtggctgattgaagagtatgcaatgagcgattttaggtctagtttgtcgtaggcagatcgacgcttgttatatttatgcctccccgggatacag

SEQ ID NO: 484669 - DNA, 286 bp, Homo sapiens
tcttaattgcttcagtgttataataattgcgtcttaaagaaaagactgagatttttgatcagaaatacttgaagaagatggaattaggaagtatcttgaggacagagaccacagatgcagaattcatacactatccttcaacaaaaagaatgacaataaggatcagaaatctagacacacttcagagacatggagaagaagttttaaatagacaccaaatatgaatatacttgcatatatggtggatttttttaattattaaaaattctactgagctaaaaagaaa

SEQ ID NO: 484670 - DNA, 867 bp, Homo sapiens
  misc_feature (566)..(566): n is a, c, g, or t
  misc_feature (568)..(568): n is a, c, g, or t
  misc_feature (574)..(574): n is a, c, g, or t
  misc_feature (594)..(594): n is a, c, g, or t
  misc_feature (625)..(625): n is a, c, g, or t
gctccgtatttgcagttacggttcagattgggagtcccagaaattaaatcggtctcaggaaaaaagatcccagagaagcagagaaaatgatttaaaccagaatggtttggatttcctcttgatgttgtagctaaggggattttaaggccctgcatgaccctcgtttgactctaggcagagttccgggattatcctccagtgctgagacaggccgtctccctggcccgggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaatngngctggnttcctcaagatcgacacggnctccctgggggacagcactgactcatatatngaagtccttgatggttcccgtgtccaccctgtagacttatgagtgggctaggacagatggctgtggatgccctggagatacgagtgcaatcagtccgaggatggcaatcctgcaggagcccttggaagaaatcttggtgaaaccagagcgactgaaagactgggccttgatgcctgggagaagaagctggagaggcggtatggtgacaaacattcactcttgactcgggagaagggtgcgat

SEQ ID NO: 484671 - DNA, 765 bp, Homo sapiens
  misc_feature (464)..(464): n is a, c, g, or t
  misc_feature (466)..(466): n is a, c, g, or t
  misc_feature (472)..(472): n is a, c, g, or t
  misc_feature (492)..(492): n is a, c, g, or t
  misc_feature (523)..(523): n is a, c, g, or t
ctgtcatctattggggtagagctggttgacaacgagttggccattctctatatgaacagcaagaagtcagaggcagagttccgggattatcctccagtgctgagacaggccgtctccctggcccgggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaatngngctggnttcctcaagatcgacacggnctccctgggggacagcactgactcatatatngaagtccttgatggttcccgtgtccaccctgtagacttatgagtgggctaggacagatggctgtggatgccctggagatacgagtgcaatcagtccgaggatggcaatcctgcaggagcccttggaagaaatcttggtgaaaccagagcgactgaaagactgggccttgatgcctgggagaagaagctggagaggcggtatggtgacaaacattcactcttgactcgggagaagggtgcgat

SEQ ID NO: 484672 - DNA, 1610 bp, Homo sapiens
  misc_feature (120)..(120): n is a, c, g, or t
ggcgaccaatgtctttcctccccagagaaccacacatatgttagcccacccattggcccgccatttttggggggcgccacccatctgtattggacacacccaacgggtgttgttcgcacncagaaagacacacaccagaaggcgtcgtgtggtgtcaccaccgccgtcccttcccaggagatatttttctccccccgggggtaatatctcttgttgggcagcacgaccacaaacagagacggtgctgcggcagacacaaggacagtgctgccggcggttgttttttccacggggccgacaggagatgatccacaccaccggtggctcctctttttgtggcagacacaccacactgttgtggcgccccccccatcccccgctgcgagtttgtgggcagactcgttgggtctctgtgttagtaaggccccccccccacgcctctgtgttcgctcacaaaataggagagagtgttgtgcacacaagaagaggcggcgcgagtgggtgcgccacaaccacacagaggggggggttcgtagaaacacacaccaacacccgccggcggccccccccccgtagagtgagaaggcctgcccccccaccacgagtaccgtttgtatagtcggccgccccccgcggcggctaaaaacgtcaaccaacaaggaggaggggctgagctccagtcagatattgttagtagccccacaacggcaagccgctacaccagccgctcttctcgtgggggtggtcccaccacatctctccgcgcgcacccaactcttgttgtggtgcgcgtctgttgccgccacaccacaccgcggctgtgtcgggggggagaccacacaccacaccccacaagaggagtgttgtcggctgcgcctccccgccgcgctacgcgccgcgctgttttctctcgaccctcctctcgtagagaggagatcctctccacagcggggtggtgccgccgcgcgacgactctccacacacacaacaaagaaagaggtggtgccgccccaccgcgacgcgacacactctcgcgcgacgactctctctctgctgtggggatactactccacagaagagagagagcgcgcggcgcaccacaacaggctctcacccatcgagagagggcttctctctctctcgcgggcgccacacacacgtgttcacacacggacgctgagagagagagagttcctctctctctctccacacactctctctctctctctctcttctctccacacaggagagacctctctctgcgcgcccccacacacagagagaggagagacacacacactttctctctctgtgagagagagaacactctgataactcctcggcgccccccccaccgcttgtcgcgcgccgcgccggtgctatattcacccctctctcgcggacacctctctatatatataagagagagagagagaaagctctccgggtgctcctctctcctcgagaggagagaaagagaaagatatttctctaacacctctctccgtatgtttctcctttgtgcgccctgcccaaccccccgggttttctggcaaatcgggcgccaaaagagtccacacaggaacccccccaccaccggagatagttta

SEQ ID NO: 484673 - DNA, 763 bp, Homo sapiens
  misc_feature (9)..(9): n is a, c, g, or t
  misc_feature (167)..(167): n is a, c, g, or t
  misc_feature (175)..(175): n is a, c, g, or t
  misc_feature (182)..(182): n is a, c, g, or t
  misc_feature (221)..(221): n is a, c, g, or t
  misc_feature (223)..(231): n is a, c, g, or t
  misc_feature (244)..(244): n is a, c, g, or t
  misc_feature (280)..(281): n is a, c, g, or t
  misc_feature (289)..(289): n is a, c, g, or t
  misc_feature (328)..(328): n is a, c, g, or t
  misc_feature (334)..(334): n is a, c, g, or t
  misc_feature (352)..(352): n is a, c, g, or t
  misc_feature (370)..(370): n is a, c, g, or t
  misc_feature (405)..(405): n is a, c, g, or t
  misc_feature (413)..(413): n is a, c, g, or t
  misc_feature (544)..(544): n is a, c, g, or t
  misc_feature (586)..(586): n is a, c, g, or t
  misc_feature (637)..(637): n is a, c, g, or t
  misc_feature (664)..(664): n is a, c, g, or t
  misc_feature (692)..(692): n is a, c, g, or t
  misc_feature (753)..(753): n is a, c, g, or t
attgaagcngaaaaggtggttttacagttcctcttgcattaacctctaattcttactaccctggccaataaagcattttcacctcctagcgctttccttcctgtgtgcttgtggttggttcttttttctcaggctttttcattcatgatgctgagatagttctgttnacttagcntaacttnaggacattgatacagtggattgttcttgtactttctttncnnnnnnnnncccaccccaatcntcagtccccttcctaggaccatttgctactcctagnnttagaggnctcattgttatatatttggaaatggtccagttttgatanagtccnctggaagactcaattttncgtcaccctcatgatttnctgttaattccactacggctaatgttctaggaagntacccttntctctgggctcagttgggaacaccttccttagactatcctggactatcctgctatttctcagctatgctttcattggtcccactgaattctctagatccccagtagttctcacactctgtagggtcctgcntttaccattaattttacttatccatttgtttaggaatatttnttttcttttttcctttctaaactgggtaatttataatatcgagcaaatttntgtatgtttaaaggattaccatccctngcctgtattgttgttttactgtgagggnatggttgggactgaaaaagtgtttgtgtagctctgtatcttcaatttctaggattgcagtntctcactggg

SEQ ID NO: 484674 - DNA, 230 bp, Homo sapiens
tatgtgatagcgacgtgttgaatcttaccctctcagagtcaccaagatatggcatgctaggccacagacagcagattgaaaatcagcagcagatcttggttgccaagtgaacagtcgtttacatatttctaagagcatcagagagcgccgtcagcagacagtctatttctgagaaatgaacaagcttcacgaaattgagaagaacgatgttgaatgcccgaggagaacaa

SEQ ID NO: 484675 - DNA, 180 bp, Homo sapiens
  misc_feature (22)..(22): n is a, c, g, or t
  misc_feature (42)..(45): n is a, c, g, or t
  misc_feature (47)..(47): n is a, c, g, or t
  misc_feature (53)..(53): n is a, c, g, or t
  misc_feature (55)..(55): n is a, c, g, or t
  misc_feature (57)..(57): n is a, c, g, or t
  misc_feature (60)..(63): n is a, c, g, or t
  misc_feature (124)..(124): n is a, c, g, or t
aaaatgtgctatactgcatacnttttaaatgtaaagatattnnnntntttatntnangannnncacttaggaaatggctttgtgattcaatctgtaaactgtgtattccaagacatgtctgttntacatagatgcttagtccctcatgcaaatcaattactggtccaaaagattgctgaa

SEQ ID NO: 484676 - DNA, 157 bp, Homo sapiens
tattaaggcttgtacgtcctctgaagcattagtcttatggaagaattttggagaacaggagatttctcctggtggattaaactattttgagaacctttctggaatttgttcacatgctctgttgctccctctactctgcttacctggacctgcataa

SEQ ID NO: 484677 - DNA, 492 bp, Homo sapiens
actataggcaaatgagctgtatggccccagtacctatcaagttgatacagctaaaggaattataatatttgttatcacttgatttgttttccaagctagtgctagaatttgctggactgcagaggatcgcttagtggggtactgtgtctcatagacatgcgccatctccacgtgggaacaagggtgaaggtgagggaagcccctcaccttgggtcttttgctgtgcctcctatgtatgtctggtttgctggaagagtgattaatacatctttaatttattaaaaaacaatgtagacctttaaacttcagtcttattggtaataaaagggaacttaattcatacaggtacttgatacagttatacattttccacttacaaaaagaagacaattctgttaaatgaaacctgtatcgtaaaatgtatttttattttacccacgagaatgttgttatttttagcaaatagaactcaatgcagtgcattggttatta

SEQ ID NO: 484678 - DNA, 682 bp, Homo sapiens
  misc_feature (413)..(413): n is a, c, g, or t
  misc_feature (657)..(657): n is a, c, g, or t
gggggcgctttattttattaatccgagcgggggcgagattaccaacaatcacttcacactgaccccccccttaaaactctaccttgtgtaatacctggagatcaaatccgacactatcgacggagcgggactacaatgacctcgggacaacgtgacactatcctgattcgattcaataacaaggtcgagcgggtgtcagataaactacggggccctgtgcaatcacatgctataacagctaccatccttttggaaaataagctatttgggagactatggacatgagactacgcggagtactctacgaatagggactctctgtccattcgcttatccgaacatgcgcctgcgagagtgaaagacacaatatctatacacgtaagaaaaccttttaattggtacaatgtattacnacaattaccggagtagcccgtgtctgtactttaacgaaccaaagtttaagcttgaaaaatttaattgaaaaaccttcaggggggccttaaacacaaactgaggccaaggcgcacattaattgaaccaattcccccttttataagagacgagggtatacccacaaaaggagcggttaaaaacgcccctttgtccccagctttatggttccttgagaacgagatacgcgtttaaatcccccctttncaacaagaaaaaaaggcccgtctta

SEQ ID NO: 484679 - DNA, 288 bp, Homo sapiens
  misc_feature (39)..(39): n is a, c, g, or t
  misc_feature (73)..(73): n is a, c, g, or t
  misc_feature (79)..(79): n is a, c, g, or t
  misc_feature (86)..(86): n is a, c, g, or t
  misc_feature (113)..(113): n is a, c, g, or t
  misc_feature (135)..(135): n is a, c, g, or t
  misc_feature (226)..(226): n is a, c, g, or t
  misc_feature (254)..(254): n is a, c, g, or t
tcgccattctctgtgctggctgtgaataattgaagtcanttatacctttacgggatctcttttctctttattngtaaantcaggangttgttttaaaatagtttggatgattngataaataaatacttcagtgtnctctgctttttcccccccccgggatttcttggagaacacaaaacctagccatctcctttgttccaggggaaaaactgcatgtgcaaaaagncaaggtgtgtgtctgctcccagaaatangtggtatcataaaggaactgatatcctgtaggtg

SEQ ID NO: 484680 - DNA, 195 bp, Homo sapiens
cgtaaatacccgtggccgagtggacaaaagtctttgcccagcccaacctggctgagatgatacagaaaggtagagcagctattcctggagccagagctggtcatcccccaccgacagcaacgaatcttcacggcccccaaatacactgggagcttcctgtcaccctggacaacagcggtcactgatgcctccttc

SEQ ID NO: 484681 - DNA, 223 bp, Homo sapiens
cactgtgctggacattcaggttattagtgcgcgtacatggtcactctgtatattgtataatgcagcaggaggaccaaaatagaacatacacgccagtactcgagtgtgcaaaacaggggctagatgctgaagtacaaatgggcaaactgtgattcttcttgttttcacatcaatccttcgcacacacgcacttgtgatccataccaagcatacttggactact

SEQ ID NO: 484682 - DNA, 350 bp, Homo sapiens
attttaacggtgttggcttcagtaaaccagctatgacaatttatactaaacaaatggacctagaacccattggaataggttctagtcctattggtttagtataaatggtcatagctaggggatcctaattagaaatgtatataatttataatataggcgggtcttccaggatctctcaccatcccggagccctctaaaaacggtaatggaggggggggggatgtatagatatgaaggtgcgagagcagaaaaacggggggcgagaagtgtacctcaataaagctcaaaggggaccaaattggaggttgggggaaagtgggacgggaacgtgtctggtgcgggtaccgagc

SEQ ID NO: 484683 - DNA, 337 bp, Homo sapiens
agctccctatgttggccagcttagtcctgaactactcctggcctcaagcaatcctcctgccttggcctcccaaagtgttggggttacagatgtgaacactgcacctggccctacctttaatttagtccagtttgtcagttttttttattgtgtttaagaaatcttttcctacctcagactcctgagtagctgggactacaggcgtgcaccaccacgcctggctaagttttgtatttttttatagcgacgaggttttgccatgttgccaaggctggtctcaaattactgggctcaagcaatctgccggcctcagcctctcaaattgctggcctcttct

SEQ ID NO: 484684 - DNA, 384 bp, Homo sapiens
cggtggtgggtcatcaaaacagtggacaaaaagggtggtggagctggcgaggtcccccaatttgccccaaaaggtcaggagggtaaatgattattatccctaatacccgcccccccccttttaaacaggggggagagacgggtttcaaacatgtttgtttccattggccctttaagttttggagtaaaagggggggttatggaaacaaagcctcggaacaccctcaaaaggaaaggggaatgttttgggggcccccttggtttttttttttggggggggcgggtttaagtttttagtttttaaaaacaggactttttaaggggaaccacttggcccaaaatttggcccaggattttggggcccctttaaaaaggttaatgggga

SEQ ID NO: 484685 - DNA, 139 bp, Homo sapiens
ccgctgacgcgcagtccgcaacaagctgcagtactccacgccgggccaggcggtgacggaccgcagtatgctgcaggcgttcacagcttcggtagcaaagacgccggtttcgactacctcggcaagctgcaaagcaaca

SEQ ID NO: 484686 - DNA, 110 bp, Homo sapiens
ctctagtaggatccccccgtattttgcgtgcttatctcgacgatcggcggcatttccctggtagggatcaatggatttgtcgtcggaccgatgattgcagcaatgttcat

SEQ ID NO: 484687 - DNA, 324 bp, Homo sapiens
  misc_feature (189)..(189): n is a, c, g, or t
  misc_feature (232)..(232): n is a, c, g, or t
  misc_feature (234)..(234): n is a, c, g, or t
cttttatcaccagaatggatagtaacccagacatctatctaaacgtgtacctgtgtgtttctccaggcttaactttgccccgagaaaacggatctgtgaatttggtgcgccctcgcttactcgacagcggttaatttgaacgggaaggtttctttccgcgccccccaagccaaacccacacccaaccgnaaaaagaaagtttaaaacccccccccccagccagaaaagaacntnacggttggaggcttttgtgatttttgtcctcctctgccccggggaaattttcttggagtaaaatactgaattatttgattacttccaaaa

SEQ ID NO: 484688 - DNA, 810 bp, Homo sapiens
ggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaaatcacgggtgttaaccgggttaagtggtaaaataatccagggcgtcagtcaaaggcattttggctgactttaaatatggattattatttttaaccgggaattttaggaaaattatttacgggaattaaaaattttttcttttttaaacatggaattttccttggcctcggtctagcttaaactattactcaagctggcttaagtccttaagtatggtgtggtattcaccattaaataaggtggcttgggaatccatcagccattattagctttttttaacaggaagattacgttcttacaacggttacctataatctctggaacttcggggatcttacttaaggagttttcaccgcttgtaaaacctaacctttttaaaggcccatgggctaatgtcttaaagagggctttaccgtaaaccttttttcctacttcttcttaaactttttccaaactttctggggaaaaaaatagaaaaagg

SEQ ID NO: 484689 - DNA, 905 bp, Homo sapiens
  misc_feature (85)..(85): n is a, c, g, or t
  misc_feature (348)..(349): n is a, c, g, or t
  misc_feature (351)..(351): n is a, c, g, or t
  misc_feature (356)..(356): n is a, c, g, or t
  misc_feature (886)..(886): n is a, c, g, or t
cttctgcgtggaacatgccaaccctcgtctgctttgactttgcaaaactgcatgagaccgccgggcgcggtggctcacgcctgtnatcccagcacttcaagaggccgaggcagacagatcacctgaggtcaggagcttgaggccagcctggccagcatggtgaaaccccgtctctactaaaaatacaaaaaatcagccagtaatcctagctactcgggaggctgaggcaggagaatcgcttgaacccaggaagcagaggttgcagtgagccgaggtcatgccattgcactccagcctgggctacaagagtgaaactccgtctcaaaaaagaaaaaaaaaaagaaaaanncncttcnttttactccccagtgaagccctccctgattggcctctgcagaaggcagcatgcccgggctttggagtcagacctgcatacaaatccttgttttgccggtgtgaccttgccaagtcttctttcctgcaggacagaaggcggcacagctctccctgaactggcactctggcttctcttgccccagggtctgtttctgctccttggacagcaggcgcatgtgggaactgtgccctcttcagccatgagcccctgttctgcgcacatctagcccatcttccagatggacagacagtctgtggtcgtcgccaaacccctgaatctggccctgcccgcagtcagagggatggcaatttgtaagctacagactattgcgaatcattcacttggagactgaactaagactactggcaccaggctccgtagaccctcgggaagagcatggtctggcaggcagactggatgtggccacagataacatcccctaaggggagagcgtgacctgcaggccagaatgccacactttctcctgtntcgttcagagagagcctgt

SEQ ID NO: 484690 - DNA, 226 bp, Homo sapiens
attgtgcagtagtctctatagtaaatccaacctttctctaatatttaaagttaccaactttatcatatgataaaatatttcatatatgcttgggcttatttctgcatttttaaattctctttaatgtttctgtctgcatacttttttggtagaaccacgatgacaaattattgtcactttaaaatacatgttaataactaatagagaaagctctccaccatggcgg

SEQ ID NO: 484691 - DNA, 307 bp, Homo sapiens
gaagaggagcagtcacatctacatggatggcagcaggcaaagagagagaacttgtgcaggaaaactcctctttttataaaccatcagatctcatgacacttattcactatcaagagaacagcatgggaaagacttgtcccccatgattgaattacctccccccatgtccatcccacaacatgtgggaattcaaggtgagtttagagtggggacacagccaaaccatatcagttagcatacatctccttaaccaaaaatgtaagagcagacagtcacaatggctcatgcctgcaatccaatgctttgg

SEQ ID NO: 484692 - DNA, 335 bp, Homo sapiens
  misc_feature (38)..(38): n is a, c, g, or t
  misc_feature (289)..(289): n is a, c, g, or t
  misc_feature (291)..(291): n is a, c, g, or t
  misc_feature (294)..(294): n is a, c, g, or t
  misc_feature (302)..(302): n is a, c, g, or t
  misc_feature (308)..(308): n is a, c, g, or t
  misc_feature (316)..(316): n is a, c, g, or t
gtgatacaagagacacagtggagaccgtccaatgagtngcatggctgccaggatgccaactgggacactaaagccctggcagtgggggctgcccagcagggctggccactagaaataagagatgcaaattcatcttctatcatagccaaagaagaccaacaaagaccaacagaggccatgtctcgcattcagctccaacagcaggcagtagatttgttacagagactaaaacccaccttattgccaagtgaccctcctctcaccagcctcccctgctgccacccaaatncntgncactgaantactcntcaaaatnaaacacagctgtaaaatgc

SEQ ID NO: 484693 - DNA, 175 bp, Homo sapiens
  misc_feature (14)..(14): n is a, c, g, or t
  misc_feature (46)..(46): n is a, c, g, or t
  misc_feature (49)..(49): n is a, c, g, or t
  misc_feature (118)..(118): n is a, c, g, or t
  misc_feature (173)..(173): n is a, c, g, or t
ctcttggtgcctgntggatccggttcccatggcccagtctgaatgntgnacatgcatatttaacttcccacagcaacattgcgatttgaggctcagcaacagcaaatcctgttccggnattggctgcaagagcctccatgtagccggctcaggccaaggcaggcgccgtgagncc

SEQ ID NO: 484694 - DNA, 496 bp, Homo sapiens
atctctgaatttggggatttcatcagttactcctggaatcaaaatgagtgtggagtcataatatatattttttttgagacaaagtctcactctgtcgcccaggctggagtgcagtggaggttgcagtgagccaagattgtaccaccacactccaggttgggtgacagaatgggattctgtttcccccaccaaaaaaataaatgaaaagaaaatcaaggccaggcgcggtggctcacctgtaatcccagcactttgggaggccgagtcgggcagatcacgaggtcaggagatcaagaccatcctggctaacacggtgaaaccccgtctctactaaaaattacaaaaaattagctgggcgtggtggcaggcacctgtagtcccagctgctcgagagggtgaggcaggagactggcatgaacctgggagtcggaggttacagtgagccgagattgtgccactgcactccagcctgggcaacagagcgagactctgtctc

SEQ ID NO: 484695 - DNA, 141 bp, Homo sapiens
tcggtccagtgtgttattcaggtcactactacagtcagggttctttaacctatttgagtcacagaattgtttttctctacacagtatttttctcttacaggaagtatttgagcagaagctatgtacataatgttagagata

SEQ ID NO: 484696 - DNA, 2320 bp, Homo sapiens
gcggccgcccgaagctgataaatcaggggccgggtcgcggctgcgggctaagttggacgccccgacccgtgcgagggccaggtccgcgcctgccccgccaggcgaagcgaggcgacccgcgtgcggccatggcttcgctgctgggagcctacccttggcccgagggtctcgagtgcccggccctggacgccgagctgtcggatggacaatcgccgccggccgtcccccggcccccgggggacaagggctccgagagccgtatccggcggcccatgaacgccttcatggtttgggccaaggacgagaggaaacggctggcagtgcagaacccggacctgcacaacgccgagctcagcaagatgctgggaaagtcgtggaaggcgctgacgctgtcccagaagaggccgtacgtggacgaggcggagcggctgcgcctgcagcacatgcaggactaccccaactacaagtaccggccgcgcaggaagaagcaggccaagcggctgtgcaagcgcgtggacccgggcttccttctgagctccctctcccgggaccagaacgccctgccggagaagagaagcggcagccggggggcgctgggggagaaggaggacaggggtgagtactcccccggcactgccctgcccagcctccggggctgctaccacgaggggccggctggtggtggcggcggcggcaccccgagcagtgtggacacgtacccgtacgggctgcccacacctcctgaaatgtctcccctggacgtgctggagccggagcagaccttcttcttcctccccctgccaggaggagcatggccatccccgccggattccccaacctgccagggcacccgtactcaccggagtacgccccaagccctctccactgtagccaccccctgggctccctggcccttggccagtcccccggcgtctccatgatgtcccctgtacccggctgtcccccatctcctgcctattactccccggccacctaccacccactccactccaacctccaagcccacctgggccagctttccccgcctcctgagcaccctggcttcgacgccctggatcaactgagccaggtggaactcctgggggacatggatcgcaatgaattcgaccagtatttgaacactcctggccacccagactccgccacaggggccatggccctcagtgggcatgttccggtctcccaggtgacaccaacgggtcccacagagaccagcctcatctccgtcctggctgatgccacggccacgtactacaacagctacagtgtgtcatagagctggaggcgccccgtccggtcagccctcgcgccctctccttcctgtgccttgagtggcagaggagccgtccagccacaccagctttcctcccaccgctcagggcagggaggtctgaactgcggccccagagcctttggcctaagctggactctccttatccgagtgccgcctctatccccttccccacgttccagcccctgcagcccacattttaagtatattccttcaagtgagttttcctccagcccctgagagttgctgtctcccagtggaatgttcactgacgtcttttcttggtagccatcatcgaaactaatggggggacagacttgatagccaaggtcccttctggtccagttttctgatttagggttctctcaagattaataaaggaagatggggaaatttgactcattaatgagctcgctaacctacgatctggtgataattttgtgtgcacagcccaaggaccacgaggctttctgcactttctgcacccccttccaaagtgaccacaaaatttcaaagggactcatacaatttgagaaaaaacagtcaacctgatttgagaaattaaccagtatggctaactatatcacagaaaatgggattgagttaaaactattttattttaaatatacattttaaagcagttcttttttttgttaatttgtttattatacacacacttcaagagaatatgcacagtctaggccgggcacggtggctcacgcctgtaatcccagcactttgggaggccgaggcatgtggatcacctgaggtcaggagtttgagaccagcctagacaacatggtgaaaccttgtctctatgaaaaatacaaaatttgctgggagtggtggtgcatgcctgtaatcccagctacttggaaggctgaggcaggagaatgtcttgaacctaggaggtggaggttgcagtgagctgagattgcaccattgcactccagcctgtgcaacaagagtgaaactccatttcaaggaaacaaacaacaacacaacaag

SEQ ID NO: 484697 - DNA, 572 bp, Homo sapiens
gcggccgcccgaagctgataaatcaggggccgggtcgcggctgcgggctaagttggacgccccgacccgtgcgagggccaggtccgcgcctgccccgccaggcgaagcgaggcgacccgcgtgcggccatggcttcgctgctgggagcctacccttggcccgagggtctcgagtgcccggccctggacgccgagctgtcggatggacaatcgccgccggccgtcccccggcccccgggggacaagggctccgagagccgtatccggcggcccatgaacgccttcatggtttgggccaaggacgagaggaaacggctggcagtgcagaacccggacctgcacaacgccgagctcagcaagatgctgggtgagtgagcgcgcggccgagcgggctgggggccgggggcgggcggcgggcggctggcggcactgcagggcgggtgcgagcgcggagcctgtggaagacccggcacgcgggacgagggccctcttcgtgcccgcgtggctggccatctgcgcgagcgtgggtgctcgcggtgcccaggattcagagcgggggcacttggcgcggtc

SEQ ID NO: 484698 - DNA, 544 bp, Homo sapiens
  misc_feature (34)..(34): n is a, c, g, or t
ccagctatgcttgccagagctcagccctttcgancatcaccgacccgcccttactcacgtggcttccaggtgcaataaagtggccccaaggaaaatgttcacagactctgaatgaggagacgggggtcagggaaagggtggtggctttagactggagaacgcctgcttcaaagtccccctgggtgtcatggtggtcatggtgggcatggacagagggtacccctggtcccaaaatcaagaaatgacctgatcttgaatgaggctgaggcccaaggatgaatgctggattcaccagagaccatggcaaagaagcctgctcctaagaactacatgggatccctgttcctcataacctagacagccctggtcctcctcactgggtcctcatcctgatcacagggccctggtcctgaccagtgggcccgtttaccgatcactgagctctggtcctactacttggtccctgttcctgatcacttaattctagccttgatcactgagccttagtcctgatcactgagtcctactcctgtttttgggcctg

SEQ ID NO: 484699 - DNA, 507 bp, Homo sapiens
  misc_feature (373)..(373): n is a, c, g, or t
  misc_feature (385)..(385): n is a, c, g, or t
  misc_feature (389)..(389): n is a, c, g, or t
  misc_feature (391)..(392): n is a, c, g, or t
  misc_feature (395)..(395): n is a, c, g, or t
  misc_feature (399)..(399): n is a, c, g, or t
  misc_feature (401)..(402): n is a, c, g, or t
  misc_feature (405)..(405): n is a, c, g, or t
  misc_feature (411)..(411): n is a, c, g, or t
  misc_feature (417)..(417): n is a, c, g, or t
  misc_feature (431)..(431): n is a, c, g, or t
  misc_feature (435)..(435): n is a, c, g, or t
  misc_feature (441)..(441): n is a, c, g, or t
  misc_feature (451)..(451): n is a, c, g, or t
  misc_feature (462)..(462): n is a, c, g, or t
  misc_feature (465)..(465): n is a, c, g, or t
  misc_feature (468)..(468): n is a, c, g, or t
  misc_feature (474)..(474): n is a, c, g, or t
  misc_feature (493)..(493): n is a, c, g, or t
gcggccgcccgaagctgataaatcaggggccgggtcgcggctgcgggctaagttggacgccccgacccgtgcgagggccaggtccgcgcctgccccgccaggcgaagcgaggcgacccgcgtgcggccatggcttcgctgctgggagcctacccttggcccgagggtctcgagtgcccggccctggacgccgagctgtcggatggacaatcgccgccggccgtcccccggcccccgggggacaagggctccgagagccgtatccggcggcccatgaacgccttcatggtttgggccaaggacgagaggaaacggctggcagtgcagaacccggacctgcacaacgccgagctcagcaagatgctgggaaagtngtaggaaggggnagantnnttngggntnnatnttggtncaatanttcgatcttgttcnttgntgtggntgactaagcntgcttcgaagnggncgncgcatncggttggtgtgcatcctcntgcttggcctgttg

SEQ ID NO: 484700 - DNA, 363 bp, Homo sapiens
  misc_feature (7)..(7): n is a, c, g, or t
agcgccngtgataccctcttgcaaagtattgagcttcctcctctaaacagtgctaacaatgcacaggactttttacggatggttcaggtacacggttaactaaatttggctcataatgcacagcagaggctcaaagtggcgcttggtgcaagccggaagaagttgagtgagaacatcaaatacagaagatttaattcagacatctttcacagagcagatacgtactatcatcagatatttactggacactttggttaagctgcgttaagcgtttaatggacactctgttcctgcagatttgcagagcacatattatgcccaggcctgtgaagagatctttaaacacttgtgcattagggcccc

SEQ ID NO: 484701 - DNA, 117 bp, Homo sapiens
aaacgtgatcaaaaaaaaaaaggggatggtccaaagagttagagcacagcctggccaccccagccaacaaatgcaaatcgtgccctcgcaaagcactcatcgccagtacatcgccaa

SEQ ID NO: 484702 - DNA, 836 bp, Homo sapiens
acgctgtacgggccgagttttatatgtcgacccagcgctcggactagttctagatcgcgagcggcgcccttttcttttgggatctatttatagcatcatcgatttatggaacataaacattaatggtggggtgtcataatccataattgacatcattctttaggatgctataaattttcccaaattgggaagggattccccttacagggccctccagtgccttgtcgtcttcacattggagcacttccatgcttacgggcataacaaaatcaaccttctcttataggacccctagttcctttaagggggcagtgatatttagaaaccaagatgtggatgctaagtctgctctattctctcgggttctataaaactgttaaactgtggcatttttggtcctgagcctgtatgatattaacctcctttgggagggtgaggatatctttgtaaaaaaatgtgatgcataatgtccatattgggggaatacacttggatattctggaaccctgtgtatcagtgtgtaggtgatcaacatcagggaacactaggatatccataacgccacctcaaacatttatcttaccttatatgggggaacattccaattctcttctagccatttggaactggtgtaactacgtaattggtacaactatacgcctactggtacatatcgaacactagattcaatacctccgggcaagctgtattatatgtacccataaaccaagcctctttaacatccaatacccctataacacttcccagcttctagaaagccccaatcaattcctattccatgagatccatttttaagtcccaaatttgactccgat

SEQ ID NO: 484703 - DNA, 169 bp, Homo sapiens
gtatttattcgtagacgtgggagtttcaccaggttggccaggcgggtctcgagctcctcaggtaatccaccggcctcggcctcccaaagggcggggattataggaatgagccactgcaccccggccccttagcttctgtttatagctaataaacaaagagggtggtctt

SEQ ID NO: 484704 - DNA, 423 bp, Homo sapiens
gcatccattcatcaaccatccatccatccatccacccacctcacccacccattcatccatccatccatccaccatccatccatccacccacctcacccacccattcattcatctatccacccattcatccatccatgcattcatccacccactcaccatccatccatccatccatccatccatccatccatccatccatctatcatcccttcattctcagcaacctgtccaaagcatgccaaacctggacttgatactatcaagctaaactaggaacaaggcggcctccacccttccaggatagagagaggctctctgacccttcactgcttctgtgcctccttggtgtttctgcttttaaatgtaccagtggtgataataattccagttatatttactgagcacttactatatgcccgtctg

SEQ ID NO: 484705 - DNA, 156 bp, Homo sapiens
gaagcgcacgatggcgcgtcctgatgaagccattggagagactcgagtgtgtggaaggtgtggcccatatcatcgaccccaaggccatcagctaagaccacctctacggacacccttggaccccatacaccagggaatggacagatgggctcttca

SEQ ID NO: 484706 - DNA, 165 bp, Homo sapiens
atcgagctcggcacctattgctgggccacaaggggaactcctcctaatgaaatatttaagttgacttacacttcctttgtctcagcaggtcctcccagaagatcgtctccttttcatatcgaaaatcatctttaagtcaaagttctcagatcttgaagcttcaat

SEQ ID NO: 484707 - DNA, 856 bp, Homo sapiens
  misc_feature (29)..(29): n is a, c, g, or t
  misc_feature (61)..(61): n is a, c, g, or t
  misc_feature (72)..(72): n is a, c, g, or t
  misc_feature (108)..(108): n is a, c, g, or t
  misc_feature (128)..(128): n is a, c, g, or t
  misc_feature (136)..(136): n is a, c, g, or t
  misc_feature (145)..(145): n is a, c, g, or t
  misc_feature (152)..(152): n is a, c, g, or t
  misc_feature (157)..(157): n is a, c, g, or t
  misc_feature (215)..(215): n is a, c, g, or t
  misc_feature (225)..(225): n is a, c, g, or t
  misc_feature (256)..(256): n is a, c, g, or t
  misc_feature (262)..(262): n is a, c, g, or t
  misc_feature (264)..(264): n is a, c, g, or t
  misc_feature (280)..(280): n is a, c, g, or t
  misc_feature (298)..(298): n is a, c, g, or t
  misc_feature (379)..(379): n is a, c, g, or t
  misc_feature (393)..(393): n is a, c, g, or t
  misc_feature (443)..(443): n is a, c, g, or t
  misc_feature (446)..(446): n is a, c, g, or t
  misc_feature (456)..(456): n is a, c, g, or t
  misc_feature (515)..(515): n is a, c, g, or t
  misc_feature (592)..(592): n is a, c, g, or t
  misc_feature (594)..(594): n is a, c, g, or t
  misc_feature (635)..(635): n is a, c, g, or t
  misc_feature (641)..(641): n is a, c, g, or t
  misc_feature (661)..(661): n is a, c, g, or t
  misc_feature (709)..(709): n is a, c, g, or t
  misc_feature (712)..(712): n is a, c, g, or t
  misc_feature (736)..(736): n is a, c, g, or t
  misc_feature (745)..(745): n is a, c, g, or t
  misc_feature (752)..(752): n is a, c, g, or t
  misc_feature (769)..(769): n is a, c, g, or t
  misc_feature (814)..(814): n is a, c, g, or t
  misc_feature (825)..(825): n is a, c, g, or t
  misc_feature (842)..(842): n is a, c, g, or t
  misc_feature (851)..(851): n is a, c, g, or t
actatccatcaggtaggcctaaggcaggnaccatgcagcaggagcagggcctgtaaaccanttaatgctgcnccttcatgcaacatggggacagcacggggctgagcnccacaggcgaggggccaggnaggccttnaaagcaganacaaccnctaanaggaaggaaggtcaggctggctttagtgcagggaagggtaatgatgggaggggatgtncacgaagganagtgggtagctgaggcttcaaagggcctccntggganangggtttagggggagtnaagagggacaatgaagtnttgggagtaaagatgggaataaacaggagaaaggaacgaggaggcaggtgccgggatgcagagtccagcagcgctgcacancctgggcagcaggntgagtatgggctcctcactcccacctcctggccttcaaggcctacttgtngcnccagacagcnatctttgtgaacacaggtcttgggaggaagcggctggactccatgtaggcagagatctnctccaagccctcaaatcgggagaagaagttcttcaggtttgggaaggcatccaggcagcggggctcaaatacttggntnctctcaaggacatcataagcgatgaaatccacaaaggtgancttgtncccaagaaaccatggctgcntccccagaaactgtgagtagagcttcagcatttcagggagtgcctgcnggnatgctggtttcagtgtctcaaaanctgggtcanagcagantgtggccagccgcatanggctgtgcataaactggttctccaaaatgtctgcgcgaatatgcnccttttctgantccccgcacaggttgtncttgcgggncatgt

SEQ ID NO: 484708 - DNA, 1630 bp, Homo sapiens
  misc_feature (648)..(648): n is a, c, g, or t
  misc_feature (668)..(668): n is a, c, g, or t
gcagagacttgagtccgctgaaaagtgtcaccctgtttccgggctcgccatgagaaaatcctcaccgcgccttggtgtaggccatcttccatcttcgcttgcctgaccaattgtcctgtgctacgcggaggccgtctcgctagcagagtgtctctatgaggagaagtcgtgtgagcaagtactgctctaatcacgaaggtgactcgtagaggagaactagctgatataggagtgtcgatgagttgaaggataggatgactcgtatggcagacgtcccgcatgcgtgaacatacgtagacgcatggagacactcatatctagatttgcgggtcttgcacaacatggagccgaagggcaagcattgcgctggctagtgcatccgttggaagagccagtcccacgctgtccgaaaacgcacctggccattactcgaagagagaggaaccttcgatgtctaggtagggggcaagggaaggcagacgcattctaataccaccacggcaaagggtaaaaaccagtatggctaggaaatttgtacacacggtggggtacagagacctttttagcacaagaccttgacgcgggttgaccaatttatacgtactctgtggaacatatagggtccgaatactgcacgtctttcgaaantcgccacactgtcactaatnccggctctgaattctacctttcatggctgaggcataaaacacaggaaggtccctgacctaagtttcctaaacaagttctaaataacaccttaacgggctcacattctatctcgccatggggccgggcgttgtttgccattgggaacccttggttcgcagggaccggggcaccgagtcccttgccattttggaaccttcagggtcccttaaccaagcctaacacggggcctttaacgcgccaaagtggagttggcggggccttagagaccgcctttctttcccaagtccgttccaaattccaaaggccatccgtattgggatggggccccggtgagttctttataacttagcgaaaggaaccgggtttctcgaagaaagacttgtggaacccccctggaaactaacccggaagcgaacccattaaccaagggtttccctaaggccttccgaaacgactgagtcgcggacggacctggaaaaagcggcttgacacacggggaaggggggcccccccaagatcccccccacggggggacacagggcggtggcggccaaggttttccggaaccattcggccggagggcgcttgggtgaaaacaaacccccttgtgggtttatcaatgaagccccttgggggtttcggtaaacccctaacttgatacaaatctccgcaagaatatcaaggggagaggcacaggataccgggacatgtacattttccgggggtgtgaaaccaagcctgtcttttggaaaacccccgtgaaacagagacccctcttaaaaaaagaaacgtgggccaagatcatctcccggaggggagcccccacattgtgccctcccgagagtagttagaggaacaccccgtctttgtgtatcacgccctgcaacggcgaaactcagagtgttgaataccacagtcgtcacaaacagacaacacaggcggtagaagtccttcccccgta

SEQ ID NO: 484709 - DNA, 837 bp, Homo sapiens
  misc_feature (40)..(40): n is a, c, g, or t
  misc_feature (50)..(50): n is a, c, g, or t
  misc_feature (100)..(100): n is a, c, g, or t
  misc_feature (125)..(125): n is a, c, g, or t
aaccacaaaatgcacactataagaaaaatggtcaggtganagacacaaanaaagacttaaaaacaggaaaccctgaaaggaaaaacaaactaaagaagcnggttgcagggggttgagtaaggctngactaagcgaaccatgactgaactggctctgtgtttctatctgctgaaggttaaacagaaactcaactggttccacaccatttgggtccctgctgtttttttcttgcagactgtgctattaatttaataacagtttttttggagtggcggtagtaatgtagatggcaccatttgcattttttttctggctatattagaattctgatgtcaaagaccgagcagcgggctgtagagtaggtttattaaactagcaagaattacttaattaagacagtgaatttggctgaagactaaaataaatttctcaaagactgagctggagattatcaacctgaatatattttcttgagtagaccaaatatgctttgttaaagtaactatttcttaagaaagtgaaagtagaagctcacttgctccacactgaactggaaatcagaaagaagcgatgtttaacacagctcttctgtgggaagatgaaaaaaagattatactctattgctcaaatatactgtttggaaatggcgaaaacctaatgccttgcttttattctcaaatacttacacagaaacttaacgttccgccctacaactcctcttagactgaattcaatactagaattccgccgccacgatccatgtaatcctcggttggacgaatggacatcagggcactcgcaatccccaaacatttgaacacctaaaagaagctatcg

SEQ ID NO: 484710 - DNA, 595 bp, Homo sapiens
tttctgtacgcgcctgccaatacatgggtcagaccaaaatcggtggctgaataagagcactaccgaaaaatccccgtgtgattggagccacaaacaacgttccgcgcaggcggagaatctcctcgtgcccccattcacaaggcggatattgcatagtccctcctaactatagcccgtaacaggtacgatctgtccacaagctgaagtgtggatatggtgcgcgacaataatgtttgcggggacaaagaaacaccacgcggatggtgttctgtccaccgccgctgacaaaccaccacctcatctcttatgggacgcaccctcatcccactacagttcaaaaaaccacggcgtatgaccagaagcattctatgccttcatttattacacgcgtgccaaaaacgttgctctactgctccccccccctcttgtgcagcatgaaaaaatagtttttctatcttaatacagacaaagtaaaactctttcacaacattatattagttccaagtattcatatagtgcaatcttatctttcgtcgaccgtacataccctctcctatgcggcccaaataaaaaaaacccccgaaccaaaataaca

SEQ ID NO: 484711 - DNA, 602 bp, Homo sapiens
  misc_feature (26)..(26): n is a, c, g, or t
  misc_feature (150)..(151): n is a, c, g, or t
  misc_feature (165)..(165): n is a, c, g, or t
  misc_feature (167)..(167): n is a, c, g, or t
  misc_feature (171)..(171): n is a, c, g, or t
  misc_feature (208)..(208): n is a, c, g, or t
  misc_feature (210)..(210): n is a, c, g, or t
  misc_feature (214)..(214): n is a, c, g, or t
  misc_feature (219)..(219): n is a, c, g, or t
  misc_feature (227)..(227): n is a, c, g, or t
  misc_feature (231)..(231): n is a, c, g, or t
  misc_feature (243)..(243): n is a, c, g, or t
  misc_feature (274)..(274): n is a, c, g, or t
  misc_feature (280)..(281): n is a, c, g, or t
  misc_feature (303)..(303): n is a, c, g, or t
  misc_feature (332)..(332): n is a, c, g, or t
  misc_feature (341)..(341): n is a, c, g, or t
  misc_feature (350)..(350): n is a, c, g, or t
  misc_feature (353)..(353): n is a, c, g, or t
  misc_feature (365)..(365): n is a, c, g, or t
  misc_feature (369)..(369): n is a, c, g, or t
  misc_feature (393)..(393): n is a, c, g, or t
  misc_feature (402)..(402): n is a, c, g, or t
  misc_feature (404)..(404): n is a, c, g, or t
  misc_feature (423)..(423): n is a, c, g, or t
  misc_feature (476)..(476): n is a, c, g, or t
  misc_feature (508)..(508): n is a, c, g, or t
  misc_feature (601)..(601): n is a, c, g, or t
gccttacagtaattgtgtacatagtntgtttagtcattattgggtcaaaagtttcaggttgttccttttttaatgcattctgctgtgagaaccgtcaatatgcctttgttcctgctgagggatctgccattctggaggtacaaatactgnngatagaatatcacngnaganctacgtcaagttcagagtgttcaggatcatttctatntnagantccanttagctgnactntggcaaaggtcnttgatcatggagcctttcttcatttcattgnatcttnntaagtagaatgccactaccgtnaaatgctgcttatatgtattttattcccntttttgttntgttttttnttntttccctctgtngctntaaatttttcccttcctgtttatntctcttccntncctgttctgcttgtccctntgttccctaaagcctgtattttttctttaaggggatctattttcctttgaaanaattgctgggaagccagcctcagaaaggtaanaggaatgtttttcctgtattttgaaacataaattttccataggaatatccattcattataggacagaaatcaataggaaattagggcatggtna

SEQ ID NO: 484712 - DNA, 356 bp, Homo sapiens
  misc_feature (322)..(322): n is a, c, g, or t
gttcttctcgctagatgcgtttcttctgacgaacataatgatacctgaaggcgtactcccactactataccaaggaccttgctcagcagattactctttgtgacagcgtagctggcctcccctgagtgtttcacgagcagtgcaatgagtcgaacaaaggcatccaggttgtgatagcacttggctcggatcatggtgggattggcagcaggattgtgctgctgctcagcctgagctcggtaactgatttcaacacacatttcagtacacagacgacagaaccttgttatgagatcatcgggcttcagtattccttgctggngcatctgtccaacatatgcagagaaagctttggt

SEQ ID NO: 484713 - DNA, 144 bp, Homo sapiens
ccacaccagtggttcatttttactgtttttggcagcatgcctgcacccagcatgcacaggccatcagcatgccttccatccagctggtcatggcccatccacagcttgggtcccgcagctcgcacttcgtcactccatggtcca

SEQ ID NO: 484714 - DNA, 499 bp, Homo sapiens
tatcgctttgatagccctctctatgacctgtgtattatagcgagtctcaaaggcggcacagacattgtacaggtgccgggggggagtcggtggaaatatgccattcaacaggattctcagaaaaaaaccagctattcctgggcaggatgcctcagtgcacaggtgggaggtgggggctggtgggacctgagcatagtgtgacagagtagaatggcctcccgggtcaagtccaaagcttctgcttcaaatgggcaccactgggccttgaaccaggccctgtgttggcagggctgggtgctgttacatgctgtcacttgccgaagtccgtgggtcctgggtctgctcgcgtgtgtgactccttgattgctggctggtgtccttcatgtcctcagaggcccccggactcctccaggggtggtggcagaattctggggcttgtctcgaggtcttatcccagccccagctctggccctcacaggccctagccccccggtgtgga

SEQ ID NO: 484715 - DNA, 746 bp, Homo sapiens
ggccaggtccggtgttggggtgtccgaattgccgctcggagaggagtggcgcctcgccccgcttgaattttgattcatcatggataatctgtcatcagaagaaattcatagcagagagctcaccagattactgatgagatctcgtggcaaagtacgaggagaatcctgtgcgtttagcccattgagtctcaggatgcaggaatcatagaccatcactatgcctggtatgaacagaaaggaagccaagcataaaccgtcgatagaagaaggcttggaccaagataaatacacgcgacctcagagagacggagacgactttaacagaactcaacaaatgctgtgcgcctttgtgtcgtgcccactgtatatacgaacaaagaactcttcgacgtctggcaagagcttataaggacaacactgggcgagatgcgtggagaaaactcaccttgcaatgtagtatctaaacaggcatgcccggctgacataatggtcagctttcatgctaatcaagcgaaccgggagcagccagtggtggatacatttatacacgcataactaatgattgccatgagaaggatgaactattgccaagagaacctgagtcaagtgggcagataatcctgggaatttctagcccagaccatggccctgaagcataggcacctgccgattgatgcttcacaatgtccaccaaataaccacgaaattcacagacgaaggctgaagccaaccagagaatcgtattg

SEQ ID NO: 484716 - DNA, 1167 bp, Homo sapiens
  misc_feature (1023)..(1023): n is a, c, g, or t
  misc_feature (1052)..(1053): n is a, c, g, or t
  misc_feature (1059)..(1061): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 484717 - DNA, 981 bp, Homo sapiens
gcgccgattgctggagggaacggcggaggctcctctagagaatggtggtgtgtggcgactcgtgggagccggagctttggaacgaggagtggcgcccattaagcgtcaatacctcaccaccaaggagcagtttcaccaattcctggaagccaaagggcaggagaagacttgcctgggaaacctgaggtagtgagaccctgctgtgcaatgagctggcttgagcctgagtgctaaggcgtgatccgactggatggatgggacatgacgtgcgtgactggggcatggacggagtgagtgcatgctagatgccctgggtgatgcagctacatgactcacgaagagtgtgccctgtgttggacaaaacaatggtgcctggccccagtgtgaatgcccactgaactacgacaatgaacagtgctgtgtccctccctaatccatgtgatgtctggctgctaaggtgtttcttcggtgatctgcttgcctgctttctgcactgactgtggtgggctgctacctggagaccaatgcctggccgacctgggccccctgctgcgtgctcttcgagaccttctggccggtgcccctacggcgttgacctgccgcttctgcttggggcccatctgggggcccgatgggacagaacctggtgcatggaggaggtaggctggacctgcgggacccagtccgctgtccaatcctgcaactgtcctgggacaaatgcccttgcatgcaagcagctgccggaagcgcgaaggtccgcttcgagcgagctgagcaggcccttgcgcctgtttcaaggcaaagggtcccctacaacccacgtgtgccggatgtaccccgaaggggcaacgtgaaagcctgaggggccgcttacaaggtcaggaaaaacttgtaggttgggcaagcatgggtcccacgacatggactaggagcactagcaaaccgtcacaagaaaaccttagttggacctaggggccctag

SEQ ID NO: 484718 - DNA, 156 bp, Homo sapiens
  misc_feature (1)..(1): n is a, c, g, or t
ntcgggtatatggccatcataggaggcttcattcactgatgtcgcctattctcaggctacaccctagacgaaacctacgccaaaatccatttcactatcatattcatcggcgtagatctaactttcttcccacaacactttcttggccttatcgag

SEQ ID NO: 484719 - DNA, 993 bp, Homo sapiens
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcccaggggcccggaatcgggccagagagaaagacacggataaacagaaaaaca

SEQ ID NO: 484720 - DNA, 937 bp, Homo sapiens
  misc_feature (793)..(793): n is a, c, g, or t
  misc_feature (822)..(823): n is a, c, g, or t
  misc_feature (829)..(831): n is a, c, g, or t
tgcaagaagcaaatcatatgacctgcggcaaccatgaatgtggtcgagcataggatcgtactgtagtggacataccgcagatggcatgtatctactgacatgattcgccctgggggtcgtatattgaggactttaccatggctgcgcgcaggtgacacctgtgaaatgctgttataattgtggatggtaggtgcgtgagtgcctactatacgtgcgattctagtacttgctagggagtccccatggcttcaatgtgcgtctactcacaatgaacccaccagaacactgcggagcatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 484721 - DNA, 134 bp, Homo sapiens
gaggatcgcattttcttggtttctccacattggtgggcagatctttaactctagactcaggtgatcagcccaccttggctaccaaagtgctgggattacaggcataaaccaccgggcctggccttgacctactc

SEQ ID NO: 484722 - DNA, 220 bp, Homo sapiens
  misc_feature (1)..(1): n is a, c, g, or t
  misc_feature (28)..(28): n is a, c, g, or t
  misc_feature (33)..(33): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgccctgactgcatcctactgcgggatcctctagatcac

SEQ ID NO: 484723 - DNA, 390 bp, Homo sapiens
  misc_feature (1)..(1): n is a, c, g, or t
  misc_feature (28)..(28): n is a, c, g, or t
  misc_feature (33)..(33): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccatctatctgctgagagccacctccagcattcaataaaaccttgcactcattctctaagcccacacatgatacaatttttctggtgcactagcgcaagaacccgggatacagaaagccctctgcccattgtgataacgcagagggtctaactgagtgatgaacacaactgccgcagatagcaagctgaaggcgcactcagtgtgc

SEQ ID NO: 484724 - DNA, 124 bp, Homo sapiens
actagacgtagacacacgagctatttcaccatcctaccacacattcgaagaacccgtatacataaaatctagacaaggtagagccgagagacaaggtagagccgagtgacaaggtagagccgag

SEQ ID NO: 484725 - DNA, 311 bp, Homo sapiens
  misc_feature (1)..(1): n is a, c, g, or t
  misc_feature (28)..(28): n is a, c, g, or t
  misc_feature (33)..(33): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccccgcccctcacctctctggcccctcctcgatgcttttagcgtgagtccaccgcgagagcccgcagcgtttaacgttcgaatatatagagtggttcatacccgactccgatccacgctgtctattc

SEQ ID NO: 484726 - DNA, 1001 bp, Homo sapiens
aagaacactcaacctatacagttatttcaacagtatgtccccaattgaccctgattgaaatcactgactgaccgaggagtgagaggacagggctttgcctttgtaagcctttgatgaccatgattccgggccatagattgtcattcagaacactaccatactgtgaactggccacaattgtcaagtcagaaaagtcctgtctcatcaagagatggcttagtgcttccatcctcgtccatcatgatggtctgaatgtgtgttcttgtggaaacctttggtgagtggtctgtggccgcgtgggtttcggctcgtggaatgaccacttccggtcttggaggtgacattgcaggtggtcgtggtggctttggtggcagaccgtggtggtgcgtggtatatggtggcggctcggcggactggcctcatatggatttgggtaatgctggaagccatttttcgggagggtggtggcactgcgtacaatgcctttcgcgcgaattacaagaatcagtcgttcaaattttggacccatgacgggaggaaattttggaggcagaagctctggcccctatggctggtggaggccaatactttgcaaaaccacgaaaccaaagtggctatgtgcggttccagcagcagcagtagctatggccagtggcgaagatttaattaggaaacaagcttagcagagaggggaggccagagaagtgacacgggaaggttacggttacaacagatttgttgaactcatgccagcccagtggtggccagctagctgtacaaaaaagccatgttttggaccacatatcctgtgttttggcaaaactcccgactgtttttgtgccctgggtacccgtttttggttctgtcttggacaggttcaccttcccccaagcttaggcaaaattttgccccagttagacagaacacatgccgcgaccaaaaggtaaaggggaagacgcaacaaggacccgcgagaaacgagaggcaataacacggaaaga

SEQ ID NO: 484727 - DNA, 275 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (256)..(256): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccgtgtgggagatcccagatgggggcctgatgctgcccctgcgggaacccgtcgtcacctggagggccacanccagcggcgttgatgcagt

SEQ ID NO: 484728 - DNA, 1146 bp, Homo sapiens
  misc_feature (1002)..(1002): n is a, c, g, or t
  misc_feature (1031)..(1032): n is a, c, g, or t
  misc_feature (1038)..(1040): n is a, c, g, or t
cttatctcggcttcgtttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaaccaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 484729 - DNA, 809 bp, Homo sapiens
  misc_feature (32)..(32): n is a, c, g, or t
  misc_feature (183)..(183): n is a, c, g, or t
  misc_feature (191)..(192): n is a, c, g, or t
  misc_feature (214)..(214): n is a, c, g, or t
  misc_feature (217)..(217): n is a, c, g, or t
  misc_feature (227)..(227): n is a, c, g, or t
  misc_feature (234)..(234): n is a, c, g, or t
  misc_feature (269)..(269): n is a, c, g, or t
  misc_feature (309)..(310): n is a, c, g, or t
  misc_feature (312)..(313): n is a, c, g, or t
  misc_feature (328)..(328): n is a, c, g, or t
  misc_feature (345)..(345): n is a, c, g, or t
  misc_feature (359)..(359): n is a, c, g, or t
  misc_feature (361)..(361): n is a, c, g, or t
  misc_feature (423)..(423): n is a, c, g, or t
  misc_feature (445)..(445): n is a, c, g, or t
  misc_feature (449)..(449): n is a, c, g, or t
  misc_feature (455)..(455): n is a, c, g, or t
  misc_feature (458)..(458): n is a, c, g, or t
  misc_feature (479)..(479): n is a, c, g, or t
  misc_feature (483)..(483): n is a, c, g, or t
  misc_feature (485)..(485): n is a, c, g, or t
  misc_feature (488)..(488): n is a, c, g, or t
  misc_feature (506)..(506): n is a, c, g, or t
  misc_feature (510)..(510): n is a, c, g, or t
  misc_feature (513)..(513): n is a, c, g, or t
  misc_feature (518)..(519): n is a, c, g, or t
  misc_feature (527)..(527): n is a, c, g, or t
  misc_feature (529)..(529): n is a, c, g, or t
  misc_feature (534)..(534): n is a, c, g, or t
  misc_feature (538)..(538): n is a, c, g, or t
  misc_feature (546)..(546): n is a, c, g, or t
  misc_feature (720)..(720): n is a, c, g, or t
  misc_feature (805)..(805): n is a, c, g, or t
ctgttagcgcgggggttgcagtagtgcttaangcgtgttacgcaatgttttgtttctgctcgtgtgggcatttgcgggtttagggattattccaaaggccgggccacatcccatcttcaccttctgagatggattatatataacatgtcctaaagggaaggggatggggcttgtgggggggtntattttgnncagtctagttcaacaggcagcnggnggcccttggngggggcntacggggggttctcggctgggggtacaaaattggntataatatagtctatccgggtatactttgggtcaggcttnncnntttttaacttttacngtatttgcctatatccnaaatataacactcncncccttctggtcccccaaagtaagacaacctactttaaaaaataagttggaaatggttttatnggcggtattaacaaaatggggnggtngggggnccntccaaattaagaccccccccnaatncnccncccggggcggcccctccncccntgngttgnnggggatgngnttatntcanaacagggncctacggggtaggcgatcggcgaaggcgctttggggggggcggcgacgttttgctttcccatttttgacttccagaaacacttttaattccttaaaaagtattctagttctgaaaatcctaaaaagctttgctacatattctactcacacaattaagctccatcaaagtatgcnagttgtgttttttacttatgcttgaaagttgatgctgcgagtgaaaatacttcatgttgacagttaacactctgacctgattcanggcc

SEQ ID NO: 484730 - DNA, 1239 bp, Homo sapiens
  misc_feature (1)..(1): n is a, c, g, or t
  misc_feature (28)..(28): n is a, c, g, or t
  misc_feature (33)..(33): n is a, c, g, or t
  misc_feature (1095)..(1095): n is a, c, g, or t
  misc_feature (1124)..(1125): n is a, c, g, or t
  misc_feature (1131)..(1133): n is a, c, g, or t
nctatatatcacgcgctactgatcaacnccgcngactgcatccaacgccgctgactgcatccaacgccgctgactgcatccaacgccgctgactgcatccaacgccgctgactgcatccaacgccgctgactgcatccaacgccgctgactgcatccaacgccgctgactgcatccaacgccgcccctatagttttcctgcccaaggttttcagcagatctcactgtgtcctttaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaaccaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 484731 - DNA, 904 bp, Homo sapiens
  misc_feature (760)..(760): n is a, c, g, or t
  misc_feature (789)..(790): n is a, c, g, or t
  misc_feature (796)..(798): n is a, c, g, or t
atcagctcgctaccttaacttagaagttgtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaaaaaaaaaaaaaacacaaaacganacacgagctgcaccgacgacaacaagaannacaggnnngaaatagaccatcagcacaaagaaaaaaagagggcacaggcggaaagaggagcgcacaagagaaggggcgccaaaaaacaacaggcggcccaacgagcgagcgcac

SEQ ID NO: 484732 - DNA, 109 bp, Homo sapiens
ctgtgcgtcattaccatgtgccttcacatctgtctcctacttactggtatccttctctaaatctgtattttcattcctggtgcctactgctctcactggggatcctcta

SEQ ID NO: 484733 - DNA, 143 bp, Homo sapiens
tatgctgcgactgagcggttcaaagtgctaggattccaggtgtgagccatggcgcctgacactcatgtctctttgtgcctgataagtttttgcatacctcagtgtaccctcaggactgcgtcttgagttttttttgtttacat

SEQ ID NO: 484734 - DNA, 593 bp, Homo sapiens
ggacgggatcatgtttcatgactgaaatgcatacttgtgctataccaaataaacagtgaatatctggctgtacatggacttccaaacatagcatgcagtactcaaatattcaaaagtagagaaaggataaataaatcacagtgtacccattctataaagcagtgagaatggacaatatacaactacatgtaacaatatggataaggaaaccagatgagtatacatgataattccattcatatcatttaaataataatacataagaggcaaaagtaatatatactatttggaagtcacgacttttgggggatcagtgattgaaagggagcagaaagggcctttccggggtcatgataatgttgacctttgatcggggtgtattcagtttatggaagtgcattgatctatacaccaatgataaatgtgctatgctacatgtatattttacttcagtaaagttaaaatttgagaaaccactctgccaaattttgtagtgcgaaagtggatacagtttagagcacgtgaatggctactgcagtctatgaggccaaggaaatgtctgagagtttggacttgacaagtcctggcagagg

SEQ ID NO: 484735 - DNA, 475 bp, Homo sapiens
  misc_feature (2)..(2): n is a, c, g, or t
  misc_feature (42)..(42): n is a, c, g, or t
  misc_feature (65)..(65): n is a, c, g, or t
tnttggtagccccattaggccccaggtgcggctcccttcaangcccgcgagcccaagcagcaacncctccgtcttcggcagaaatgccagcgttctctcagcatcagcaccaccctttgggcagggtcttgggttgtggagttaaagtttgccttggtcctgttggcaggaccgtggtgggtagggcaggaaggggtcttgtgtcctcataggcagcacagcaccagaactactcacacagagtagaaagtctgtgcagtagcccggaggtacagtcagattctgacggtagttttcttccccttaatactgcgcagcccctcagcgaccatgtccttgtgactgtatttgcagcgggcacggtcagtgatgaggggctgtgggaagatgggcactcgctgcctctggggaaggcgggggccttggtatcctgggagttcaagctccacagccgtatcgagtagagagaggtacg

SEQ ID NO: 484736 - DNA, 410 bp, Homo sapiens
ctgaggaccccccccacccacagcccactgaatcaaatgttaatctcctttggcattatcctcatagacacatccaggatcaatactttgggtccttcaatccaatcaagttgacactcagtattaaccatcatactagctattgtaaaaggggttgagttcttgatttgattctgtgcttggttgctgttggtgtatagaaaacctactgattggtgtacattaattttgtatccggaaactttgctgaattcttttatcagtcttaggagctttttggaaaagattttagggtttacaaggtagacaatcatattatcagtagacagcgacagtttgactccctctttaccaatttgaatgccttttatttctttctcttggttcattgctctggctaggactttcag

SEQ ID NO: 484737 - DNA, 105 bp, Homo sapiens
acccccagacacgacggtgaaaaacgcccctgtgtaaaagttttttcccccccccccgcgccgggggggaaaaaaactccctcgggaaagggggttttaatacac

SEQ ID NO: 484738 - DNA, 128 bp, Homo sapiens
taaaaaaaaaaaaaaaaaaaaaggttcctttttaatggtgggagaaaaaactttaaaccttaattttttaccccggccaaaaattttttccgaaatgaagggcggaggataaaaaaattttttctgga

SEQ ID NO: 484739 - DNA, 144 bp, Homo sapiens
tcccaagtatgagaaattgacgcagggcatggagtggatcctgctgcatccatcatgcttgtgagctccatccatcatgcctgctgtggcaggaaaaggctcagagctgctgggtagtgtatcttccaaggtccctttcagttc

SEQ ID NO: 484740 - DNA, 386 bp, Homo sapiens
caaaggggcttattgcagccgcagacagtgcttaatcccgtcctttatatgcaatggccttatgcatggctatcatgcgtgcctcgttgtgaggcgatacttgcatgctgacgttgttagaacttctgaaagatggccgattccactctggagaggcgctgggggctgccctgggcgtcagtcgcagtgctgtttggaagcagctccagcatcttgagtctgaattgaacctgcccattcataaagtccgtggcagggggtatcagcttgcgtcgccgttggtttttctgagcgctaaagaaattgaagcgaatgctgcttctttggtgtggcccgtttacatctcggattccattgactccaccaatgccgaagctttgcgtctt

SEQ ID NO: 484741 - DNA, 146 bp, Homo sapiens
ggtgactttttgtttaatttttgtagagatgaggtcttgctaatgttgcccaggcgtggtcttgaacgtcctgggctcaagcaatcggggacctaaatggcaaataagatgctaatctggggttgcaagccccagtcctcttgaat

SEQ ID NO: 484742 - DNA, 208 bp, Homo sapiens
  misc_feature (134)..(134): n is a, c, g, or t
  misc_feature (198)..(198): n is a, c, g, or t
aatcctgggggggctttaattctggctcctttcttcctcagaacatctctattctgaagaccctctgcatgcaggcacgcccattccaagctgagtcgtgcggctgggcacaggggaatttttccagagctgangctgacgtctgctctgaagaatgttagaaggttcccagacaccagagccagatgtcccccaccnacggtcagga

SEQ ID NO: 484743 - DNA, 204 bp, Homo sapiens
  misc_feature (78)..(79): n is a, c, g, or t
  misc_feature (89)..(89): n is a, c, g, or t
  misc_feature (114)..(114): n is a, c, g, or t
ggtgactactacgagcacagcttaaacttcaaggactgggtgttcatatcctctagaggagctgttctgtatcgatannaccgatcaanctcacacctcttgctcagctatatnacgcgatcttcagcaaaccctgatgaaggctacaaagtaagcgcaagtacccacgtaaagacgttaggtctacctgggggtaccgagctc

SEQ ID NO: 484744 - DNA, 1931 bp, Homo sapiens
  misc_feature (1)..(1): n is a, c, g, or t
  misc_feature (865)..(865): n is a, c, g, or t
  misc_feature (916)..(916): n is a, c, g, or t
  misc_feature (1417)..(1417): n is a, c, g, or t
ntcttgtggtgtgtgtttgttctgttgctgtgttcgtcgttcggttgactgttgatgtgagttgcgttgcttctttgttctatcttatgatgtaaggttgtaattatgtaagtgcttactagtgtctgttgtgcagtagtagttttgttgtgccgtgcttgttgttcatcatcaagatggagtcgtcgttcttttgtttactaccaactctcctctgctggtttgtgagagcagctacgtctgtttgtcctcggaccttgtgagtgagcaagctcctctttggtggccctcttagtgtcgcatccctgcggggggtggtacacccaggtggttgtgtgtccccagccgctttttgccagactagtttgtcttctttcctccgtttctgtagttgtagcccccctgctcttactttggggtaccctgtcccaccctggcggtgggcacccacactgtgtgggttgctcctccagacgtgttttttttgctgtgaggttcctcactccctcaccgcgtgtggtttaaggttgaaatggtgggttttcttccttcccctcaccacgaaggagcccacacagagttgtgcccactctttttcaagaggctttcttgtgaggaattggtaacacccctggctgcgccccttttttggaggaatttcttctcacaccaatctggggggcaaaacacacgcacctcacgagaggtcgatacttatctttttgtgggccgaccttattccacaccagggaaagagtgtctggctcctgtcagattgggttgggccgcagttttttctctcttttgttgggtgacctcatacccgtgggctcaaagagattgtgttctcgtctctttagggganattctttccttcggtgagtgatagtttggttctagaccagcgcattccctnacataagaccgttatagatggggatagtagatattaaaacccacctagggagttgttgttgtgtgcgccgccaagaatataacaacacatggtgtccaccacagagtgattgttatagtagaccacccacattcgcagagaattggggggtggttttcttttagggtggttccccacgccggtttttttctggtcctctcttactactaggcgtctatgcgcattaccctctctttattctcattctgggtgctctcccaacttgttggtgccctttgttggggcacaccacaaaccactggtggttcccaaaggagtttatagtgtaacaccacacttgtggctctgatacatttgtgcctcaacagacgtttgtgatagggcccctacgcgccacaatttgggcgcacacacacacagagcggcttattctctgggtacacaccgcgttgacgctggttctgtctctctccaagaaatgggtgatctcaccctctctgngtgcgcttatctttgtgaagagccccacagagtgattggctctcagagccacatagattttataggagcatttttctctcaccgataggcgcaactacacaccctgttcacacaccgcgttagatatatggtcggggcacacatctcatctcatacacgccccctgttggcgttctcaaccacttgttaccacgcgtgtacactggcgcatttggtggcgttgcgcaacacaaggcgcctccagcgcattccaatatttcgggatattagaagaggaaagaatccattgttagaatgtcactgtaaccccagaaagatttatccagttacccagccagcctaggccagaacaccacccccagtgccacctccactggcctggtttgctgatggcccagaacatctgtttgctggctacccggaccacctggtgcgaatgttggccggtgacccattggcacccccttgaaagatttttggcagagcctttaccaaattaaaaaaaaactggcca

SEQ ID NO: 484745 - DNA, 633 bp, Homo sapiens
  misc_feature (468)..(468): n is a, c, g, or t
tggggggattcccaaatgatttaatggaggtaactttccccaatttaatacttttttgcatttatatatacttagaaacgctaaacagggtcctaaggccctgggaatggtgcccagacaagttatcctctaatataatacaactctaattagaccaaaattgggcttttaaaataccacaaataccagtaaagggaataaaaaaggggactacatagtctttctttcgggttaacaataggggaactacacggtcacatatgggtgtgtatactgggtagatatttatccccacatactataattacaagtacagacataaaaacaacacaagagcagaacaccggtcagtgtccacctcaggtgctaaccgctcccagttattacacacctcaacagacaatatataccccggcgggtgtctacactcgcggctagaaaactagaaacacacctccgcggggaaanactcaaaaccaggccatcacagccacagcccgtgaatacagtgaccagcggtttccccagtgggtcactcccttcaaccgtgacaggggcgcaactcaccaaaagatgggcatatagcccgtgaatctaaagctcccgggttcccccgacaaaacacaacacacg

SEQ ID NO: 484746 - DNA, 227 bp, Homo sapiens
acatgatacgactcgagtgtcggaccatgctcatccctcctggtcaatctcagctcacggcaacttctgcctcctgagtttaggcagcttcttatgcctcaatccccgaatagctgggactacaggtgcttgttaccatgcccagctaatttttgaatttttagtagagacagggtttcaccatgttggccagactggtctcaaaactgctcacctcaaattatcca

SEQ ID NO: 484747 - DNA, 473 bp, Homo sapiens
gtctgagtatcaggggtctgggctctcttcctgcatgtcgtttaggggcgagtggtgagctgctcctcgaagtaatgaacgggtgcccctcgcgttggtgcctcccacttttcctcctctctcctttggcgtggtgactgaatgggggtgggtccatgagttggactcagttgctgacgacagttgagggtgatacccgcagacagaggctgtcgccccctaggaatggacatggcaaaacacgatggcgacaacagaggacagacagcggggtcaggcaggaaaacggtcataaaagtatccaagtcaggaaaagggaaagctgggtaaggctgcaagccctcggacaagggcggcccatgcaggccttccggtgcagttccgggggctgcgtattctcttccgggtgaggtcgcggctgggaggggaaaagctgggacgaggtaaggggcctgggctcattggttccgatg

SEQ ID NO: 484748 - DNA, 216 bp, Homo sapiens
ctgtatatatatctgggtatcaatatccttatccaataagtatgatttctaagtattatctcccattctatgagatgtctttttacattcttttatttatttttccttttggaaacacagtctgtgctcggtggtccaggtgtaattgcagaagtaccttctcatgtcccttgaacctctccatggcgagggattaaattagaatctccagatgga

SEQ ID NO: 484749 - DNA, 114 bp, Homo sapiens
ctcggggatagcttatggcagttgatgaagagagaatggatagagtatatcaaatgacaagtaaagaggcagctgcttttggagatgttattttagaagatacaaatgattcaa

SEQ ID NO: 484750 - DNA, 559 bp, Homo sapiens
  misc_feature (268)..(268): n is a, c, g, or t
cttcattaagattatttttcattcagcatttatggaatattcatcaagtgttattgatatgccagtatacctagtgacaagaatatttgggggcactagtaaatactcatgagccaccttttacataataagccaccttttcaagtttttactccaaaaagtatgtgtccatttttcttcatactgtcttaagtgtctacatttttttttcctgataattgtaaacctgttacaaataacaacatagctaaccagctttgacctatantgatttaggagggaatgagaaaagacttgaatactacagtgatggaggccacctgaccccatattttttaaaaaatgaatgagaaatgtgatgctagtggaaaagtttttaatgcctctatcataatttcaataactttatgctctttattttaaaaataatctgggagataaagatatgacatgttttcatactaaagacctaatcaacaatgcaaacaaataatactgtgaatacaggtttcccagaattaaaaagtgatgtttacagctatcttggtagtgaaaaata

SEQ ID NO: 484751 - DNA, 310 bp, Homo sapiens
  misc_feature (283)..(283): n is a, c, g, or t
atgaggtaaggacagaaggagaacttgggctttcttgggtcaggtggtggggcttggagcacttgttggtgggggccaaaggtcaggtctggaactgcatgttattatgccaaaaccatcagagtgctctttagcttcaggcttcatgaatggctttaaactactcaggtagagcattttgacgtaggctataaaagtaacgttcatttttttctataggtcagcatttaacctagggagggcatatactatgggcggggacggactatgagccaggataaanaaattaccctcttccccaggccaggtc

SEQ ID NO: 484752 - DNA, 113 bp, Homo sapiens
ctccttagagcactctctaatcagatgtcctgagtcgtcccaattcttagaccttttatacctgtttttctccttctcttattccatttagtttattcaattcatacaaaact

SEQ ID NO: 484753 - DNA, 668 bp, Homo sapiens
  misc_feature (482)..(482): n is a, c, g, or t
  misc_feature (543)..(543): n is a, c, g, or t
  misc_feature (551)..(551): n is a, c, g, or t
  misc_feature (574)..(574): n is a, c, g, or t
  misc_feature (588)..(588): n is a, c, g, or t
  misc_feature (668)..(668): n is a, c, g, or t
cagaactttacaaatactgtgttttttacaaattgaaggtttgtggtaaccctgaatcaaacaaatctatcagcaacaatttttccaacagcatatgcttagttcatgtttctgtgtcacattttggtaattcttggaatatttcaaacaattattatatctgttatgttgatctgcaatcagtgatctttgatgttactattgtagttgttttggagttccacaaattgcactaatataagatggcaaatttaatccataaattttgtcagttctgactcctgccacaacaggcagttccctcatctcctccttttctcaggcctccctcttccctgagacacagtaatactgaaattaggccaattaataaccctaaaatggcctctaatgttcaatgaaagaaagagttgtacgtatcttaccttagatcaaaagctagaaatgattaagcttagtgagaaagccatgttgaaagctgngatagaccataagctagaccttttgtgccaaacagttaagttgtgaatgcacggtacgttnttaaaganaattacaagtgccactccagtanacacatacgggacnaatacatagccttagttgctgatgtgaagaaaggtttagtagtctagatagacgatcctgctttcattcctgcagagctn

SEQ ID NO: 484754 - DNA, 535 bp, Homo sapiens
tatcagctcggtacctgctgagtttcgtatctttttattcataatcaacatcattttgagaccaagctaagcttgcactgtattcaaacttatgagagtataaaggatctggaggttggggatatgactgacaaggcaaaggctgtggccacctcgatgaccctgttccctgttttattaaatgcggacacactgtggccgcacgatccgtgactggcccgctgggccagtacgtgatgtggcccagggagggggtcgagggggccaaatcagagaaggggactgacagtgggctacactcacatcccactggctgctgttctgaaagcatctgattggctttctgaggtttggctgggtggggactgcgcatttggtcactctgcagattggacttgcccgcgttcctgaagcgctctcgagctgtgctgtaaatagctggtgctaacatcccatggcgctccctcctcacgatgcaaccaccggcctgagggcccgtcctatgaatggatgtggggatggtcgcttagtaatg

SEQ ID NO: 484755 - DNA, 161 bp, Homo sapiens
tcccccggggggccctgggggggccccttttttttttttccgggggttttccccgggggggggtttttttttccggggggttttggggggggccccttttgggggcccttttgggcccccgggggggggatttttttggaaaaaaaccccctttttttcta

SEQ ID NO: 484756 - DNA, 191 bp, Homo sapiens
taaaatatatgagatgcttacttacatctggtgctggtctcagagtaagtaagcatctcatatatttcagccaaataaatgggccagggggaaaaattatatatatatagacaggactagagaaaacctatttttgtaatgatgtttcttggatactgtctagtcacccagaaaaatgtatggatgaattt

SEQ ID NO: 484757 - DNA, 1165 bp, Homo sapiens
  misc_feature (20)..(20): n is a, c, g, or t
  misc_feature (106)..(106): n is a, c, g, or t
  misc_feature (137)..(137): n is a, c, g, or t
  misc_feature (144)..(144): n is a, c, g, or t
  misc_feature (181)..(181): n is a, c, g, or t
  misc_feature (199)..(199): n is a, c, g, or t
  misc_feature (234)..(234): n is a, c, g, or t
  misc_feature (236)..(236): n is a, c, g, or t
  misc_feature (252)..(252): n is a, c, g, or t
  misc_feature (301)..(301): n is a, c, g, or t
  misc_feature (324)..(324): n is a, c, g, or t
  misc_feature (329)..(330): n is a, c, g, or t
  misc_feature (336)..(336): n is a, c, g, or t
  misc_feature (346)..(346): n is a, c, g, or t
  misc_feature (350)..(350): n is a, c, g, or t
cggggaaccgcagtagccgnctgctagtggcgctgctagccggccggcgcaggctgccgagcgggtgagcgcgcaggccaggccaaagccctggtacccgcgcggngcgggcctcagtctgcggccatgggggcgtncgcgcgnctgctgcgagcggtgatcatgggggccccgggctcgngcaagggcaccgtgtcgncgcgcatcactacacacttcgagctgaagcacctntncagcggggacctgctncgggacaacatgctgcggggcacagaaattggcgtgttagccaaggctntcattgaccaagggaaactcatnccagnngatgtnatgactcggntggnccttcatgagctgaaaaattctcacccagtatagctggctgtgggatggttttccaagggacactttccacaggcagaagccctagataggagcttatcagatcgaccacagctgattaacccgtgaatttgtgcccttttgagggtcatttaaaccaacgccttactgcctcgctggatttcatcccgccagttggccgagtctataccattgaatttccaaccctcccaaaaacttgtgggcatttgattgacctgactggggagccctcttcattcagcgtgaggattgattaaccagagacggttatcaagagactaaagggcttatgaagaccaaaacaaaggccggtcctggaactattaccatgaaaaaaagggggttgctgggacaacattctccgggaaccagaaaccaacaacgattttgggcctagtggtatatgcctttccttacaaaccttaaatgttccaacaaaagaaggccagaatggcttccagttacctcccagtgagggagcacactggttgtgtacctcattactagtttaacgcatggcgcaaaaccccctccctaaatacctttgccattttacgaacgcctcgcttttttcccttaagaccatcctagctactgtatattgcaactccctctttgcgccacactatcattatttaacttctcactttccctacccgcgactttactttctgcgatacacaacaggattgttcgcacattactctccggatactaaaatcacactcccttgacaccactctaatgtcgtcatatctgccactattccttctca

SEQ ID NO: 484758 - DNA, 821 bp, Homo sapiens
  misc_feature (30)..(30): n is a, c, g, or t
  misc_feature (65)..(65): n is a, c, g, or t
  misc_feature (72)..(72): n is a, c, g, or t
  misc_feature (99)..(99): n is a, c, g, or t
  misc_feature (169)..(169): n is a, c, g, or t
  misc_feature (299)..(299): n is a, c, g, or t
  misc_feature (411)..(411): n is a, c, g, or t
  misc_feature (443)..(443): n is a, c, g, or t
  misc_feature (586)..(586): n is a, c, g, or t
  misc_feature (590)..(590): n is a, c, g, or t
  misc_feature (601)..(601): n is a, c, g, or t
  misc_feature (621)..(621): n is a, c, g, or t
  misc_feature (625)..(625): n is a, c, g, or t
  misc_feature (635)..(635): n is a, c, g, or t
  misc_feature (644)..(644): n is a, c, g, or t
  misc_feature (655)..(655): n is a, c, g, or t
  misc_feature (664)..(664): n is a, c, g, or t
  misc_feature (666)..(666): n is a, c, g, or t
  misc_feature (693)..(693): n is a, c, g, or t
  misc_feature (700)..(700): n is a, c, g, or t
  misc_feature (703)..(703): n is a, c, g, or t
  misc_feature (705)..(705): n is a, c, g, or t
  misc_feature (707)..(707): n is a, c, g, or t
  misc_feature (710)..(710): n is a, c, g, or t
  misc_feature (729)..(729): n is a, c, g, or t
  misc_feature (732)..(732): n is a, c, g, or t
  misc_feature (745)..(745): n is a, c, g, or t
  misc_feature (749)..(749): n is a, c, g, or t
  misc_feature (761)..(761): n is a, c, g, or t
  misc_feature (763)..(763): n is a, c, g, or t
  misc_feature (771)..(771): n is a, c, g, or t
  misc_feature (774)..(774): n is a, c, g, or t
agttcagggtaactgcatgaaaaaacattncaggaggaatttacaattaccagcttaaagaactngcgcacnaacataaccaatttatgaaagtgaatncattaaaaggtatagaacctcttgtggggcatgaaggcaagggacaaagctacaacttggcctgtgcctntggaagcggaggcaggaggaccatctgagcacaggagcttgaaaccagcttgggcaacaaagagaatccgtttaaacaaaaaaaaaattttagccaggggtgcggtaagcggtagtcccagcgacaaggngggaggattgcttaggcctgggtgattaaggatgcaatgagctgtaattttccaaccacattccagcttgggcaataaagcaagattgttttaaaaaaaaaaaaaaaaaccnaaaaaaactaaagaatgtaatgaatgaaaacnaatgtgcctttcctagaaaaagtggcaaaaaatatttttgggatctcctgaccatgtcccctgaaaaataaggaaagcttgtttttacacccagtttggaggcaagtaagttttcagaatccaaactgaggggagcaactggncctngggactaaaancctctgggaatataaccttntttngggctgaaangctgccgcnagccctaaaanagccctttntnctaaaaacctcaggggagggtcctggntccaatnctnancngcnaaaaatgaggctgattctncangaatttccaaccnagtnctttggggtttncncacccccnctntgggcgggggaaccgggtcccggccttcgcagattccaggttctggc

SEQ ID NO: 484759 - DNA, 2275 bp, Homo sapiens
  misc_feature (11)..(14): n is a, c, g, or t
  misc_feature (47)..(48): n is a, c, g, or t
  misc_feature (66)..(67): n is a, c, g, or t
  misc_feature (69)..(69): n is a, c, g, or t
  misc_feature (193)..(193): n is a, c, g, or t
  misc_feature (1478)..(1488): n is a, c, g, or t
  misc_feature (1490)..(1494): n is a, c, g, or t
  misc_feature (1497)..(1503): n is a, c, g, or t
  misc_feature (1505)..(1507): n is a, c, g, or t
  misc_feature (1509)..(1509): n is a, c, g, or t
  misc_feature (1512)..(1513): n is a, c, g, or t
  misc_feature (1516)..(1523): n is a, c, g, or t
  misc_feature (1525)..(1527): n is a, c, g, or t
  misc_feature (1529)..(1537): n is a, c, g, or t
  misc_feature (1539)..(1539): n is a, c, g, or t
  misc_feature (1541)..(1551): n is a, c, g, or t
  misc_feature (1554)..(1554): n is a, c, g, or t
  misc_feature (1556)..(1558): n is a, c, g, or t
  misc_feature (1560)..(1560): n is a, c, g, or t
  misc_feature (1564)..(1567): n is a, c, g, or t
  misc_feature (1569)..(1569): n is a, c, g, or t
  misc_feature (1572)..(1576): n is a, c, g, or t
  misc_feature (1578)..(1579): n is a, c, g, or t
  misc_feature (1581)..(1588): n is a, c, g, or t
  misc_feature (1590)..(1591): n is a, c, g, or t
  misc_feature (1593)..(1595): n is a, c, g, or t
  misc_feature (1598)..(1598): n is a, c, g, or t
  misc_feature (1600)..(1600): n is a, c, g, or t
  misc_feature (1602)..(1609): n is a, c, g, or t
  misc_feature (1612)..(1612): n is a, c, g, or t
  misc_feature (1614)..(1615): n is a, c, g, or t
  misc_feature (1618)..(1624): n is a, c, g, or t
  misc_feature (1626)..(1627): n is a, c, g, or t
  misc_feature (1629)..(1629): n is a, c, g, or t
  misc_feature (1632)..(1632): n is a, c, g, or t
  misc_feature (1635)..(1636): n is a, c, g, or t
  misc_feature (1638)..(1639): n is a, c, g, or t
  misc_feature (1642)..(1642): n is a, c, g, or t
  misc_feature (1644)..(1649): n is a, c, g, or t
  misc_feature (1653)..(1653): n is a, c, g, or t
  misc_feature (1655)..(1658): n is a, c, g, or t
  misc_feature (1688)..(1688): n is a, c, g, or t
  misc_feature (2055)..(2055): n is a, c, g, or t
  misc_feature (2087)..(2087): n is a, c, g, or t
  misc_feature (2168)..(2168): n is a, c, g, or t
  misc_feature (2206)..(2206): n is a, c, g, or t
  misc_feature (2217)..(2217): n is a, c, g, or t
  misc_feature (2231)..(2231): n is a, c, g, or t
  misc_feature (2258)..(2258): n is a, c, g, or t
gattcgggagnnnnttctcttttcccccctggactgtgaagctggannccgaaccgcagaggtggnnanagttctcctttctttttgacacagcgcactgcagtgcttccaaggaacaacttctgccttggtgtggaagacaccgtggacaagctcaagatgctggaaggccgcaagaccagcatccgcaagncagtgcaggtggcctatgaccgtgcgatgatccacctgagcagagtccgggggccccactccttcgtcacttccagctacctgtaagggcagggctggcctgcatccgcttgccctgcctccatcccgcaggggacagagaagcctcttctgcccctgccagatgtatggccggcagcttccccctctcatggtaggccagggactgggctttctccccactaagggcaagggcccagttttgaccaatcgcatggttctcctggcaggcctgctgtgtgccaaaaactcccacccaagtcctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaaggcagctgctatgccaggtggtgtctctgccaagctcctcaggcccagacagaagccagccacaacctatgaaccccttcccagaaaccactccaccacagacttcctttagctgtgacacaacttcccagctctgcgagtgtgccccctggatcaaggcggtcccttcttgtttttttctttgctgccacgaggtggtccaagcttcagggtgggctcctatcaggctgggtgtgcgagtgtccatctgtccacatggatgtcgagggtggtttgtgtggagctgtgctcgtcagctgggtctgccctcttcccccttttctccttctttctcctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaannnnnnnnnnngnnnnntgnnnnnnnannnancannacnnnnnnnngnnncnnnnnnnnntntnnnnnnnnnnnttntnnncncctnnnnancannnnngnngnnnnnnnngnngnnngcngntnnnnnnnntgntnnttnnnnnnntnntnttnttnntnnttntnnnnnnttcntnnnngagttttggacaaaacagtcactggggagntcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctccccaggtagttgggtcagctgtggactctgtggacctttgtctaaacctgtgttgtaagntcttggggacttcctctctttctatgtctatnctcttccccccaacactttctcttcttagtctctctctttatttttcaatctctgaatattttagtttcctctctgagtcncattttttaaaatggctcttttagaacggggaaacggntcagatcctgntgtggcacgggggnctatggtgtctctggtcgcgtctggcngtggaagaacatggatg

SEQ ID NO: 484760 - DNA, 653 bp, Homo sapiens
  misc_feature (20)..(20): n is a, c, g, or t
  misc_feature (106)..(106): n is a, c, g, or t
  misc_feature (137)..(137): n is a, c, g, or t
  misc_feature (144)..(144): n is a, c, g, or t
  misc_feature (181)..(181): n is a, c, g, or t
  misc_feature (199)..(199): n is a, c, g, or t
  misc_feature (234)..(234): n is a, c, g, or t
  misc_feature (236)..(236): n is a, c, g, or t
  misc_feature (252)..(252): n is a, c, g, or t
  misc_feature (301)..(301): n is a, c, g, or t
  misc_feature (324)..(324): n is a, c, g, or t
  misc_feature (329)..(330): n is a, c, g, or t
  misc_feature (336)..(336): n is a, c, g, or t
  misc_feature (346)..(346): n is a, c, g, or t
  misc_feature (350)..(350): n is a, c, g, or t
cggggaaccgcagtagccgnctgctagtggcgctgctagccggccggcgcaggctgccgagcgggtgagcgcgcaggccaggccaaagccctggtacccgcgcggngcgggcctcagtctgcggccatgggggcgtncgcgcgnctgctgcgagcggtgatcatgggggccccgggctcgngcaagggcaccgtgtcgncgcgcatcactacacacttcgagctgaagcacctntncagcggggacctgctncgggacaacatgctgcggggcacagaaattggcgtgttagccaaggctntcattgaccaagggaaactcatnccagnngatgtnatgactcggntggnccttggtgggcggaaggcggaagccctagatagagcttatcagatcgacacagggattaacctggatggtgggctttgagggcgttaaacaacggcttactgctcgctggattcatgccgtcgggggcgagcgtatacatgggattaactctcccagactggggcagtgatgacctgactgggaagccgttgattggcgttgagatgataaacccgagcggtgtcagggactgagggctataagacggacggaggcgtcctgggatgtggggggaggggtcttggaacgttgtgcgacggggg

SEQ ID NO: 484761 - DNA, 664 bp, Homo sapiens
  misc_feature (649)..(649): n is a, c, g, or t
aagcttgcggccgccaacaggcaagaactgggcctgaggtggccaggctgaggcaagagcttggaaaaagcaatggtaccagcgcggtctttaaccccagcgtcttgcactaccaacatgctctgttcatggcgaggcttatttcaggacgatttgggcctgcagaagccattatcaggaggcagtagcctggcctatagaggctgcgaaaatttaaattcttgacctgcagaggccatgatcacgtaacatctaggcctggagggtccactgtcaggcagcggcgcatcctgaaggggcctacaacaggcaggatctcggcctgtggagaggcatcccctgatcctaaagaggccagtgtgagtgatcacatggcccacagaagcaagtgtcaggccagatcgtcgcttggagagtctgagaaaggcatgagatggacctaaacagaccattgcgattcagcacctgggcctatagaggccagtgtgaggcaggagcttgacctggagaggctggaagacgtatgagcttgtcctaaactgtccagtgtgaaggaagaagttggtctgtcaaggccgtcgggtaacaggctgtaacgtggactgggaaagcaactgtgaggcaaggggctgggcctcgggagggctgnggaaggcaagacctt

SEQ ID NO: 484762 - DNA, 121 bp, Homo sapiens
  misc_feature (39)..(39): n is a, c, g, or t
  misc_feature (70)..(70): n is a, c, g, or t
  misc_feature (88)..(88): n is a, c, g, or t
  misc_feature (90)..(90): n is a, c, g, or t
gcttggttccgcgttccctgcacaaaatgcccggcgaanaccaagaaaccgtccctgctacagagcaggngttgccgcagccccaggntnagacagggtctggaacagaattttgacagtt

SEQ ID NO: 484763 - DNA, 926 bp, Homo sapiens
  misc_feature (1)..(1): n is a, c, g, or t
  misc_feature (198)..(198): n is a, c, g, or t
  misc_feature (263)..(265): n is a, c, g, or t
  misc_feature (330)..(330): n is a, c, g, or t
  misc_feature (385)..(385): n is a, c, g, or t
  misc_feature (397)..(397): n is a, c, g, or t
  misc_feature (736)..(736): n is a, c, g, or t
ncttggtggagactcacacaggtgtcggtttggaggagctcacgctgcacgcccaactgttatgactggattggaacttcttcccggctgtggcctcaccttcagaggagttgcattcagctcatctcgcttccatgtgaggtgggaatgcggcacggcctccatctctgctggcggcccccgtcttgctgcgcgttnccccgtctcggttggttaagtggtaaaacacaagaacaaaaattgcctgattaaagacgccgggnnngtcggctgccgccccctccgtcctctcctcctcttgctcgctactggccttcttgccttggctgnctgtcgggtgggccccccgcccccctctctatggccgctcgctccgcctccggtngagcgtccgctngtcgggcgtcgttttggcgcgtagtatgcaacccccccccctcccgcgctcttcgctctcccgcctcatgcgcctcccggtcgccggcagccgtgtcttcccccgcgcccacccctctctcactcacctgccttccccgcaccctcccctctctcccgcctcttacgccccacccgccccccacgcctgcggcgctctctgtgctggtcggctgtgccctgccccacgcggcgcttgccgttggcgctcgccctccacgcccggctctagagtctcccgcgcccgccccctcgcctccgcggccccgtctctatctgccaccgccgccgcccgcctccntccggccacggctccgcggcgccctacgcgcgttccctccgccccatcgctccgccccgcgccgctgcggacgcctgcagcgctcgccgctctcccccgccctcgcccccacccgtcgtccccacccacccgcctggcgcccacgccggccgccccccgccccaacccccgacccacccgcaacacaaga

SEQ ID NO: 484764 - DNA, 221 bp, Homo sapiens
tgggcagcattttccagcaaaatgtaccccattttttgcctttttttcgtaaagttttataccaaaaaaaaaaaagcatgtctttcctttaaaaactcttgatccaaaatttgggtgggaaaaaaaaaaatgggttatcaagggttattttaaattttttccacccttaaaactggcccttaataaaaataagtaataataaaaaaatttttacccttcca

SEQ ID NO: 484765 - DNA, 181 bp, Homo sapiens
ctgtggctgagcccagcctgcgctacatacgtgagaccccactctctaccacaatatgcaaaaattagctgggtgtaggtgtctcatgtctgtagtctcagctacttaggatgctgaagtgggaggatggcttgagctggggaggtcagggctgtaagttatctgagggtctcttggccag

SEQ ID NO: 484766 - DNA, 386 bp, Homo sapiens
ggtcggtacccatcttgcgtccatcagaggtccagaggcctaagcgggaaaatggtttcatgggccaggcccaggcccagctgctctgtgcagccttgggattcagtgccctgcctcccagctgctctagctccagccatggctaaaaggggccgtggtacagctccggctgttgcttcagagagtgcaagccccaagccttggcagctgccacatggtattgggcctgtgggtatgcagaagatgagagttgaggcttggcagcaaccacctagatttcagaggatgtatggaaacacctggatgttcaggcagaggtctgcggcaggggcgaagccctcatggaaaacttctactagggcaatgctgatggtagcaagactgcg

SEQ ID NO: 484767 - DNA, 527 bp, Homo sapiens
tgcccctgagcacatccaagcagacaggaaaagaggagtcagacatgggccagtcacatccgtgagctgctcctggctgataaccacgatggagcccgtgtattgtcctgccatctggcactgtcactgagtgtggcacgaggcaccgtcgctgcttgatctctacatacacagtttcttaaggttaggacagttcttggcttccgttgtagacagggtgaggagaactggggcactagagaggtgcatgtcatctgcctggtgctcaatcagcgtatgcaaggtgatggagtcccagagttgtcaaaccaaagggggattacgatccagggagctggaggttcccacgtcacctgatgctagtagatgccatactgggccagccattagactccagacgcgtgttaccgaccaccggtttaccaccagcacacgacgatgggacttatgcaaagttgaaacgggaaacgaggaaggtcagagggccgtgggccgagccccgagggccagggtcccctatggtcgaa

SEQ ID NO: 484768 - DNA, 437 bp, Homo sapiens
ttggggctcattcaggttggggcttcagtggctaaaaagggggtttggttttggttttggtttggtttttttcctatccaggcggcctgggacggggaaaaaaaatttaggtccatgggacaaatatcaaataatagtcacaaattattatctccaaaatcctggcccccaaatacaaacaaagatagcatgaatacttaataatcagagtacttaatcaaaagcaagttaggactggacagcttgggttggggcagacggtcccggcagagtagtctgggacagatccctcatttaacctatggaagttagaggttcggaacccaaaaaaaaaaagggtggtcttaacccccataaaggggagctaccctacaaagaattatggccaaatccaggagtaatcggggactcggatccagaatgtacctggttaccac

SEQ ID NO: 484769 - DNA, 410 bp, Homo sapiens
gactatgtcgctccactgatactccagatccgacactagtaccgtctgctctcctctggtgacggagcaatggatctgtcatccctgtacgatgacttgaggctcttaaagtcccccgaggtcctgtcacattggacgcgcccactacaacgaagtgccgagtgccctttacgcgcctcgcctgcctccagcactactgccagggtcatcacaaagcagtacaacaacccagctggcctctactcttctgagaatatctccaagttcaagaatgccctggagtcaaagactgctggcagcggggtggaggcgaacagcagacccttagaccatgctcagcctccaagcagccttgtcatcgacaaagaatctgaagtttacaagatgcttcaggagaaacaggagttgaa

SEQ ID NO: 484770 - DNA, 370 bp, Homo sapiens
tgagacggactctcgctctgtcgcccaggctggagtgctggagccttgacctcctgggctcagctcaagtgttcctctcacctcagtctgccaagtagctgggactacaggcatgcaccatcattcccaactaattttttaaaattttttgtagagatgggggtttcatcatgttgccaggctggtctcgaactcttgggctcaagcaatctgcccacctcgtcctcccgaagtacagggttataggcatgagccactgtccccagccaggaattacctttaaaattttaggtgtgataaatatgttgtggttaattttttaaagagttggttttttttttaaacaggttcattctgaaatatttactgg

SEQ ID NO: 484771 - DNA, 673 bp, Homo sapiens
ggacgcgtgggtcaaacagtttaggtctcacaggttaccattgttggggatgtctgagctgttttcagatctaggaatagcacagtgttgtcttgtctttggcagtctcatatggctctgtttctatgcaccaccagcgtgttcattaccacttaacatatatagctacagcatgtggaacaacagagtggtgcaagacactgtagattaacggtcagaggcagaaattgtgcccttagtgttaacaagtgtgccttttgttctgaatgccatgttgtagggcatgcatatttaggcctctttaactcttcgacattctagtcagtaagcacatggcaacccatctctgcaaagcatacatctgtcttaacatatctagttcacaggccttcaatagacaaccatcaaggcatgcactcatcttcaggcactgcaacaaacagataaccatctagcgtcagtgtcacaccaaggacttcctatatttcacaggggttaaccgcatggtccctgtcgtatcttcaacctccagacgtgcatacttcaccatgtacatccctgcgtcatgctcaacactagcaccaagaaatcacctgcattgcgtccacacattaccttccaaacccatccattcacatcacgtgactaatccccagggcctagggtccatcac

SEQ ID NO: 484772 - DNA, 592 bp, Homo sapiens
ttcctctcttggtagctgagtctctccactcagggggaagctcaaaaaaaacagaagcttcaaacaaacaaccaaccaaaaaaaaaaaaaaaactgtgggttcatcagaggtggtagggaagacaaaaacatgggaggagcagctgggattacgggcttgacccacaacatccagccccttttctcattattctttacccttttcttttccttattttctctttatcccatttttctttctcccttccctttctttcttttcgtttcctaacttatttaagggagtagatggaatttcaaaggtcttatatgtgtgtcaggtttttggttttccaacaaaataatttcttaaaaaccaaccatttgaaacgtaattggtaaccactgggccccttgttctccacctccacaccttaaaaagccccaaatccagatgtgtccattaaaatcagtccaaatcttctttaccaagccactagaatgtcatattaatttcacagcagaaatagggaagcccatgccggaagctgaaaacctgcaacaacaaaaaagcttctaaatactgcaaaaaaagaatactaacaaaaaagcg

SEQ ID NO: 484773 - DNA, 113 bp, Homo sapiens
ctcatggtgtggctgtcacatgtggctccagtgtcctcatccccgcatgcatactcgtagagtgtccactggtgcccagtggtgagggcacctcgaagaagggcctctgggcc

SEQ ID NO: 484774 - DNA, 1035 bp, Homo sapiens
cccacgcgtccggatggacgaggagacgcatcatctccgctgctcgccgctcctacgtctccgtcagggtgagatgatggtggggggctcgtggcgtcctggtcgcgcctgtcttggtgttcctggcgacccgccgtcatcgccttgggtccgagtgccccctctcactcgccgcacctctgggttggtatttgtccctgtgtctggggcactcgaatgctggcttcaaggagacccgggccagtgagcgggcagagatgatggagctcaagtgaccgctttgccatgctacatcgagaaggttcgcttcctggaacaggaaaacaaggcgctggctgctgagctgaaccagcatgcgggccaaggagcccaccaagctggcagacgtctaccaggctgagctgcgagagctgcggctgcggctcgatcaactcaccgccaacagcgcccggctggaggtcgagagggacaatctggcacaggacctggccactgtgaggcagaagctccaggatgaaaccaaactgaggctggacgccgagaacaagctggctgcctatagacaggaagcagatgaagccaccctggcccgtctggatctggagaggacgatggagtcgctggaggaggagatccggttcttgacggaaagatccacgaggcaggagggtcgggaactccaggacgcagctgggcccgacagcaaggtccatgtggagacttgacggtggccaagcaagacctcacgcaggccctggaagagaaaatccgggacgcaaggatgaaggcatggcagaccaagccaacatgcctgggaaggccgcaccagtggggcacaggcaccaaggtgatggcagaaccctgacagaaaggagtgcggggcacggaaacagacgacagacacagcacgggcaagcgacacaaaccaaaaaaaaccggggccacatgccggccctagaaccggcgaacgggggaggattcgtagacgagcgagaagaaacccaggcgacaacgaaaagcacaacagagcaagcc

SEQ ID NO: 484775 - DNA, 276 bp, Homo sapiens
aaagttgagaacaataatgaacaattattgtatgaacaattgttagaaacagctaatcacaaacaacctgcgggcacaatgacctcattccacacgtagcacccttcagcaggaccctataaaactttcctccagcccttacctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 484776 - DNA, 1427 bp, Homo sapiens
ccacgcgtcgtccgggcctgccatagagagggagcaccagggccatcgatgggcatcagtgagggcttgtgacacttcctagctcaccgctagaagcctagagagtgtggatgcgatagagcgagtctgagcccgagcattcgctgcagtcccacaggctggtccatcaggcacccacgtgcacgtgacagggacacgtgaggccacaagcagcgcgaagagaacccagagagaacccacacgcacgagagctacaatgagacagaagaggacatgaaacaccgagagaccagaccatgcaacagcaaaccgaacaacaaagacagcatacaggcaccaagacgtggcgaaacacaccaggaacaagaggagcaccgagagacatagagaacacaaaacgaacgcacaaaacatacacgaaaagaaagatgcaagacaaggaagagaccaccactagcagacacgacaaccgacacgaacacacacacagagccacacacacgaaacgcccacaggaggtagaacaccacacaaagcaaaacaaacaccaatggataacacagggactacgcaaaacaaaggacccatgaacaacagacacaccaacacacgaacacaaatggcgaccagaggaactaaggcaaaaccacagagcacgaaagccacgcaacagtcacacaggaaaaagaccacaccatagcaaccgccaaacactacaataacacaccgacacgaggaggagacagcacaggacaaagcaaggacaagagagacagcacaactacaatcacgagatgagcaacaacaccccagaagacgagacgaaaagccaaacagcagaagcagcaacaaaagacaggaaaagcacccataccaagagcaaaaacccaaacgaacaacgcatagagcgaaacgaccacaggcgaacaaaccaacgagaacagacaacacaagcaagccacacaaagcgagagctgacgtggataacaacacgcgaacaataagcaaacaaccaagcggaaaccaaacagacaacagacagaacacaacaccaaacacgacaacacaccaccagaaaaaaaacaacaaaaacgacaaacaaagacaacaacacgacaaaccacaaacaaaagagcaagcaagagtacgacgaggcaacaccacgaagaagcaagaagacagacacgacacaacaacgacacaaagaacaacagacacacgccgacagataagcatcaaaacgcagcaagaagatatggaagggacacacaccacaaacacaaaaagacagaggaaacaaacaagacataacaaaaatcaaacaaaaaagcacaaccacgcaaaatacacagaaacaagaaagaacacgaaacagccaggacgaaagacagcaaacgcaaacaacgaacaagaagagagaagcaaca

SEQ ID NO: 484777 - DNA, 768 bp, Homo sapiens
gggatcttatctttttagcctctctgggcttcagagctctcatctacattaagtttttcattcattctgtcattcaataaatatttatggaatgcttagcatgtgccactagtctagcaactgtggatactgaagtacgcaaggcagaatagtacttgctatctgaagcacacggtttaattggggtggggaaagagttggtggggagggtctcattaaacatataagccaaataaaccaaaattacaggtagagttaaggccatggcagagcaactgaaggtgatgaattcagagaggccaggaagggaccctctgaagcgatcatatctgaactgagtttttgagtcaactaaatgagatagtgtctgtgaatgtcttagaatcatgtctggcatgtaataagtgtcataaatgataagtattactatttataaaaacttgtcaaaaaatgaaccaaaaatacaagcagcttgtctttcacatattactatagttgcaacatgtatatgtctttgtatagtgagaaagcatattgtatgtatattatatttcatttgagtaagttattttttaactgaaggaatcttctattttggatctgaaatagtaactgtccttttaagtagtctcatttatccttgagagtgattaattacccacagcatctgtttaacattgtacttacagagaaatacaggcgaatgccacaatggttgttcctaagtagattcaatgttttctaggacttcatcctgtagttcttact

SEQ ID NO: 484778 - DNA, 207 bp, Homo sapiens
tagtggaccaagcgcggggcacatgcctgtatagcagcactttggcaggctgaggcgggcagatcacgaggtcaggagttcgagaccagcctgaccaacatagattctggccagatgcagtggcccatgcctgtaatcccagtactgtgggaggccaaggtaggcggatcgcttgagtccacatttttgcgcttgagtccacatttt

SEQ ID NO: 484779 - DNA, 575 bp, Homo sapiens
gtgacgtggaacggaaaagggaggagccaaaagaacaaagatccaagacaatatgcacttcatattgtaatacaatcaccagactagggccatcttatttccacatgcccagaccaggaaggcacaggtgccgtggggaatccagagggattcctactacaagtatttaacaggctgagacagctgataacaacaagggaaacagagaagccagagaggagcctgctgggtgtgacctactgactccaatgagccactctcagtttgccttctctgtgtatttgggtcttccaaccagttgccctcacagagggcttaggaaacactgcagctgctgcccggaactgcttatgacgcctgcaagcctggtgggtgtcaagggatggcagaccagagtggcacagaactgtcatcgtatgggcccttgcatgttccctatgtttggaatctggggtaggctcttggaaagcctacattctttttattgagattttcttgagatggagtttctctcttgttgcccaggctggagtgcaatggcacgatctcgactcattgccatttccacttctggg

SEQ ID NO: 484780 - DNA, 210 bp, Homo sapiens
  misc_feature (23)..(23): n is a, c, g, or t
  misc_feature (154)..(154): n is a, c, g, or t
aagatgagggagcctactctatnagttctggaaggatagggaagatgaaagccacccccatggcacccaagcaagcaatgaagcagtatatgcaaaagctaatcagctttgaacaccatgagattttcagctaccctgaaatacatttctttgngtccaaggcaaagaagcaccaaggcaggcccaacaacagtagctatgatgatgacc

SEQ ID NO: 484781 - DNA, 173 bp, Homo sapiens
  misc_feature (79)..(79): n is a, c, g, or t
cgggtgcgttgccgagcgcgcgcacaaatgggctgcatgatgccttgcgtgcggatcgactcgtgccagctcgcccaangcgccctcgtccatgcgagtgcgcggctggtacttgccggctcgcatcttcgaaacaggcaaggtggacggcagaccctcgggcttggccggag

SEQ ID NO: 484782 - DNA, 336 bp, Homo sapiens
  misc_feature (315)..(315): n is a, c, g, or t
  misc_feature (328)..(328): n is a, c, g, or t
cacgaggggtcgtcaccgtgaccccctacgaggacccggccgaggcgatccgcatcgccaacgactccgactacggtctggccgcgatgatcaccggctccgactctctgaaggcggtcgagatcgcccgtcagctacgcacgggcaacgtctggatcaatgcgggcggcaacatcggcaacgcgccgttcggcggcttcaagctgtccggcatcggccgcgagggcggcgtctggggcatgcacgagttcaccgaggtgcagcacatcgtctggcgcagctgaggcgacggcccctcgccgcgacgcggccgtnggccgcgacgatnactccgcg

SEQ ID NO: 484783 - DNA, 763 bp, Homo sapiens
aacggagatgtacaggcgttcaccgtgtttatttcattcacgggcctgggcctttcgttttacattacattgtcctcgtctgtacaatattgacctggcattctcaagaaccagctaggaaagcctgcagaggcgtgtagaacacgaagtcaacagtaggagtgggccaggatggctcgctgttgtcctccccgaatcctcaacggagatatcctaggctagaactatagtggtaggccaaactagaggagcatcacgcagtaacttggcagctatacagctagtaggagacacctaggcgactagaccatactatagacgagctacagcgcatatagctagtgcccaacgtaggagcaacgacatataaagaggactcatattgcacgtatagctaacagcaacgggagcccagacatagctactagagtagccataggaaagaggcaggatgagcagctcacgccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagtcaggtagatgctctgatcctccagtattctctctggcaatgtaccacggcttctccttctggagctgctca

SEQ ID NO: 484784 - DNA, 1061 bp, Homo sapiens
ggctgggcaaggtgacacgtgcctgtaagtgtcagctactggggaggctgaggcaggaggatgcttgagtcaaggagttcaaaaccagcccaggcagcatacgtaaggacccacaatcatcaaaacaaacaagaaagaaacagaaagaacaaaaaagaacaaattggtgctgcggcaccgcgcctgggcgcactcggagaaaaagcttgttacaaccacacaggcggttgggcgccgcgcggagcgcccacagaaagtgtaacggcgaacccatgggccaataacggggcgtccccacaaagagagaagacccgtggaccgcagacaaaacggtgggcttgggagcttaacacacaataaaaaaacgcgcccagggggaaaaccgggacgtgtctaagaacaaataccaaagaggggagaactcacggaggaggaaaaaaaacggggagactatataacagaagaggagagtacgcaaaggacgagactccagaatagtcaaaaatattcccgcccgggccatggggagaaacaaacaaaaatcaacaaaaccacagagtcagcgaagcacaacacaagagtagacggaaagatgcacaacgaacaagacaagagagaacaaggagacgtaaaagacgtgagaccgaagacagcggaaggacagtcatacagcaaccagatgagaaagacagaagacggcagccaaagaaaacaagagccaccgacgagaacgcaaacagcagagagacgagacacaccgaggaacacaccagacgaaacgcgcaggacagcctgcagagcaaccacacacgataacctcacctagacataagaccagacaggacaaacacaagagaacggaagaagcacgaacaggagcaagcagcacaggacactaccgcacagacgaacagaagagtacaaggaagcagagcagcacgagcgagcagaaacagaaccgacgacgaagacagcaaactagacaaaacgaaggacaacagaagctacacgaaaaaaagagaaaacccagtagggagaacgagcagaagaagaacaagaga

SEQ ID NO: 484785 - DNA, 355 bp, Homo sapiens
ctataatcccagcctttgggaggccaaggcagaacggattgcttgacgcccaggagttcgagaccagcctgggcaacagggcaaaaacctgtctctatcaaaagcacaaaataagctgggcattatagtgcacacctgaaagtcacgagctactcacggaggctgacgatgggaggatggttatgagcccggagaggcagcaggctgtattgagcatgagatcataccactgcaacttcagcctgggatgacgagccagacccgtctcaaaaaaaaataaaacataaaaataaataactacataaatagttttctttttggccggttgcggtggctgatgcctgcaatcccatcc

SEQ ID NO: 484786 - DNA, 148 bp, Homo sapiens
ttcttagagcatttatcgccttctattatgtttaaaattttacttatctggtggctggctggctccccttactagagtatatgctgcctttgtgtgtgtgtgcgtgagtgtgtgtgtgtctgggtgtgtgtgtgtgtttctttttttc

SEQ ID NO: 484787 - DNA, 414 bp, Homo sapiens
gaactccctgtcagatggttgggccttttgggatagattctgtgagtcccttctttcctacctttgcttgtagataagactttcccttgaatcccaaacacacacactctctctgctttttaaaaaattagttttggggctggatgtagtggcttacacctgtagtccccaggcactttgggaggccgaggcaggcagatcgcttgaggtcaggagttccagaccagcctggccaacgtggtgaaaccctgtctctactaaaaatacaaaaagtagctgaatgtggtggtgtgcacctgtagtcccggctgctcaggaggctgaggcaggagactggcttgaacccgggtggcagaggttgcagtgagccgaaatcacaccactgtactccagcctggtgacagagccagactc

SEQ ID NO: 484788 - DNA, 743 bp, Homo sapiens
ccgtcttaaaaaaacaaaaaaaaagaacgcccttttactgtcctcatcatcccagtttgaggcagtgctggagttggggaaggccgtcttagaccatagaggttggaagacgctgagagatcatccagcccagcccctttgatgttccagagctagaagaacagatgcccaaacaggagaaaggcacttgcccacggtcatacggcaggttgccacaaaaccaagatggcagcccttcctcagcgtgcctcactgccactcccagaagccagggagcccctataaaacccactatcatgtcttaaagagttatatctgggctccttgaaccagcaatcggccctgggaagccaccaaggtggggacaaagcgcctctggccagaagtcccaggcctttgggattgacagaacagctttgcccgaacacttcgggccccacttcaaggcatgtagggccattttctggcccctgtgaccccttcccgtggcattgggagcgtggggacggggctggcctttgggaaggagcggcaggggcattcaccttccttctgcgtgcttctcccgtgtttcttaccctcaggggcctgggggcttgcccagcttgcctctagtgcccttcggggggatctcagcccatgtgctgacacttcgtgcaatccagagaaagcactaaataaagcaatacggtgtttggccaaaaacaaacaaaaaaaaagggggggccgcctcaagagagtac

SEQ ID NO: 484789 - DNA, 422 bp, Homo sapiens
agggacccctgctggaaaccagacgctaaagcttgcagctgtgagctaggggatcatctgttttccacttgagagcaacccgggcacgcgagaacagcccgatttcggtgcaggggtgcgtcccgaagaacgggggactgttactgcgcggacaggcggacccggcaggaagaccgaggccacgctaggtccgcagccccgaggtgtccacaagagctccgctcgcgcagagggccgatgcgaggcgtgcccgcgggaccggcctgcggacgagtcggccaacgagtggataaagaaaatgtgatatatatgcactatggaatactaagccataagaaggaatgaaataatggcatttgcagcaacctagatggagttggagaccattattctaagtgaagtaactcaagaatggaaaacca

SEQ ID NO: 484790 - DNA, 164 bp, Homo sapiens
  misc_feature (85)..(85): n is a, c, g, or t
tcaactagtgcatttcacaaaagacaatatagctatgcatttatttattcattcaaatagataatattgtcctattctttcaccnctttcatttcattttgagtcttacacttgtattgctccaaattttaaggacaaaatgaaatgaagggtgaaagaaaagg

SEQ ID NO: 484791 - DNA, 460 bp, Homo sapiens
  misc_feature (330)..(330): n is a, c, g, or t
aagtatatcatagcatgattcctaacccactcaaacgcatgagatcttcaacaaatctttatactaaacaatgaatgcccaaacataccattaatcggcctactccatagctgcagcagtgaaaatcagctcaatatcggactacattccctgatatgccctacagcaatagcaaggcccacactcccgatatcagacattactacactccatgtacaatcagtagtagcaggggatatttcatactcatcctgcttctacccctttaatagacaactaacgaaactagttcaaacatataacacatatgcctaggtagctatcaccacncttatttacagcactatgtgcaatcacacaaaatgatatcaaaaaaatcgtagccttctcaacttcaagccaactaggcttgataatagtgacaatcggcatcaaccaaccccaccatctaatcggaaag

SEQ ID NO: 484792 - DNA, 376 bp, Homo sapiens
  misc_feature (6)..(6): n is a, c, g, or t
  misc_feature (25)..(25): n is a, c, g, or t
  misc_feature (51)..(51): n is a, c, g, or t
  misc_feature (115)..(115): n is a, c, g, or t
  misc_feature (117)..(117): n is a, c, g, or t
  misc_feature (189)..(189): n is a, c, g, or t
  misc_feature (336)..(336): n is a, c, g, or t
  misc_feature (351)..(351): n is a, c, g, or t
ttttanacacgtgggtctgtttttngggtccaacctcctcacttgggtcantccctgtcattgaacagccccagaggaaaaccaaactaaaagaacagcaaggcccaggcgtggntntcacgcctgtaatcctagcactttgggaggctgaggcaggtggatcacctgaggtcagaatttcgagactancctggtcaacatggtgaaaccccgtctctactaaaaatacaaaaattagccgggcatcgtggtgtgtgcctgtaatcccagctactccggaggctgaggcaggagaattgctggaacccagttggcagaggctgcagtgagccaagntcacgccactgcacnccaggctgggtgatagagcggactc

SEQ ID NO: 484793 - DNA, 137 bp, Homo sapiens
  misc_feature (89)..(89): n is a, c, g, or t
caggagctcaatacaataaatacacacaataacaattggccttaaaaggtgactgcactatatactaaaaagacttaatagaaggtccngcagattattgagattgttgatgcagtagatgaataatggcaaaaaaa

SEQ ID NO: 484794 - DNA, 540 bp, Homo sapiens
ctgcgctaggatgttggctcacagagtagagggcaactgagaccagagaggaaaaatgggatctggccacttacttattttctaggcttagggagagtacagaaggaggcacaaaagattccaactagtttaactagtccagttccccagagggatatgagacaggaactcaggacagagcctctgtaaggtggtgaattgaaaagctttcactgttgctgttctgtgcaggaaagcacgaggctggagcaacttactcccgtatccagcactactgtactagcccacctgggacactgaataacatcagagaaaaggctacaaacctaaaaaaagggaggctccaatccattcaagccatcaaggtcatcttggagccaggtgtttgcagatagggggctatatttgataaatccggtttataaaaacacagggcagctccaattaaccacatttcagtccaggttaatccatatatacttgttctcttcttggatgtagggcctgtgcggacactgaggtatgaagaaactgggactc

SEQ ID NO: 484795 - DNA, 127 bp, Homo sapiens
taggctacacacataacttgctagtataatgcatttgttcttggaacatgtgtgttttgcacactttggtttccacctgctttttgggagatgtactatatgatgcataaaagatccggagctagct

SEQ ID NO: 484796 - DNA, 148 bp, Homo sapiens
ttagacacctatgcagatcaataatgggagcaggttacaatgttacttcatcccacagtttatttctatacttgagttctataatgtacagaagatagaccttgaattaaatgcgcatagtatatatatcattttcgtggcgagtccg

SEQ ID NO: 484797 - DNA, 112 bp, Homo sapiens
ccccccccccccccgggaaatttgggggaacaggttaatttttcccccgccctagggaccggttttggggtttcccccccccgggttattaaaaaaattaggttttttccca

SEQ ID NO: 484798 - DNA, 250 bp, Homo sapiens
tgcccccccccaattttgggtggggggcccccccccccccgttgtttttcccccccttttgggaccccggggggccggttccccccccccggtttttttcccttggcccgggggggggtttccttttttcccccgggccccgcttttccccttgggccctttttggggccccttttgccccggttttttcccaaacccggggggggcccggtccggttttcccggggtttttttcccccccggggcccga

SEQ ID NO: 484799 - DNA, 253 bp, Homo sapiens
  misc_feature (35)..(35): n is a, c, g, or t
  misc_feature (168)..(168): n is a, c, g, or t
  misc_feature (212)..(212): n is a, c, g, or t
  misc_feature (249)..(249): n is a, c, g, or t
ccaagcttacacctccagtcctggttctggctgtncaccctgggcctaggggacgccagagggacaccccaggctaagggttcttcccaccttcaacatttccctgggccacagcaccaatctcggcccagaatgtacacaacgctagctgcccctttccaccctgtncaccccgaatctgcccctatccccttctctgcttcctgcactgnacacctgctaagtcccagacccctccccccaagcttnccca

SEQ ID NO: 484800 - DNA, 352 bp, Homo sapiens
  misc_feature (20)..(20): n is a, c, g, or t
  misc_feature (54)..(54): n is a, c, g, or t
  misc_feature (65)..(65): n is a, c, g, or t
  misc_feature (283)..(283): n is a, c, g, or t
ccattaaaattccaactggnggtgaaataaaccatatccccacacctaccccancccaattggcnttatgccttttccagaaatggtgtgtcagtagaaagatgtgtgtcccatacccagaactggctactgatattttatcctagggtatagatctttctcatgttataaaatatcaataagaattgatgaattctgcacacattcatcagcatcagaatattcttttaattccatttaaaaatagagttggaatagaatgaagaaaggctactatttgggnaaatacatttctgaacatttggaaagctgttatatgttttccatagtcttttttgttttagattatttg

SEQ ID NO: 484801 - DNA, 305 bp, Homo sapiens
tttgctcttaattcaaaaaattaattctgacacactcaactccactttcctaacacagagcagtttgttgttaactttctttcaattcaaaaatacatataacataaaatttcccatcttaaccatttttaagagcacagtttggccgggctcgatggctcacgcctgtaatcccagcactttgggaggccgaggtaggcggatcatgaggtcaggagatcgagcccctcttggctaacccagtgaaacccaaaataaactaaaaacacaaaaaaaaaattagctgggcgtggtgacacgcaccg

SEQ ID NO: 484802 - DNA, 302 bp, Homo sapiens
tcccggattgactggctgtggctggaatttggttcaaaacatgggtcagggctgggcgtggtggctcatgcctgtaatcccagcactttgggaggccgaggcgggcggatcatctgaggtcaggagttcaagaccagcctgaccaatatggagaaaccctgtctctactaaaaatacaaaattagccaggcatggtggtgcacgcctgtaatcccagctactcgggaggctgaggcaggaaaagcgcttgaacccaggaggcggaggttgccatgagccgagatcgagccattgcactccgg

SEQ ID NO: 484803 - DNA, 243 bp, Homo sapiens
aatttagatttaggtttccttcctgcttcccccccccttcgaataaggaaacgtctttggggccccctttatggaataaataagctgagctgtatttcaagtaaaatagttataaattaccaatgtagcagttattgataaagaaatttagaaaactgaaacgtgcccggagtattggaaataacgtagtacatcccctagcccaatgacccaaagtaggggctcaataaatttatgcttata

SEQ ID NO: 484804 - DNA, 153 bp, Homo sapiens
actacccatgatacagtatagggaaaccacccccatgattcaattatctcccaccaggtccctcccacaacatgtgggaattgtgggagctacaattcaagatgagatttgggtgggaacacagccaaaccatatcacaccctgcctcttaaa

SEQ ID NO: 484805 - DNA, 240 bp, Homo sapiens
tacatttcccaaaaggctttgctccaggagtccaggaaaaacaaggccccttggccccggggcctgctgggacttgtagttgcctaaacagggcccccccctgcacttccggacccccccctggaggccccgttaggcgttggtgtttcctggatgctactagccccaaccccggggctttgcatggggcccaggggaggccttagcttggatttaccctgtaataaaaactcctgtgga

SEQ ID NO: 484806 - DNA, 875 bp, Homo sapiens
  misc_feature (875)..(875): n is a, c, g, or t
aatataataaatgtatagtgttatagaataaaaaaaagatacccggccgcatccgagtttattatgaatagatagacttttcagaatttacaatacgcccacattgttcattccaaagatagcttttgaatagaagcaatcacccacatccttctgtttacaatacatgcaatggaagactttaatttgctcttcttataattaagcttccattacaattaccaattttaagcagacatttgaaaacaccaagccaaatatatccttcttcagtttaattaacatggcctattgtcttacaggaaaaaatacaaaattaagattaattattataaggaactcacctcaacctcaggattatatgactagagatagtgtcagcaaaaataactatacacattgaaaaccatctatggcactataaatcttatattatgtttggcgaatcataatcttaaaacaaggataataccctattctactcttagaagccttgtgttaatcatatgctgcaatctgtacaacagaacatgggatacgtgcatcccaaatccgaataaaagatgtgcgcgaagaaacgtacatttttatttcaaaacctacccacacgaaacaacccctatgtatattattaaagtgtaggctccaccaaccggagcaaaatgtgtaaagaataatatttaagaagctgcaccgaaaaaggttgagttgacaataaatgcatataaaaagggcaagtaaataacccttagcgtgtaagaagggtgggcacactactccaatggagccgcctaaaataataggagaaacaaaaattagatgccccaacacagggatcaaagattgtgttatctccatggtttttaccacagttn

SEQ ID NO: 484807 - DNA, 326 bp, Homo sapiens
ctactactactaaattcgcggccgcgtcgacgacctttctattttgaaataatttcatacttaagaaaagtttgcgcctgtaatcctagcactttgggaggccgaggcatgagcccaggggtttgagaccagcctgggcaacatggcaaaaccctgtctttacctaaaatacaaaaattagctgggcgtggtggtgtgcccttgtagtcccagctacttgggaggctgaggtacgagaattgcttgagcctgggaggccaaggctgcagtgagccgagatctcaccattgcactcctgcctgggtgacagagtaagaccctgtctc

SEQ ID NO: 484808 - DNA, 310 bp, Homo sapiens
ccccccccccccccaaaaaatgggccccgggcaaagccccccccagggttcccccgggggggggggcccccccttttttcccccggcccccagggaggggcccccccaccccccccggggcccccctggggggctggggcccttttaacccaaatggggggacccccttcccccccttttttttttcaaggggggccccgggcccccctggggggggggggttgggccccctgggtttccctttatttttttaccttttttttttttttaggggggggttttataaaggaaaaaacccttttttttttta

SEQ ID NO: 484809 - DNA, 392 bp, Homo sapiens
attttctaattagaaaattaggtctgtcattttgagttaaattttgtgtatggtgtgaggtaggggtccaaattcatcctctttgcacatggatattcatttgcttcagcaccacttgttgaacagactttttttcctattgaagtgtcttgtcactttttttcaaaaatcagtatttcatggatgtttgggtttatttctggactttctatttcattgatctacttgtcacttcttatgccagtacgacactgtctcaattactatagctttgtagtgagttttgaaatcaggaagtgtgagaccttcaactttgtttttttcccaaggttatttggctgcgtcttttgtatttccataagaattttaggatcagcttgtcaattgttgcc

SEQ ID NO: 484810 - DNA, 413 bp, Homo sapiens
aagccctgctgaccttgttgagtgctcttaggatctagcagctaactggttaaagtctgtatcccatgactagctctaattatgggcttcataccgtaccatgtttgcagcactcgtcaattttgcaaacagtgaaatttatccaggaatctaatattctcttgaatctgatcttaagtggttaacctctcattagcattaaacactacttttgatagtatgtccacattaaatgctccatacagaagtgttacttagagacaacatggacgatttctttaagaaaggaaccatgctttcctctccagcgcagccaatgggctgaaggcctgtttccattctccattcttccagcataaatctacaactcacttggcacacaaacctgattttaacaggcaccctcatccaga

SEQ ID NO: 484811 - DNA, 1872 bp, Homo sapiens
gcggtcggttgtgtgcaatcagcctcatactcagttgtcgtagtagacggcgtctgcatatacacgcgtcgtgctgtccgtttgagcacgctcgtgaatcgccgcgcgactctcgcgttgcaggatcctgcatctgttcgctttgctgtttacactcagatgtcccgcgctgctcggtcatggtggtgcgtcgacagagaggatatgtcggtgtaggagtgagggtctcgcgtagtgcttcttctgtagttgtatgcttgtggatgtgtgggatgagagtaggaggtagtggtggagtcgacagatgtattgcggagggtgggtataatcatctgtgagttgttgaagagacgtatgttagtagaggattaggacttatcatttgagactaagttaatgggaggtagaaataccgtagtattatattgtttttggcagatatttcattatgaaaactttcgctccctatctgggctttccgttgtggcttgattgtcttcccttttcttctgtctttctgttcttctgttgctttgcctcctctgcgcgttgtgttgacgtcgtcctctattcttgtgtgtatggcgcgctttctgccggttgtctcacttctctggttcgtgtctggctttttgtgggtatggtggtttttactgtttagttgaagttgtgtttgggtgtttgttatcgtttgttttgttgatcgttgaggtgcttgtgtatttgtgcgtatgtggggtggtgagtaagacacggtggttggggagtgttattagaatatgatgatgagtgtgtgcgtggagtgtttgtagtgttgtttgtgggtagtgggggagaggacaaggttgttagagtctcttgtgtgttgtaaggtagggttgtatgtggttggacagaggcttgtagggtggggagatccgttattggtgggagttggtggtagggggagagtgtgtgttagatgtagcgagaagtggacacgatttggcgttggggtaacggttatgagtgggtgttttcttattagtggaatgaggttggttggatgaggtgagtgagagttgtggcattgtggagtattgtgttggatgaaatacggtgtggtagggtgtgtatgaggttgtaggtgatgtgatgggagtgtgggggccgttgtgagagtttcggtgtagtctggtatcgtgggttgtatcggcggactgggtcggcgccctagatggcaagtgcgcacgcatgtgtcggcggggcgagtgctgtgcaagattcgcgtgtggctccgtgtggggtgcggtgggcctgtgctattgggccgtcaatggatttgcgtgttggcgtgaatggttagcgagtataggatggagatggcttttgcattgggtctgccttgcctgtttataactgcggcgcttagtgttttagctctcatcgtctctttaaattattggcaccgggttcatgtgagccaggtgttcgtgagtcatctgtagtgattccgtgtgcacgttgtccgcgtggtaagcctgtactgctgctagcgtgcgctgcaaggccgtccctagacgccgcgtggtaatccctagccacgcgtgtccctgagctggagtaagtgaacatcaagatatgtgtcttagattgtgcagggtgctaaacttagcaagttggagccccatgaggaacaggggcaatctctgggctgagcctactgtctccttcccacatgtcctttctccaggccacgtcagatggcacagttcacgggatgggcgtgactgcggagtcgggtatcgccacctgccagcccacagtgctcagttgtacttatttattaagctgtaatatctattttgtatacatccgggggctttattcctg

SEQ ID NO: 484812 - DNA, 182 bp, Homo sapiens
ccggcccagcctcccaagtagttgggactacatggcaggcaccaccacaccgtggacctaattattctgtagatgacgggtcttgctgtgttgtccaggctggtcttgaactcctgagctaaagccatttacctgcctccgactcccggagtgctgggtattacagagtgtgagctaccaca

SEQ ID NO: 484813 - DNA, 768 bp, Homo sapiens
cgcaaggcctgaatgatgtgagctgagcccaggcgccacactgatgccacctcaggagggtgggaccttggagcctgcggggtgcctcgcgcccctccagtccccggtgccggactctctgctggctctcgctccaccaactcaagtgttagcacatgccccatgatatgctgcccggtgctgccctgatgggtcggactgtcttgtgtgtctggggtctctggcgttccaactccaaggcctataccagtctgtgtacagtgccatctctctgtgcttctgttgcccctcactcaccaaagcacgtgtatttatagcaaagaaaaaaaaaaacaatcaacaacaaagcaagatagaaagaaagataatagaacaaacatagataaagcaaacaagaacacacacaggaaagaacatgacacacaaaaacaaatgacaaagcaagggaatcaccgaatgacagatacatccaagagagataagagtaggaagaaaggtgaaatgaaggggctgtcgggatagatattcaagaacatcttgaagaagcatgaaatgcaaatggatcaaggaaagccataacaagactcaggaactgaggaggtgaacattaagtgagaggccaagaacacaaaagcctttaaaaatgacgggtagtgatgcaacaaaaaagacatctgggcaaaactaggaattccatgacttaacagaaaaaaggcaggacccaatctcctaacagaaacagactcctaggtggacgtaaaatgtcca

SEQ ID NO: 484814 - DNA, 255 bp, Homo sapiens
ccccttttaaaaaaaccccttggaaacccccctgcccaaaattaccccgggtggcccttatagggaacgggattgattccggattttaaaggttcccggttgtgtttttaaaaaaccgaagggttttttttttagggccccctttttggttaccggtaaaggtttaaaaacttaactgtttgggggggtttttgtgggtttttttcccagggaaatttgaaggattccgaaatttaaatatttttttttttttta

SEQ ID NO: 484815 - DNA, 690 bp, Homo sapiens
ctgaggcccacaagggccacagggagccccctttctgcgtcagcctggcgccacacgaggttacccgttgtcgtctggagttgaaatttatagcggcacagtactcgccaatgagaggagcacacctcttcatgtgggcagctgcgcaataatgttctcgggaggcacctttgataaaggagcggctgggtcccctgtggtaaactcacgaggtatctgcttccctcgagagagaactcacctcagagccttcactgaagctgcacaatctcactcacctggagattgttccacgcgagctggagaccaagctgaggagagaaatgcctcttgccacgtgtcactcctcttttgggaccacagccatagcacgctccacattttctggagatctgggtctttccgacggccacggaggcttgcctttccgcctgaggtccacgaattggcacggtggagactacgagtgcaataacaccactggcggagaaactggagtcctggcacgcgaaggaggaacccacgaacgctggtttgagagtacttttcctgggagggggccttccagcatgtgggccaagccttcaatcagggcaagatcttcaagtgaacatctcttgccatcacctagctgcctgcacctgccctttcagggagatgggggtcacttaaaggaaactgaacatttga

SEQ ID NO: 484816 - DNA, 369 bp, Homo sapiens
ctcggtaccattggtcagagagaattagctgaaccaggcccttttggacttcatgccctgtgtgttctgcccgcacggacccccatctctgttgacttcctgtgagactcacttcctatgattaggcattgatcgctttactcagtgacgagttgttgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaatttctctcggaccaatg

SEQ ID NO: 484817 - DNA, 311 bp, Homo sapiens
actcggtttggctcctgcctttctattagctcttagttcgattacacattcagctccccgttccagtgagttctccctctaaatcaccacgatcgctagggactagcatcaggcacgcagcagatgcagctcagaacgcttagcctagtcctcacccccactagaacagtctgtattctccttcagtcaataacgaaagttaactaagctatactaaccccagggttggtccattgcgtgccagccaccgcggtcacacgattaacccgagtcagtagaggctaccgggtgggaagatttatgagttgagg

SEQ ID NO: 484818 - DNA, 599 bp, Homo sapiens
  misc_feature (58)..(58): n is a, c, g, or t
  misc_feature (62)..(62): n is a, c, g, or t
  misc_feature (97)..(97): n is a, c, g, or t
  misc_feature (109)..(109): n is a, c, g, or t
  misc_feature (111)..(111): n is a, c, g, or t
  misc_feature (124)..(124): n is a, c, g, or t
  misc_feature (135)..(135): n is a, c, g, or t
  misc_feature (138)..(138): n is a, c, g, or t
  misc_feature (159)..(159): n is a, c, g, or t
  misc_feature (167)..(167): n is a, c, g, or t
  misc_feature (210)..(210): n is a, c, g, or t
  misc_feature (223)..(224): n is a, c, g, or t
  misc_feature (265)..(266): n is a, c, g, or t
  misc_feature (349)..(349): n is a, c, g, or t
  misc_feature (520)..(520): n is a, c, g, or t
  misc_feature (522)..(522): n is a, c, g, or t
  misc_feature (565)..(565): n is a, c, g, or t
ctatctgctcattgtttttcagttgtctcatactcttttttttttttcctggaaattnaaanagaaaagctttactaaatattgacatttatttttnctccaaattttncntttagtgaaattngattatctctngtngctccgttatcatcatcaganggcttcanaaggtgtttctgataatggcgggcgaaatttcttttttttgtnggcaattacttannctgggaatttggctttttgcttaattggtcatgtgggtganncctccccattgcggttaggtttccggtatctggctttttttttttttttggcgatggcattaacagggttttgccgggttttnagggtgggggctttcttgggggttactttttgtttccgggttgggtggcggggcgcccgtgggcccatctgggggtggatggctgtgtctcccagtcctgggccgggttgctgggacggctcacacccggatgagaggcctttttggtgttgtgtccaggtgggcagaagnancttgatccaactacagagatattgttgttatgaaggtagacancctggatgtacttatgctctgccagcccaccagg

SEQ ID NO: 484819 - DNA, 322 bp, Homo sapiens
ctgatcaccagcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccagagggaagggcatcgtggactccctcttccag

SEQ ID NO: 484820 - DNA, 454 bp, Homo sapiens
cacaactttgctgttcatacccttaccttcttactacttttggtttggaggagggtatcaccactagaaagtgtgcctccttaagatttcttaaaggaaagttagtttcagtatttcacagcaagttggactacaaaatctagagttgatctgctttttaaaccttcatttaaaagcaaacttggaagaaatttgaaactgatgtttttaatatatgtctgtgttgcctaggttttctttttttaaagaggtatgtaattaaaacctttgtaaaatttgccaactaatattagggccgcgctccccatatgggcaacatttttaaagccgacagtatttcacacttcttcttaaaaaagaaggagtgagtgcctccagttccaactttttataaagaagctactccctttttagggggcacactttttacagcgagtcataaaaggtttactcc

SEQ ID NO: 484821 - DNA, 405 bp, Homo sapiens
tcatgttatgtttgcggaggaaccgtaacaggagatcaatggccataggaagcccgagaattagttcccacagacccagttcctgatgaattcccagcccaaaagaaccaccctgacaatttttaggttctaaaagtctcaattattagacagtattgcacagctattgaaggaaaacaattcactcattctatagggcggcttagttgtcttgggcaaaagctgtataatggtaccacaaaaacagttacatggtgggagttccaattacacagaaagaaatccattcagtaaatttccaaagttgcagactgtttagggcccacccaggaattccaccagggactgggacagcccccaccaggttatactgggatatgtgggacacagagcttatttttaagg

SEQ ID NO: 484822 - DNA, 211 bp, Homo sapiens
acggtcggtcagtagggctcaaacatccagcatctgcccagtcatcacagcaggtagtgctctaaatgctgtgctagcctgccttcatcctccagatccatgcaggcaggagacaccccacggacaccagagggctcctccttactttagatctggttagcaccaaggtcatgcactgtaagacgtgaatgttctgggcaacacaccaaca

SEQ ID NO: 484823 - DNA, 112 bp, Homo sapiens
aggacccctctctaccaccgaacaggcctctacacctactacaacgacagaaggacaagctgcaaatcgtgtagatgcccccgagcccacaacgcactccagacctcatcat

SEQ ID NO: 484824 - DNA, 560 bp, Homo sapiens
  misc_feature (12)..(12): n is a, c, g, or t
  misc_feature (30)..(30): n is a, c, g, or t
  misc_feature (53)..(53): n is a, c, g, or t
  misc_feature (58)..(58): n is a, c, g, or t
  misc_feature (79)..(79): n is a, c, g, or t
  misc_feature (116)..(116): n is a, c, g, or t
  misc_feature (183)..(183): n is a, c, g, or t
  misc_feature (313)..(313): n is a, c, g, or t
  misc_feature (360)..(360): n is a, c, g, or t
  misc_feature (382)..(382): n is a, c, g, or t
  misc_feature (404)..(404): n is a, c, g, or t
  misc_feature (410)..(410): n is a, c, g, or t
  misc_feature (487)..(487): n is a, c, g, or t
  misc_feature (517)..(517): n is a, c, g, or t
  misc_feature (526)..(526): n is a, c, g, or t
ggcaagcaattnaagccagggccggaaccnggaagagaacctccacccaaacnccttngggtgaagtgagacttgtccngctaaacaacatctctactctcctgcaagtctggcancctccccactctctcctcagctcaatcccaaataaacaccttaagccaaaccttgattcaagtgtcnggctcaagtttgtgctctgggagagcccaggctacaatagcactgctcaacttcttaattttgccaatccactgtgcagaaaatggcatctcattgtattaattttcatttcactgctccctaataattnggaacacttattaatataaatgtgggtggtcagtgatccctccctcngaattaattggtatagcaattnctaagatttttgggcattcctnaatatnccttgattccttgatcatcctatataagtttttttgttttgttttgttttgttttgagatggagtctcgctatgtcnccaggatgaagagcagtggcgcaatctcgntcatcgaantctgctgccgggttcacgtcattctcctcctcag

SEQ ID NO: 484825 - DNA, 335 bp, Homo sapiens
  misc_feature (13)..(13): n is a, c, g, or t
gctatgcttttanaacacaccccttcccccacccccaaccccccggcaattaccgcccctattcccccgtaactgtagttttgcccttttccgagaatatccatataaataatcatgtattatgtaacattcctgagacaggcttctttcaccccagcataatgccctttgagattcatcccagatcgttgtgtgtatcagtagtttgtttttattactgggttatagttcattgtatggatataccacagtttctttagccattcacccactgaaagtcatttgggttgtttctaggctttggtgattatgaataaagctgctatcaacatcca

SEQ ID NO: 484826 - DNA, 104 bp, Homo sapiens
cattgacaatgatcacgaattcccctttttgtgtgaaaatcgtacccaaatcatactaccgagctcgaaaccgagctctagtcagagctgtttgctagaggtga

SEQ ID NO: 484827 - DNA, 693 bp, Homo sapiens
ccctcccctataataaaaaatttttcccctttaatgtccgcccccaaaaaccatttccttaaaggcctccaagccgggaagcccctttccaaacccctcccaccaaacctatttaatctaacctttcaagacgtcagggaaatagaaccggtgttaactatcgggcccgcatcaatctaagtcctattggccttccaatccataagaatccttacaataacaaaaaaggtcaaggatccctccctacccatcaaatcatttggccaccaatggtactgaacctacaagtaccccgactacgggggaataattttcaactcctacatacttcccccccatgtcatagatgggtccagggctgatcacatatctcgttctccatgaagtagcgctctcagtgtacagggcctctgtgaccattaatcctgtgacagacagttctggattccaatcgagtcccgtcaagaggccagtaatccaaagccattcgggatttttgtttccttgatacttttattttactggttgtgaggacagggcaggtcagtgccctcaaccttgtgcatctgtccccagtttcacccccatcgtcctagaatgcatgcgcagagtttgccttcccatggccaccgtttttcccggatagccccccgtaagccccctctttagcaattcagctggttcctccaaaaa

SEQ ID NO: 484828 - DNA, 219 bp, Homo sapiens
gacattgcgcaccgagtggccctgccgcatttggtctttgaggactgcggtaagtaatccgagcatgtagttgattgagcgcggcgaccacggtttgcgcgccttccctgtcggggaagacaggccgccgttgcggagttttgtcacgaggtcgtcgatgctgcgtttggtgagcttgtgcacctcgatctcgcccagttcggcgatggctgccgcgag

SEQ ID NO: 484829 - DNA, 651 bp, Homo sapiens
tacgttgacctgtaccgtaagaaatgttgtatcctgaagaagtgctaacaagttacaggtctgcattagccggagatccaagttaatgccctaaggtcgtacattttgggggtgcatattgcaaacaatgacccagcaagaatggtctagctcgaaagccttgcagcaggtccggtctcaatgtctacttctgcagaatagggtgcagtgcagtgatgtgccgcgggtcctttaatcaagtgccagaattttcagggctgttccacgtgcttgtacacccatctcagtgctgtaacgctgttctcctagtacactgccgtaactgtatgcattagtaccttattgcatactcaccctgaacaaagcccagctagctttgagcaattatgatcataagatcggtcatacaggtatctggtcacccattggtgacacactatcagcggctcagattgataagccaatatcaggacgtcatctgttagtcaggatgtagactttgcgcgtgagtcgcgacagctcagtgcgcagttcgcgcaggtggtagtgcaactgctgttacaggtcatattcgtcggcgttcgcatcctacctgagatacaggtactgcagcacgtcctttgactcacaggcactcactgtcacactctc

SEQ ID NO: 484830 - DNA, 211 bp, Homo sapiens
ccaccggatgccgaagcgcccaagcagcagccgccggagcccgagttggatcggggacggagagagcacgaccccatcagacaaagtggtgaagaaggggaagaaggacaagaagatcaaaaaaacgttcttggaagagctggcagtaaaagataaccgggctgggaaagaagagaaagtgctcaaggagaaggagcagcagcagcagcaa

SEQ ID NO: 484831 - DNA, 197 bp, Homo sapiens
gcatatgggctgtagctaaatgtatccagtactctcttttttcctttttttttttaattttatggagacggaatcttgctctgtagcccaggctgaagtgcagtgatagtagtctcagctcactgcaacgtccacttcccgggttcaagcaattgtcctgcctcagcttcccaagtaactggaactacaggtgtgca

SEQ ID NO: 484832 - DNA, 315 bp, Homo sapiens
atattgatcgaactggcgttgcgcgagtgcgtgctgtcgtagtacacgcccaggcaccgccgacgtcgatgtggtacaccggcaggccgaggttgcgcagttcgccgtagtaacgaatggcttccttgaacccgtgctggtagtcggccaggttggcaatcggcgagcccatatggaagtgcagcaggcggatgccctggtccaggccggatgcgcggaagcgctcgaccactgacagcaactgggctgacgacagcccagaatttggatttctcgcctacggtgtccgaccacttgctcgatgcctgggacgac

SEQ ID NO: 484833 - DNA, 383 bp, Homo sapiens
gctgctagctaacaagaatgatgtaactgaggaagacagaagaggaatgctcctcaccaggcctggtgttttcgccagtgagagtccatgggtgactgatgactaagtgtgtaacttcctcagacacagacaagccattaccccagcaagaaggaagctcttacatccagaacctcagaacacaggatttgaggggaaaatgaagtcttaaactgaaatttgaatggatattggggaaaatgtaattacctttattctttttgattggttaccaccaacacaaccaaaacttaagaaaatggtaattgtggcctattgtaaactctgtcatacaaataacagcaaagttaggtcaataaatgtgatcgtcagtgaaaaaaaaa

SEQ ID NO: 484834 - DNA, 324 bp, Homo sapiens
tctttacttttctctctcataccctacagaaaaccctattgggtctcccttcaaaatatacccagaatgtaaccatttctcaccatgttccttgcttctacactgtccaagcctctgttattgccatctagattatagcagtagactcctaatgggtattctcacgtccaaccttgtcattatctagtctattctcaacacagcggcagagagatcagtgacaactttggatcatgtcacatctctcttaaaaattgccatgttggcgaatgagccaaagtacttttgaagctctactgggttccagttacctgggcctctgat

SEQ ID NO: 484835 - DNA, 340 bp, Homo sapiens
tccctcccccttccggggaaaaagcccccttactccccctccccgccaggttggggcccccccccctcattgaattttggggcccccccccctcattgcattttgggaaccttccccctgcaaggggttttctattttcaacccctgggcgaaacttcacccctgaaaaagggggcgggtcaaggttgcgtggtaatggggtttcccccccccccccctcccgggcaaggctggaactggacaaaaaccagtccctttaattcatttttttcaaaaccctttggggtccgaaggctgtgcgggtttcctcctgccaataaaccctacccggttttcccca

SEQ ID NO: 484836 - DNA, 968 bp, Homo sapiens
tcttctttcgcgtctgccagtcgagtcacatcgctgagacaccatgtggaaggtgataggtcggagtcaacgtctttggtcgtgataggggcgcctggtcgccaggtgtgttatcaagtctggtaaagatgtgcatgaattgtagcgatcattgaccccttcattgacctcaactacgaatggtctatacatagttgccaatactgtagttcccaacccatgggtaccaattccattggcaccgttccaatggctgcacgaacggggacaggcattgatcgttcaagtggttgaatcccaatcgagcaatcttctccaatggacgctatactcccgtccagaaactaactcgggcgactgcgtgggcgctgagtgtacggtcgctggagtccaacttgggcgtcttcaccgcgccagtcgtgacgaacgagcctaggggctcaattgctgcgaagggtgggagatgccgaaagaggggtcagtcatctcggggtccccatctttgcttgaccccccctagttgtacgtccactcgagtggtgtcgaaccatggagttagtaggtatcgataggacgaagcctttaagagaatcatcatcaaaattagtctcctctgcaacctagccaacctgcattaaaccacacccttggggggtcaaaaggctcattgcgatagaacagacattctggagtatccagatggaaagggtactcgatggaccgagagtcccatgaccaatagaattgactgaccccagaaatgacctgttccatgaagcacctgcgcgtgatgagaactgttgcgcgttgatgggcggcgggggctctccgaaagagaggatcatcccctgaacttttatctggtggctgccaaatgtggtctgggcaagggctcgttcgcctgaggttgaacggggaagctcgcatggggatggcctttggggtccccaacggcgaacggacagcga

SEQ ID NO: 484837 - DNA, 309 bp, Homo sapiens
cccatgcacttgtcaacagctgttgcatttcaatagagacctggaagcctctgtggaaacgtcataacagaactcgcccaggcccctgcgcacaacttagtgccaggaacttggagcttaaaggcagcctgctcctgtctggattcctgcagtttcaccaacagcgggagtaaggctgacagaatgccggattccagcatgtgcttagtcctgaagctgcatatgctcttggcattttgtttttggtcaaagatgtcaagatgcataattaagtgtctgtgccaattaaattcaagtctgcattttgat

SEQ ID NO: 484838 - DNA, 352 bp, Homo sapiens
gcaacttacaagtgttttctcccactgacgagcaagctggactcaatacgttctgcagctaaaatcaaacaagcgctctctccccagaccctcgtaacataaccaccgcaatactaattaatgtacagacgtccacaactgtaagttctccccccataaatatctccaaatcagtgctacctgctaccccgtatattagactataactcccaatggagtctgactctgaaaacaactcatatctaataaatttaagcttaagcgacatatatgctattccgcactcaggaacgtggcttccagatgtttcttccaccccaagcatcctcgcagagaccatggggccaggtgg

SEQ ID NO: 484839 - DNA, 332 bp, Homo sapiens
atcagctcggtccgtgcttacccaggtcttggtgagtgaagcagaaaccaacaaacacagtgaaggtccagagagctgagaagagcaggtcaccaatgaccagtgtacttgctggtcagtgtgctgttgctgatctgggtgtgaaatacgctgtcgaccaccaatgaagaaagcctgaggccagtgaatgtgccatgcacaaccctgtggaccacgcacaacgtgacatgcacaacactggtgaccatgcacagacctgtggggtgatccatctacgagtctgaccttgcagtgcattgcaatgcttgtgcacttggcctgtctgttttaca

SEQ ID NO: 484840 - DNA, 106 bp, Homo sapiens
tcaatttctacactgccagtgtcatccagttatgtgaacttgggaaaagttcggtttttcttcaaaaggtccctcatacatatgttagtgtgtagaacattgaact

SEQ ID NO: 484841 - DNA, 1721 bp, Homo sapiens
  misc_feature (860)..(860): n is a, c, g, or t
ggcggctcgggatctgcggtacctgttgtagtcacgagggacgggcggcggcctggtcggcagtagagtagccgtgcaacatacgggcgggggttacgagtgacgatttactcccatcaatcgccagagaccatttccgtcagatggagctatgcaggcaaagcccagtgcatggtgaacacttaagctggggcacagtggtagtacgaagggcctcatactgagttagtccgtgggtagaatggagctaagcactggaaatcactaggcagcttgtgtcgacaaagtaactacgtagagggagagtatcactaagaataggaaaggcattccgttcgtgggaaacaatcatgtgtgttgaaggttttatcataatagatggttagttaatcacattcgctccgttattaatattcatgaggagctggtggtagagggaacggacgggaggggacatgactgggggggtaaacattggaggcagtagattaggggagtgcttggtgtcgctagggagcggcattggttgttggggagtaactaggtaatctatacgtgaaggatgaactcattatcgtactttgggctttgtagtttattgctacgaaagcgtgtggacaaacaccacccatgatgagagaaggggaggacctggacatagatagagagacccccctgagaacgcgtttcccaaagtagcgttcgcgtgaggagcgtgcagagccacgaaaaacgtgggacgcgtttgcacatgacacatgccgttgcttataccccagaaggatcaaatttccagaggcgacggtacacaacatctggtggcgagccaccccaaggaacactctcaaaggatggggtcngcccaacgcttggacagatgtttgggaggcacactttttccttgcagtgggagaagactccccccttgatctgatttcgagaaaggcaaacggtaggagtcgaaaggaaatgtgcggccaaggatagcaccccccgcggtggcgcccccatggggttggctatctctccaggcattggggtcagcacttacacacattggtattccgggggggcccattgaggggaccccagggaaaggcgggcgctgtaatggttcgataatggggccccaattggttcaacaccctaccgtagggaaccaacgcgcgtggaggacccccacgagaggaggccacatgggaacgactctaggggagaccaaccatcacccaagtgacgggggcgccccttggagtcagccaggttgagtgctctccccttgggctaattttaatggcttaaaggcgcacaaacgggcccaatattaacgaaggggggcttagtagaattgaagttggaaaccacacaacgcaagcaccgccacatcacaataagcatcacacaacaaaacgctcacaggcggcgacacaaagtaagcaggggagcgaggcagacaacaggaaagcagacaagacaaacacgggaaaacaacagcgacaacagcacaagcaaagtcaaacagaacaaacacaaagcaatcggacgctgccacacaagggaggcgtacaaccccgagcgagtgcacccaaaaagcaagacagaagaaacaaacgatagaagacaccagcggatacgcgtaacgcacacaacggcaacgacaagcaaggcactcaacacaaaacgacagcaacaagaagaaaaaaaactaacccaaagactga

SEQ ID NO: 484842 - DNA, 143 bp, Homo sapiens
gtttgtattggctccacgtggggttcagctgtctcttacttttaaccagtgaaatttgaccttcccgtgaagaggcgggcatgacacagcaagtacgagtaaggccctatggagactttaatttatttaatggcaaacagtta

SEQ ID NO: 484843 - DNA, 563 bp, Homo sapiens
gcaagacccttcatcccattctcagtcagataataattcttgactcatgatcgtccacattgaaaacatgcatgctcagaaatgggggtcttctcggtgtactcctttcccagtgacaggaactcgtcgtgactcgaacagacgcttgactgcaaatctcatcagtttcactttgggaaggtctttaattcctcgattcattttcattaaacgcctgattatggaatcacagttatctccttgcctgatttcaattttggttgagaagtggccattggatggctggggattcaccagagaaacggacacaccaggttctattctaaaaacattaagtggtttcccaggacagcagtcttccctgattttatcttctgcttcggaggcaaacttgacttctatgtgttctagctcaagcgaattagtcagatagactatattctccataagcacagccttttcatcaaattctaattgcaaatccagaatacgaggccccatcttctccagattttccttaatcatggcaacaaatggcatgactttcttcatgtatttcttca

SEQ ID NO: 484844 - DNA, 769 bp, Homo sapiens
gattctaggtggacattacagagttgaattcctcactaccccctcccgctgtcatttgttttattggaaaacttcatgttaactagagtgtacaaaaagtctgtttcctgctgagccaatagtgattgtttgcatatcacctaatgtgaaaagtgctcatctgtgaactctatagcaaattatattttagaaaatacttgtgaggccgggcatggtggcagagcgagactccgtctcaaaaaaaaaggaaaagaaaagaaaatataaggatgtaaaagaagcaattgctggcacatctgaatatccttctttgtgtctccattttcactctgtgaaaactgaaagcaattgtgacttttatttcgtttttctaaagaacagctaggtgaaaaggaggttaagctgatggtcactctgcctgccattacctatccccaccatggtgtttcatgaaaatccccaccatctgaaggtgatctttgtaatcctgtgttgatagtaaatgcatgtgataattaacaggaaaaaccatgtcttttaaataatctacaaatgagaacccaaatggtagtgtttctgtttgacagaagtcaatcaaatattatggtttaacttctacttgcaaaaatttcaggaccagttaattgttggggttccttaacctaaagagggtttttcttataataacgggaacgaagggtgtgggttccaacgaacatttagagacaaaactttcgggtacattattgctgaaaatttttaaattggg

SEQ ID NO: 484845 - DNA, 95 bp, Homo sapiens
catgaggagcaggagcaggaagaagaagatgaagatgaggaggaagaggatgaagatgaagacatcacaatggctatcctatcactgatgcgtgt

SEQ ID NO: 484846 - DNA, 1469 bp, Homo sapiens
gacagggtctgctgcaggagcagcggcccgaacccgctccagcggcccgccgccgccagcggctcccgcgtcgcgtgtgtacccccgcgcacttgaaggaggtccaccagccctcaccagcccccgcggaccggtgcaatggcccagcgtaagattgccaaagagcagcggaacagcagcagcaggggcttccggcaaggcggtagcacgagtgcggcagcaagcaagccccggggccccgaagaagagacaaagcattgggaggacacaagattgggaggaaaggcgagactctcaggacacttcattccttccacggtgggtaatggcgggatgggcagtggcttggccgtctggacatctgtagctgtcgtggataagatctggtggacctatgaggaagttctaggaaaacctaggaatctatgatgctgatggtgatgagaattggatgtggatgatgccaaagttttataggacttacagagagatctacttcagagccaggagtcccgccagaaagaggttgagcacacatggagcccgagagcaggtccctgtgggaggcagatcccaaatatcgaagatgaagcaagaaccatcaggccctctccaggaagggtacgccacatgtggcggaaactggccagaatggcccgggaccccagaggttgcgtctcgccagggaaaacatagaccgaacggttttaaacgagtcacggaagaccagacgaaaattgcgacatatggtctctctgtgccgttgtagtacaaccaagtatttctgggcggatcgctgaacgatcaaggacacgtcaatacagtcacacgcggcgcaatgagacacgcgccacgaggacgcgaccagtagcgattacctgtcaacacgcagcctgagcgcacgagtcacgagacgaagcaagcaccatcggcacagctatacactaacgacacatgccagacgacagagaagaaggaccgagggagaccaacgggacgaccaaaggaggcgaagaccacaaggagaccagaaccaggagaaaaggaaacacaacgcggcagacgaccaacgagccgaccagggaagagcgagccgggcggcaagagagggcagacgggagagagggagacgagaaaggcacgacagcacgcggggcaccaacaaacacacaaggcgagcgcagacaaacgggcagaagcaaaaaccagaaaagaagagacaaagggaaaaagaaaaaacgaaagaaaagcacccagaagaacacaacagaacccaaagaaaaaccgacacgaaaggccagccagcaccgacacccagagaagcagaagcacaaacgcacagacagaagaagaacaacacaagaggaggagaagaaaaggaacgagagaagaagaacacaaaaaagagaggcgggagacgaaggacacaacgaacagaaccgcaagaacacagaaaaaaacaagcaaaa

SEQ ID NO: 484847 - DNA, 121 bp, Homo sapiens
agaccagacttcgctcgtactcgtgcgcctcgcttcgctttttcctccgcaaccatgttcttacaaaacccgatatggctgagatcgagaattcgatatgtcgactcaggagacagacgcg

SEQ ID NO: 484848 - DNA, 239 bp, Homo sapiens
  misc_feature (144)..(144): n is a, c, g, or t
  misc_feature (198)..(198): n is a, c, g, or t
ggacgaagggtaacgggatgaaggcccgagctcccgagagcagcgtcaggcacgatgcagtgcattcgcagcccgggtagaagcgggcagtggggatgagcttgatacagccaatgatgacttgggcaagggggtagaccaagnggcgtggagggcttccgctggggcccgcatgtgctcatggacccggcaccatanggaagaggcagtgcacatactgccagttgtacacagactgg

SEQ ID NO: 484849 - DNA, 234 bp, Homo sapiens
cgctggcgctgtgacgtgagatcgccacctaccgcaagctgctggagggctgaggagtgcaggctgaatggctgaagggcgttggacaagccaccatctctgtggtgcagtacaccgtatccagtggctatatgtggtgcagctggtgtcggcagcaggctataggcctgaggtggaggacagcagctacatcctactggcaagatggtctttgtgcgtatggcaggatggctt

SEQ ID NO: 484850 - DNA, 420 bp, Homo sapiens
ccaggaggcccacactgacctggaaagggtccgcgccatctggatctggatctgccatcacatagagtatgacattgcagctgctcaggagaaggaccgccaagccttcaaacccactgacatcctgcggacccagaagaccaactgtgatggctatgctggcctcttcgagagaatgtgcaggtggctctgagcagaggacaagcatcagtgggcagcatgtccagaggtccacagcgccgctaaatcagttcaccttaatgcaaaacgagccattctccaagccccattgttcccaggactccccttatccctccacatcatcctagaaagtgatatgcacagacgttctaggcagcaatggaaagtaatttcctgaagaatataattttaagtagtatttatggctttttttccaat

SEQ ID NO: 484851 - DNA, 519 bp, Homo sapiens
gcaacattctttctactgcattaaaaaccctccaaaaatgaatacaaacatgaggatttattattacaaattctaaatttggtattcattgcatctcagtcattaggagaagttttagtttgtatgatgtgattttcagggagttgcatcttcttttttagtaaattcagagttaatgttatgcatctgtcatttaaaggttttgaataacagatgcatttgtcatttaaaggttttattttttcatgcatgacagtaatttttaattttatatttttaaagtccaagcagctttccctcaaattgatgaggaaattttaagtttaaattttattgcaggcatttttttagttacatgcagcatgcatgtttacgcagagagtatgtgtgtatgtgtgtgtacacatttgtggttgaaattctattaataatttaaatttgctcctaagcaatatccctcaagtacaatttcaactgataattggcattttgttgaggaagacattttcttctcttttt

SEQ ID NO: 484852 - DNA, 247 bp, Homo sapiens
  misc_feature (107)..(107): n is a, c, g, or t
  misc_feature (216)..(216): n is a, c, g, or t
tttgttgtgtccttgttaggttttggtatcagggtaatgctgattttgtagaatgagtttagaagaattctttcctctttattttttaaaaataatttgagaagaantcgtattagtttcgctttgaatatttggtagggtgttgttgttacgccagtaccccagcactttgggaggctgaggcagaacttcaagaggccaggagtttgaggtcancctggacaacatggtgagaccttgtttctac

SEQ ID NO: 484853 - DNA, 1021 bp, Homo sapiens
accaaaaaaaaaaaaaaaaaaaatctgtcgagcacttaccatatgaccagggaactgtgactgggcttgggaatagaatcaggagcccagagccacggagtggaggatgcacaaataatagcatcaattaaacgtgttattgcaagagaaggtaagtgctctgaaggaaagggtcaaggttctgtgagagtatgtaacaaaggaatgctaagagtttcttgcaataactcttagttacaataatttgtggcgcattcttgtaaaattacagcttatacttctgtagcacttgcactttataaagcactttcatccgtattatttcacttgctttggctgcgcaatagatatttattatgatgatgtcctcttacagacacagaggcttggagaaattaagaaactgggtaagttctttacagtagcggcagacagatttaaacctaaggtctgtcaattccctacccctaactcccattttgggcaagattttaaaacaaatattcattcacacggaaagtagaggataatataactctccaggttaagaacaactcacctatacatttgaaagccggtatatcccttcctgagggcatttccctccttcctttctcagaggtcaccactttgctgactttggtatttatcaatcccatgcctattttaatactttacatacagcatatatccagaaaggaaattagtatagttttgcatgccttatattggccgggcacagtggttcagcctcttgagtaactgggactatagatatacactaccatgcaccaccacacctggctaatttttatttttgtagagatggggtctcattatattgcccaggatttggagaccagcctgggcaacatagaccctgtctctacaaaaaaataaaataaaatttagatgagcatggtggaacatgcctgagtcccagctactcaggatcctcctggctcagactcccaaagtgctaggagtataggcataagccaccatgcctgtccaactcccc

SEQ ID NO: 484854 - DNA, 127 bp, Homo sapiens
tagacatcaggccatccacagcatcgggagccagcagaaagggctgggtcaggccatgtggacagggacaacggacagtacagggccagaggtccctatatcagggacctagacatgctgccgtact

SEQ ID NO: 484855 - DNA, 402 bp, Homo sapiens
cgacgagctcctgacctctatatcggccttattctgtaataccagagcgctgcgagtatagtcgtgagtttataagcgcaggcatagttcattattttaagctgtacaattgagtgatttttattacgttcacaaagttacgttaccattaccacttttgaattgcagaacaatttcatcactccaaaaagaaatctcataacaattagcagttattttccatcgctacttccttgattccaaggcaatcagcagtctgctttctatctctacctgtttgcctattctggacatttcatatgcagtggagtagataatacatggccttttgtgactggctttcacttagcataatgttctagaggttcatttatgttattgcaaaaatcagtacttcatttc

SEQ ID NO: 484856 - DNA, 1552 bp, Homo sapiens
  misc_feature (942)..(942): n is a, c, g, or t
  misc_feature (1281)..(1281): n is a, c, g, or t
gcccccccgcccacggctgcggttgtggctgatgtaatttatcaacaaaggacttctgtttttgatgggcaccccgctcctcagagtattctcccgctcttggtgtaggaaactcgcgctctaccatccccgcacccgtgtgttgtttgtggaccccgcccccgccgatgatggggagaagagacaccccccgggggggctccctgtgaatagcctccagagctcctttctccggtgaatacttttttatacggctctttttagtagccgcgctcccgcggcgggtcgcccgtgggtgatagcacccacaaaagtgttgccggaaccacaccacggggataaccctacgcttttattgtcacaccaccttttagcggtcccatcatatttttataagggcgtggaccacacagcattaatgttatgggaaccacaaagaggtgtttgggtcaaccgccagagaaaaagagcgccaacggggcccgtgtgtgggtacaccccgggggttctcccggggagagttctcctcccccgggagggattaattatcgcgtggtcggagacccccacaacgtccgtttttcccgcggtggccacaacatgttgcccctcttcgcggttgctgtttcccccggcaaatattcccgccggggtttttcctacttcccgggaagacacatcccacggccccgcgctgctgtgcttcaacacacaactaggtgcgccgcgccggccagtaagagtgtttcggagccccctcccctcactccggcacgggattgtctccaaaacaggtctcgggatatactcccctgaagagggtgggccaccccccgggagagggggtgaaaaaatttctcgggtgggcaccacacctttcttggcgccccactgggccgcccccacaaagagatcctcgcccgcccccctgggggtgctctngtgtctttcccccacaaaaaaaaaaggtttgggggtgagaatgaaacacatttggcccacaaggggcacaacgcgggggtgatcactgtgagaagggggcccttgaaaggagattacacacgggtgagagaacgtgagacccacattctacgagacaacagacacacgggccccacgagatttgagagcgtgtgtcgcctctttgtggcctcctgggccctggagatcactccaaggcccctccaaaggggatccacccccaagaggagccacgagaagagataccacgagaaaacacactttgaagacaccacgcgtgggagaataatcacctctttngagatgaggagattgttcaaacacattggctcgaacaagaatgcggcacccgagtccttatgccacgagaaacttctctggagaccacttaaagaggagtcctggggagctgcccacgtcacgtggggctgttataatgttgaatggcccccacatcctcactgaacactcactcgagtgacaatcaacacgtggtgctgtggaaagccccagacccagttaagccaccaagggaaaccatttccaataaaggatcatttgacaactggga

SEQ ID NO: 484857 - DNA, 393 bp, Homo sapiens
  misc_feature (9)..(9): n is a, c, g, or t
  misc_feature (35)..(35): n is a, c, g, or t
  misc_feature (38)..(38): n is a, c, g, or t
caccaccanggggcatggccacagactgacaatgnctncggcacttttaagggagggatgagctgcaacatggcctcggggctgtttatgataaataggtcaggcatcctatgcatcttactccccacaacaggttctgggtgaagaaaggagcacttgtttaaagaggcatcttttggaaatggcaggtgagtgaaaacaggaaaaagctcacgtaacatttgtgatctgttcagaggtctcctccatggataaggaaatgggaaccaccgctcaggaaagcagcgccaccacttggcgaaaaacccttcagagaagccttctgtcgcctcagggtactggcacaaaaaatgctgaatctcctcctccaacaggggctatcccgtcttgatc

SEQ ID NO: 484858 - DNA, 690 bp, Homo sapiens
gaatccattcaggtatatacacatggaggtagtcacactctgggacagatctccagaagtatgctggggtcagctcgttactcaactccagttgacatttggagtataggcaccatatttgctgaactagccacttgaggaaccccttttccctggggattcagagaagtgatcaactcttcaggattttcagagctttgggcactccccataatgaagtgtggcccgaagtgggatctttacaggactataaggatacctttccccaatgggaacccggaagcctagcatcccctgtccaaaacttggatgaaaatggcttggatttgctctcgaaaatgttaatctatgatcccgcccacggatttctggccaaatggcacctgagatcactccactattttaatgatttggaccatcacgatttagaagatgtagctttctgaccaaaagtttccacctatgttatgtccacagatagttgtgtttttattgttaactcttgtctatttttgtcttatatatatttctttgttatccaacttcagctgtacttcgtcttctaatttccaaaatataacttaaaatgtaatattctatatggattttaatataattctgtaaaagtgtgtaggtctccctgtaaccactatttgttactataattaaactattatattgatgtcagga

SEQ ID NO: 484859 - DNA, 181 bp, Homo sapiens
gcacagcatacataccccaggcagagcaagaaccccttacttcagacgtgtgggcacctcgacggtagggaacattgcgctcctatgcaccttcctgttggtgagacccaaacactgccattgtcctgtgtaactggcctgcttccaacaagctaccacagacctaaggaaattcatccca

SEQ ID NO: 484860 - DNA, 1147 bp, Homo sapiens
gacagagccgactgtccggccgcctggacagctgcgcgcggtggggcagctgctcgtccccccggtgcccccgtgccggacacttggtgggtgccacgaggacccgcagcagcacgtgcggtcccccggctgtcctgggcgtgtacggccgcctgtgcgcgaaccctcggggggagttggggcgtggggtggcgccggagggttgggggcaggacagcccggggttgctgcacttggtgcccaccactttggccaatggcgggctcgaaaggttggaccttgagcaccttccaccggatgtggaagggagggcgaaaatcattttctggagggggcctgacttgacaaagcaatgcgggagcgcaccattaccttttcttgccaagggactttggaccagggctggacagaaagactccccgacattggaaagcgacgatggccgaacaagggggtggccttgctgacagcgtgcggaggaaccccatgtgtactacacacaggggcacaagccagtgtcaatggagggaaaatcttccttgtgttccggaagggacaattcaccaaggctggatggtgggacggccatctggtacaaacggctggccaacaaaggttcacttggatccggcagagggaggctaggccttgagaacgggttggaattccatccggggccgggcggcccccctggattaaccgacgaatgtgcttggaacctggagaacctttgaaaaactgggcaatgcgccaagaacacggggggagcaatcgcgtccgggccaagtgtctgcttccaccacgggtggccatctgcttatggggccacgcgcacaagtgtgagagcagcgaagaattacagtgatctgtcgcagagagatgcacatccggggtccgcatcaacggtgagacacgagggccaacggatgtttctgtgttgtatatccttttttttgctactactgtgcctctgcatttcgcagccccgccacaataatagagtcgaacgagacctcatcacagactcgcagaaagatacgacgacgagcgaacatgaagaacacaagtgacagtcacgagaagtcagaagcaaaacgacacacgaacaacagacagacgagaacgacaagaacgacacaaaacagca

SEQ ID NO: 484861 - DNA, 457 bp, Homo sapiens
ttgaggaaatatctcaagcagacatgtagaggtatgaagaacggcagaggtgcgggcatggtctgtgagggcacgggtattaagcgatgagagagagccgtgggtctgcctttacttacccgggtctgctctagccctagccctcgggagtcagggaaggggaattgcctaagtaacaaagggggcttttgggtggggttcccacccaagttcgagaggaggagcagacatctgtgctactggagagcagtgtggccaggccagtcgggggctggcttaagccgtcgctgggcaggaaacccgtgcatgcctgcgtgtacccttggttgtgttttgtcctggttatcagcggtttcttaggaaagttccttgtcaaagctccaagtttcgcttggctgatccaagggaaaaagagacttagccgcagttgggtggggaaaccagagtgttcagaggc

SEQ ID NO: 484862 - DNA, 289 bp, Homo sapiens
cggggggccttaaattgggggggggcccccccccttgttttttggccccccagggggggggggcccgccgtttcccttcgggagagggggggggggggtggcccccggggcaagcccctttgtttttggggccccccgttctggttttttccctaggggggggcccccgggggttttttttcccgggggggttttttccccttttgccggggggggggttgggtttttcccttttttccccccccgggaagggtttttctttaaggtttccccccctttggccccccta

SEQ ID NO: 484863 - DNA, 389 bp, Homo sapiens
aaagcaagtgtatctggaaaaaaagccggagggaaaatcctttttttaaatccccgttttgtcactttttcggataaaagagggccatattcccccttttcggccccatgtatctcagtcccccatggggcggggctaagtaaataggatttggtttcaccctgaggcaattagacactttggaagagggcataacctgtctccccgggacttaagcatctggctctaattcacagtgctcttttcccctcactgtatccaggttccctcccgggggggcccccagttcccagggggggcacccagtccctcttctccccagctgactaaactttttttctgtcccagttaatttttccaactactaatagaataaaggcggttttcta

SEQ ID NO: 484864 - DNA, 582 bp, Homo sapiens
tagtagctggggggcaagagcaaataaagagctcgagcttctgtggtctctggggagatgttcccgggaagcctgtctagagggcggagggcagctgttgagatggcgtggctccccgtgctcctgcgccctgcgtggctttctgcggcgggctgctgctgtgccctggtatttggacatgcctgtgcagggcagctgctgtgtggcctgaatcctggctgcctgtggcttgagtgctcatgtgatcactactttttgtgtgtagtggccacatcttgccagatgcctaggatgtcttgcgaatggcctggtgacccgtgttccccggcccacagtgtgggtgtgtgcaaaccctgagagaacttgggtaagtttggggtctggcttgcaggttttggggtaccccgagggcggtgtacgtcggtaagattgtaacagtattacttgtgaggacttattccgacttgtcctgatgatacttgtaataggaagtgccgtcagaagcgataactgacgacgtctaatgtctatctgaccgcagtcgctgaaacctctacaacttagttgaccgtaactgccaga

SEQ ID NO: 484865 - DNA, 265 bp, Homo sapiens
catggtccccagcttctcctaggatcccagtggcatttatcagtggccagctacctgccaggcccgggctggggcacggtcctgcgccatgaggccaggccgcctcccgcacccctaccccgtggcagcagcatacctctgcatttctggaatgtgtgtccaccactgatctttgtatactcgacgcatttacaaatctatctccgctacgaggccaaatgaacactgcatcttgatcttaaaacacgacaagcaagacaaaaaa

SEQ ID NO: 484866 - DNA, 131 bp, Homo sapiens
actctcgactaccgtaaaagaaaaaagataaattaaaccttaaaagtatgtttttatctttctaatttccctatcttctctattcttatcttcgccttcccgtacttcacggaagtcgatagtgggtaccg

SEQ ID NO: 484867 - DNA, 686 bp, Homo sapiens
gatcccccgggctgcaggattcggcacgagcttttacccattggcgtgagtatttttcctcagcttccctctttctccgtattctgctcctcctcagtcccatcctccacgctttggaagctactgccttactgcccggagcgccgccgtccccgaacctcccctgcttctccctttccttctgttccggtttctggtcgtaactcaagagcaaaccaccgtactgcaaaggaaccagatattgtgctcgcggttccaaaccgggcatgggcaccgaatgcttctcgataaatccccttatggcctctgagccttaaagaaagcatgggaggaaaacatgcgcccaagctcgttcgcaggaacatgttcgcgtgtctgcgcctgtgtgcgcagccagttatctggctgaggatcgctcgccaacttcagacatgacccgcccaggacccggtgccacactcacccaaaatacgaaacttcacaggagccagaagaaggagtccttttctccgtcggctcggcaccgaaacgggatgcaagtcccctgatttagtaccttctgagaaaagtggacaagaaaccctagacctggattcaaaagcccctttggtcgggtcttaaggtaggccctaagaaaccctgtttacgccactgccaccctaatttttggaaccgtctactccccg

SEQ ID NO: 484868 - DNA, 484 bp, Homo sapiens
gacttatccgtagcccttttgtggaaaatacttggaaaatcaaatttatcaacctgagaatcattggaggaagttcccttgctcctgaatcagtactgaagccatctgtaacatttgaaccaagtgatctggaggccttttataacgtaatcaccttgtgtaatagccctgaagtaagacctaacgtaaggcagataatagatagtggcactggagaccaggttttacatagtggagatgaggcattgttgaacaaaagggaaatgaatttgctaacccctctaaagcattgagcactgtacctctgcttgaagaagctgcagaaacaacactgaccatctatctctaagccactgccgatgtgagaattgacatattttagttgaaatacctttttggactacagactaatgtgaatacttgcctatttctacctgagttacagcaaatgttctgagaacttattgcggtccaccaaataaat

SEQ ID NO: 484869 - DNA, 1898 bp, Homo sapiens
gcctcgcggaggcgggactctggccgcctgttttttttgcatgccgcgctgcgcgcaccgcgggctccgggctcagaagtgcggacgcccggctcccggcgtggacgccatggtgctgtgcccggtgattgggaagctgctgcacaagcgcgtggtgctggccagcgcctccccacgccgtcaggagatcctcagcaacgcgggtctcaggtttgaggtggtcccctccaagtttaaagagaagctggacaaagcctccttcgctactccgtatgggtacgccatggagaccgccaagcagaaggccctggaggtggccaaccggctgtaccagaaagacctgcgggcccccgacgtggtcattggagcggacacgatcgtgacagtcggggggctgattctggagaagccggtggacaagcaggacgcctacaggatgctgtcccggttgagtgggagagaacacagcgtgttcacaggtgtcgcgatcgtccactgctccagcaaagaccatcagctggacaccagggtctcggaattctacgaggaaacgaaggtgaagttctcggagctgtccgaggagctgctctgggaatacgtccacagcggggagcccatggacaaagctggcggctacgggatccaggccctgggcggcatgctggtggagtccgtacacggggactttctgaacgtggtgggattcccgctgaaccacttctgcaagcagctggtgaagctctactacccgccccgcccggaggacctgcggcggagtgtcaagcacgactccatcccggccgcggacaccttcgaagacctcagtgacgtggaggggggtggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggctgcaccggtgcactggcccgagagctggcccgtgagtaccctcgtatgcaggtgactgtgtttgacctcccagacattatcgagctggccgcccacttccaaccccccggaccgcaggcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatagggatgtcctcccccaggctgcaggtggaccgcccggtccccaagtaccataggacagtcacataggagcgtgtagtcgtgactgaataaagaaagcaaaagcctgaaaaaaaa

SEQ ID NO: 484870 - DNA, 1470 bp, Homo sapiens
gcctcgcggaggcgggactctggccgcctgttttttttgcatgccgcgctgcgcgcaccgcgggctccgggctcagaagtgcggacgcccggctcccggcgtggacgccatggtgctgtgcccggtgattgggaagctgctgcacaagcgcgtggtgctggccagcgcctccccacgccgtcaggagatcctcagcaacgcgggtctcaggtttgaggtggtcccctccaagtttaaagagaagctggacaaagcctccttcgctactccgtatgggtacgccatggagaccgccaagcagaaggccctggaggtggccaaccggctgtaccagaaagacctgcgggcccccgacgtggtcattggagcggacacgatcgtgacagtcggggggctgattctggagaagccggtggacaagcaggacgcctacaggatgctgtcccggttgagtgggagagaacacagcgtgttcacaggtgtcgcgatcgtccactgctccagcaaagaccatcagctggacaccagggtctcggaattctacgaggaaacgaaggtgaagttctcggagctgtccgaggagctgctctgggaatacgtccacagcggggagcccatggacaaagctggcggctacgggatccaggccctgggcggcatgctggtggagtccgtacacggggactttctgaacgtggtgggattcccgctgaaccacttctgcaagcagctggtgaagctctactacccgccccgcccggaggacctgcggcggagtgtcaagcacgactccatcccggccgcggacaccttcgaagacctcagtgacgtggaggggggtggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggttacaggacccagcgggttttgctctgaggatctttgcaggtggaagtcactgagggaaggtgacctggagcctgggcagagcaaggaaggagggccacaccttctgtccctctgccctcaggaatgctgcttttcccgaaagggtgagaagcagagggtgaatgacagagagggaacagtggcagccgcgagcacataggagaagcgtgacctccttatgggctctagtctcaaaggggctgtatcagtccatgttctcctgagaaacagaacccaatacggtgtacacagacaaaaaa

SEQ ID NO: 484871 - DNA, 427 bp, Homo sapiens
cgatacctgagatcaatgatttgagcgtaaaaggtagtgaaatggacagcgagagacttcagtatgaaagaaagcggagatcaaccaaagtaggtttttctcacaggttaacatcttcaaacaaatggcatcactattcatctatgcccaataatataaataagatgttttctacttaatgtatgataaagaaggtattttaaaagtaaatgaagatttccccccaagctggaaaccttgaatttaaacaccactgatctgaatttaaaaacaaggcttaactcatccgacagaacataacctgccctttctctgagttgtatctaacctcctttataaactgatactgttttctcggttatttagcttggctttttctatctggaggtttctttcactcctctgtctctctaccagtctttaatgg

SEQ ID NO: 484872 - DNA, 151 bp, Homo sapiens
catctcaccactacaatcttcctgggaacaacatattacgcactctcccctgaactctacactacatattttgtcaccgagaccctacttcttacctccctgttcttttgaattcgaacagcatacccccaattctcagacggggtgtcca

SEQ ID NO: 484873 - DNA, 706 bp, Homo sapiens
gcctcgcggaggcgggactctggccgcctgttttttttgcatgccgcgctgcgcgcaccgcgggctccgggctcagaagtgcggacgcccggctcccggcgtggacgccatggtgctgtgcccggtgattgggaagctgctgcacaagcgcgtggtgctggccagcgcctccccacgccgtcaggagatcctcagcaacgcgggtctcaggtttgaggtggtcccctccaagtttaaagagaagctggacaaagcctccttcgctactccgtatgggtacgccatggagaccgccaagcagaaggccctggaggtggccaaccggctgtaccagaaagacctgcgggcccccgacgtggtcattggagcggacacgatcgtgacagtcggggggctgattctggagaagccggtggacaagcaggacgcctacaggatgctgtcccggttgagtgggagagaacacagcgtgttcacaggtgtcgcgatcgtccactgctccagcaaagaccatcagctggacaccagggtctcggaattctacgaggaaacgaaggtgaagttctcggagctgtccgaggagctgctctgggaatacgtccacagcggggagcccatgtgagtctcgggggcggtggggggacgggggacacgtgtggaagctggctccctcacacgtggggtgtccacccagcctttggaaaga

SEQ ID NO: 484874 - DNA, 418 bp, Homo sapiens
taaagatacaaaattggccgggcctgttgggcgtgtatgcctgtagtcccagctactcggggggctgaggcaggagaattgcttgaacctgggaggcggaggttgccgtgagccgggatcgggccgttgcattccagcctgggcaacaagagtgaaactctgactcaaaaaaaagaaaaaaaaaaaaaaaaaaaaacaacaccaaaaggtatatagtataacaggtattaaaatctatttcaaagaaaggaacttgttgattacgacactggtaatttacagaagagcaagcatttgaatccagccctctgattccagtgtaacctacaatgtaagtgctttcctcaagcataccttacagagtctgcacatcagggagagtgttcctgcagaggtgatgtcatctggtattttcacc

SEQ ID NO: 484875 - DNA, 700 bp, Homo sapiens
gcctcgcggaggcgggactctggccgcctgttttttttgcatgccgcgctgcgcgcaccgcgggctccgggctcagaagtgcggacgcccggctcccggcgtggacgccatggtgctgtgcccggtgattgggaagctgctgcacaagcgcgtggtgctggccagcgcctccccacgccgtcaggagatcctcagcaacgcgggtctcaggtttgaggtggtcccctccaagtttaaagagaagctggacaaagcctccttcgctactccgtatgggtacgccatggagaccgccaagcagaaggccctggaggtggccaaccggctgtaccaggcaaggggcccctgcccttcggcccttatgaaaattcctttgctgtgatgaggggatttgcgggtggtaaatatacatgatacaaataaacgtcattcaaaagatgcagttggtggcacagcttagctattgctatgttataatgtaatgcactattgcagtaacctaataataccattaatgatacagaattaatggagcttatctgttactgtgtgttataatattctcttgcaattgatacagtatcattgatgatatacaattaatgtagcttatctgttactatgtgttataataatttctcgcaattgatacagtatcatttatgatatacaattaatgtagcttatctattactatgtg

SEQ ID NO: 484876 - DNA, 1570 bp, Homo sapiens
  misc_feature (581)..(583): n is a, c, g, or t
  misc_feature (600)..(600): n is a, c, g, or t
  misc_feature (684)..(684): n is a, c, g, or t
  misc_feature (702)..(702): n is a, c, g, or t
  misc_feature (1248)..(1248): n is a, c, g, or t
attggacccccagagtttgaatgctctctcggagtatgccgccatctgaatttcttccaaggcccctgttaaagaaggcttgcaaaagtgctgccagaagggacaccgtccttttgcgggttggcacatgtccaccggattgcttcaccatgttcctgctcaagcatctagcacctcggatgaaccgtaccgggtgctcctttctttggaagatctctcgacaagctggtatcttttgcatgtccccatccagagcagatgatgcggtacactaggcatgccccagctgtgcacagtccctgcccgtagccttccggtggctatcttgtccccaacttttgtacactggcagtctgggcatcgcggatgttcacaatgtccacctgaggctgcgtcctcctatggaggggttgccaggatcttctgttttcgctctggatctgcgctgtagatctcctggatgatctgctcagccatagtttttggggaggggcttcccatgcccagactccttgatcattctacccccgtgatccctcggcccttgaaggtcttggcaatgatggctgttggctggtgcnnngcctggccaaaggcctngcacagctcctccacgctgtgtccatccacgatgatggcatgccaaccgaaggcctcgcaccgcttctggtagatgtccatctnggtgctgcagtggggccnccccgcctggctggccaggactccagctctctgctgtctccctcaggggccggcctgctgctggtggagacgctcctcctagcaggcagacggctgctgtgacggtgccgtctaccaggcagggtctcagtccttctccgcactccagcctgcatcttcccatcttctgcacgatttccagtgtgtttcctccatgggacgccatcgctgccgctcacccctggatgcccacaggctatggagtggcagttctctgggcggcttccatctctcctgccttggtgcagagactgtcacgagcgggacctccccagcccctgctgcggggctgaaatgcgtctgtaaacaccccccaccccgagcccaggcaggccagactcacacccaccccgtgaggccctcctgggcacatgctcactgcggttgtagggagctcagcgcatccacgtttcccccgtgctccgctcccagctgctgttcccggcctgtgtcccgaccctcagacctcagttcaccctctggtgcccacacagccccctttcctcnctggcccctccaccagggaatggctgggccaacctggggctgggctggggtgagccctttaactcacagccttgaccttagaggcactgaggttcaggaggcatctgcaaagcgagaaccggagcaggcctaggtgctgttttcacggcgcgtgcacccagcttacctgttcctgggctgggcgtcagtctcctatatttcagctgttttcctttttctgagacagactctggagtttagctcttcttacccagactggagtacaataatgcaatctcggctcactgcaacccagcctgggcgacagagtgagactccgtct

SEQ ID NO: 484877 - DNA, 108 bp, Homo sapiens
taatacaagattcatcttccgcagtatgaatgtgctaaaatattttgatttatggagctgtgaaagattacgtgctcgctgccttttgactcagaaataatacaagag

SEQ ID NO: 484878 - DNA, 952 bp, Homo sapiens
  misc_feature (630)..(630): n is a, c, g, or t
tgccagatctgcaaaaacagaaatgctgaagtttatttatgtttgaacggggtttcgctttgtcacccaggctggaggatccccgcctggctggccaggactccagctctctgctgtctcccttgcaagccaggggccggcctgctgctggtggagaccctcctagcaggcagacggctgctgtgacggtgccgtctaccaggcagggtctcagtccttctccgcactccagcctgcatcttcccatcttctgcacgatttccagtgtgtttcctccatgggacgccatcgctgccgctcacccctggatgcccacaggctatggagtggcagttctctgggcggcttccatctctcctgccttggtgcagagactgtcacgagcgggacctccccagcccctgctgcggggctgaaatgcgtctgtaaacaccccccaccccgagcccaggcaggccagactcacacccaccccgtgaggccctcctgggcacatgctcactgcggttgtagggagctcagcgcatccacgtttcccccgtgctccgctcccagctgctgttcccggcctgtgtcccgaccctcagacctcagttcaccctctggtgcccacacagccccctttcctcnctggcccctccaccagggaatggctgggccaacctggggctgggctggggtgagccctttaactcacagccttgaccttagaggcactgaggttcaggaggcatctgcaaagcgagaaccggagcaggcctaggtgctgttttcacggcgcgtgcacccagcttacctgttcctgggctgggcgtcagtctcctatatttcagctgttttcctttttctgagacagactctggagtttagctcttcttacccagactggagtacaataatgcaatctcggctcactgcaacccagcctgggcgacagagtgagactccgtct

SEQ ID NO: 484879 - DNA, 1097 bp, Homo sapiens
ggtgagcgtgttcactacagtgttgggctggatccccggtgctcgttcaccagcacgttcgcacagatgttaaggagacccttgcactgtactgctactgagggacggacgatgtgctccagtgccttggcacgcacgatacccacttaggtggcaccacgtctgtgaagctttgccagactgcgtacactatatatcaagtcctgattaaaagaaggggaaaacaggtggactcgaggccatcgtaatagttgactacacaatcatccatagcacgagaccgtgagtaccaaaagcgtctccgtgcatgcgacaacgcgtcgatgactcaattgctggcacactcgtaaaacctcctgtatgattgtcctgtgttcaatatccttccatagaaatacatggccagtagaagtgcttgtgtcttgaagaacgtcttgctgacatcatgtgtagtcaatccaatttgctgaccagttgcaaaacctggcagaagctaatcattaaacccagatgccaggaccagcacctttccggggagcccaagtgctttcttgctggatattggagccccacggactggatgcatcgcagctgctgcagcagcgggagggccgaatctgatggtgtgaagcccttaacctttcacattgtggctgtgataatgatcaagaattcttccttctgcgctatgtgggaacattgtgcatcccatgcaaaaaatgaagggcaaattcgctcagtgtgggtttttggatgtggtggggatcgcgggctcggcggaaagtacctggcgcatgcggtggtgccattacccccgtgaacaccccatgcggaagggtctgtgcctgctctcgaactttctacggagggtccttcatcgatgtagtgaaacacaaccatgcgctgcttgcttaataaagacgtgacccggggaatttccctaaatcgggtggtcccctcctgatttccagggtactcccctgttgtgggggaccggtttcgacgttgtcaagtgccccggcctcctcttaagttcctacttgaacattgcggctcgcctgggaatggttgcagccccgccgcctttgcggctggcc

SEQ ID NO: 484880 - DNA, 836 bp, Homo sapiens
  misc_feature (658)..(658): n is a, c, g, or t
  misc_feature (836)..(836): n is a, c, g, or t
gcctcgcggaggcgggactctggccgcctgttttttttgcatgccgcgctgcgcgcaccgcgggctccgggctcagaagtgcggacgcccggctcccggcgtggacgccatggtgctgtgcccggtgattgggaagctgctgcacaagcgcgtggtgctggccagcgcctccccacgccgtcaggagatcctcagcaacgcgggtctcaggtttgaggtggtcccctccaatgtttaaaggatgaaaatgctttgggacaaaaattgccttcccttctgctactccgtatgtgtgtactgccatgtgaagacctgccaatgcagaatgggccctgtgatggttggccaacctgtgcttgttaccatgaaaatgaccttgctgtgtggccccctgactgttgtgtcaatttgggatgctgtgacactgatctgttgaccagtctgtggggggggtggcctttgaatttttacctttgtggaaggaaaaatggccccttggggttggtggaaccaaaaaggtccatgggactgccgtaaacgatgggatagcttggtacacacgtgtggtattgaaaagttgtgtcgaagcagggacaacaacaagtctggttgtttcccaacaatcgggttggttcctggcgagaagtacctggtaccngcaaagctatgacgtttaccccaaaagggcctaaaataaaatggaacgcccaattaccaaatgtcctatggggtagacaaccccgataggtggggttacaattcccgggtggcaacaattttcccttaaacccggaaagagggggaaaaaacacctcggacacaatgggggtttggcn

SEQ ID NO: 484881 - DNA, 710 bp, Homo sapiens
  misc_feature (114)..(114): n is a, c, g, or t
  misc_feature (185)..(186): n is a, c, g, or t
  misc_feature (596)..(596): n is a, c, g, or t
ttttttctttggggttaaaagatggttgtagcatttaaaagggaaaatttcctccttggttggctagtatctggggtgtattctctgtaagtgtagctcaaataggtcatcatnaaaggttaaaaaagcgagggtggccatgttatgctgggtggttaaggccagggcctcctccaaccactgtnntgccactgacttgctgtgttgcacccgtgggcaagttcacttatacacttaatatagggtgcccctcaagttttctcctctctctgtgtgttaacaatgtgggggcattacatataatatactgtgcacctataacctctcagagaggcgacagtttgtgagaggcgcaatgtgaactataatgtgcgtttttataaaacacagccattttgtggggggaatactcccctctcaaggcacacgagagaaatatctcctcaaagagacacccgtggagtatctatattcttatataaatatgaagggagaaatttgttcaccaccaatgtgacagcactttgtggatatcacggtctccccgggtgtgtgtctccccccgaagaatgtggtctgtgtctccaatatgaggnctccactatatttgttggtgttctccctcccaacgagaaaacagtgttggaatgtgagaatctcccactgtgtggggaaaaaaaaggcgggggtgaggatataaaccataggcc

SEQ ID NO: 484882 - DNA, 713 bp, Homo sapiens
  misc_feature (114)..(114): n is a, c, g, or t
  misc_feature (185)..(186): n is a, c, g, or t
ttttttctttggggttaaaagatggttgtagcatttaaaagggaaaatttcctccttggttggctagtatctggggtgtattctctgtaagtgtagctcaaataggtcatcatnaaaggttaaaaaagcgagggtggccatgttatgctgggtggttaaggccagggcctcctccaaccactgtnntgccactgacttgctgtgttgcacccgtgggcaagttcacttaactattaagggtgccctcagtttcccttcgtgttaaaagtggggataataattactgacctacctcaaagggcagttttgaggcatgactaatgctttttagaaagcatttggggactccttcagcacaggaattctcaagaccgtgagtattttttataataggaatgtccaccatgaacttgatacgtccgtgttgtcccagatgctgctcattagtctatatggttctcctccaaaaaactgaatgaatccatgggagaagcgggggataactagccagacaaatttggagaatacttaaacaacgctttggcacggaaacatacagaggatgcctttctggtgatggggggggatttttccccttttacaggtggggatatagtagtactgtgtgacagaataattgggaataatcctattatatcactctgaagctatggactatctgaaatgggtgtcctataaagtgaatgattctg

SEQ ID NO: 484883 - DNA, 416 bp, Homo sapiens
accccgctcggatccggagaaacggccgccagtgtggtggaattccagaaatgcatcaaacagaactaatgcctgggcatgagggagtactgactaaacaacaattaaaataaataagcggccaagcagctgggaccacaagcgaacgccatcatgcccagctaatttttgaagccccagcagagatggggttttgccatggcggccaggctggctcgaactccggacctcaagcgaaccacctgcctgggccttccaaagcgcggggataacaggcgtgaaccaccgagcccggtcccttggtcctaaagggattcgaagacttgtgaacgaagtggaaacattgcatagaatataatacacaaacggctggatttaaataatacgttggactgatgttaagtatttttgggcta

SEQ ID NO: 484884 - DNA, 189 bp, Homo sapiens
atacccattcgagctcggcacccatttttctactctcttttccttttctctctattttttcttttctctaaatcacatgattaatgataagtaaagcgaatgtgcacgcacaggagatatattactgtgagggcgagcacactataaatttgcgcgccctctatttttaccaattttacattaacttat

SEQ ID NO: 484885 - DNA, 701 bp, Homo sapiens
  misc_feature (173)..(173): n is a, c, g, or t
  misc_feature (194)..(194): n is a, c, g, or t
  misc_feature (211)..(211): n is a, c, g, or t
  misc_feature (236)..(236): n is a, c, g, or t
  misc_feature (250)..(250): n is a, c, g, or t
  misc_feature (252)..(252): n is a, c, g, or t
  misc_feature (307)..(307): n is a, c, g, or t
  misc_feature (424)..(425): n is a, c, g, or t
  misc_feature (431)..(431): n is a, c, g, or t
  misc_feature (663)..(664): n is a, c, g, or t
gctctagaacgagctggaggattctgcctaccgatacagagccttcgagtcgtcctggggcctgccattacaatccacctccatccgcttggaaatggccttcgtcccggcctatgactggtcccagcgggcagtacagaccccctagaagcccctggagctcccctttttcngtggcccctgcccaatcctcngtgagtctatccacccncctctactcctgccctcaagaggantttcaaagatggangngctggcggctccctaaaccacttttctgtgttcatccgcctccatcctgagatcngaaactggtgacctcgtcggcccctgtagggtgccctgacacagaagagggaatcccttgcagaccaacatgctgggctatattgacgacggtgtctgagatcggggaccgatcttnngaagangtcagtccctccttagttgcccgcctcagctgaggcctgccgccatttttcttgctgtccgacgtactgcagagcgcgccaagctgcccggagctctccgagaggcccaaagagactgcttacgtgccggccaggcagggggtagtcgcctggaggcccagaggaacggcctcccccaacttagcgggttatgctgaccgggacggtgaggggaacgaggccacccggactnncgcggtgatgtcatcgcagtccttgcgcccaatctga

SEQ ID NO: 484886 - DNA, 730 bp, Homo sapiens
  misc_feature (496)..(496): n is a, c, g, or t
  misc_feature (675)..(675): n is a, c, g, or t
cttgtctgaggagaagaagcatctgattaccttgaattggatacaattaacaatctcgtcaaaaaatattcacagttcataaactttcctatttatgtatggagcagcaagactgaaactgtcgaggagcccatggacgaagaagaatcagccagagaatagaatgaagaatctgatgatgaagctgcagcagaggaagaagaagatgaacagacaccaaagactaaaaaagttgaactgtctgggactgagaacttatgattgatatcaaaccaatatggcagagaccatcataagacgttgaagatgatgaatacaaagctgtctacatatcatgttcaaaggaaagcgatgaccccatggcttatattaactctactgctgaaggggaagttaccttcatatcaattgtatttgtacccacatttgctccacgtggtctgtttgacgaatatggatctataaagagcgattacattaagctctatgtgcgccncgtattcatcacagacgacttccatgatatgatgcctaattacctcaattttgtcaaggatgtggcggactcagatgatctccccttgaatgtttcccgcgagactcttcagcagcatctgcttaaggtgattaggaagaagcttgttcgttggaagaatgtggaccaacatcaagctnggtgtgattgaagacactcgatcgaacacgcttgctctgctatgatcagactctt

SEQ ID NO: 484887 - DNA, 244 bp, Homo sapiens
gcgatactagaggatccccgtagcccacctgatatgaaaaccaacagtagttttccacgattctgcttgtcccctagagttctgtaaacgtgccatcccaatattccaggagtcagcaagctctttctgtaaaggggccagagagtaaatattttaggcttggcagatcatatatggtctctgttacaactgctcaactctgcctttgtaacagaaaagaacccataatctcacacccagaggt

SEQ ID NO: 484888 - DNA, 823 bp, Homo sapiens
cactgtatttaactaactttaaaaaagaaaaaaaaatgtatacagtgttctccaaatagtcccgaattgtcgacctttgcttacaagaagtagtctggtctgcataggatgtgatagctatctctgttcattttacaagtgtggggcaaagttactgtttctagacaacccaactgctttccctgtgcagcgtttgtagcaacggacattggcacagtgacattctgcggcggggatttacttaatggactctttacaattgactaacgtggtttccctatcggggaaaaaactggccaactagaatccttgtcactgataagcaaaggaaatcctgatatagtagtaaattatgtgagacgaagtggtagatggattttatataatgaattacaattatacgtgtacaatcaaatcttagtctcagaggagttaatttatgtaaagttgtgtaaaaatttaatacttacaacaatgacaatgataaaaacgttgatagaaaaaaagcacaaaaaaaaatgaacatagacaatgttaagaggccgccattcaggcgtccactagaagcatgatgaaaaaaaaatatgatagaggacacgagagccaataaaaagtataaaaaaaaaagacatgtggcaccaagagatactagtctggacaagaatagagaaactcgcacggtgccaatgcgaacaaaagacggacacaggagacaactagcaccagcagacaagtataaaaaaaaactgcctaccgcgaggtggcaggaaaaaagctgaaaagctgtagtacctacaagatcaacaaggcatcacgatgaagg

SEQ ID NO: 484889 - DNA, 149 bp, Homo sapiens
taacgacccttacacttgaaacgtaagacggggctagatattgggagaacaaagtggaagatgctttctacaaaggtgaactcaggctgaatgaggaaaaattatggaagaaaagcagaacggtgaaagtgggagatacattggatctt

SEQ ID NO: 484890 - DNA, 422 bp, Homo sapiens
accgcgacactcaaggtaaagcttctaaggtgagaaacggtatcttgttatatgaacagagctccctttttttttgagacagtcttgctctgtcgcccagggaggagagatcagactgttactgtgtctgtgtagaaagaagtagacataagagactccattttgttctgtactaagaaaaattattctgccttgagatgctgttaatctgtaaccctacccccaaccctgtgctcactgaaacatgtgctgtgtcaactcagggttaaatggattaagggctgtgcaggatgtgctttgttaaacaaatgcttgaaggcagcatgctccttaagagccatcaccactccctaatctcaagtacctagagacacaacacactacagaaggccgcagggacctctgcctaggaaagccaggta

SEQ ID NO: 484891 - DNA, 1105 bp, Homo sapiens
  misc_feature (788)..(788): n is a, c, g, or t
cacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttgggcaagtggtcaagtgctggaaacggggcaccaatgagatcgtagccatcaagatcctgaagaaccacccatcctatgcccgacaaggtcagattgaagtgagcatcctggcccggttgagcacggagagtgccgatgactataacttcgtccgggcctacgaatgcttccagcacaagaaccacacgtgcttggtcttcgagatgtnggagcagaacctctatgactttctgaagcaaaacaagtttagccccttgcctctcaaatacattcgcccagttctccagcaggtagccacagccctgatgaaactcaaaagcctaggtcttatccacgctgacctcaaaccagaaaacatcatgctggtggatccatctagacaaccatacagagtcaaggtcatcgacttcgcgttcagccagccacgtctccaaggctgtgtgctccaactacttgcagtccagcatattacagaggccctggagaataatcatgtaggatacacatatgtggaggcgaatggct

SEQ ID NO: 484892 - DNA, 454 bp, Homo sapiens
  misc_feature (351)..(351): n is a, c, g, or t
  misc_feature (361)..(361): n is a, c, g, or t
  misc_feature (450)..(450): n is a, c, g, or t
attttaagagcttttcagcttttgaatatgtcatgtaaacaactgtgttgtctgtgactaactagagatatgtttacttttccagtccctatgctttggtagttgttttacttacctcaattcacagcctaggacctgaattacaatgttaaatagaagtggtaatagtgagtaccttgtcacctgatcttaggaggtaaggttttaataattcaccaaaaagtatgatgtttactgtaggtattttatagatcccaacaccaaattaatgttatattctgtttctactttgctgaaaaaattttataatgaatttcaaatgcttttctggcacctattgagaagaatgtnttgtatttcncatttcttctattgtggtaaattacattgtttggttttctaatgtggaacaatcttgcattcctggaataaattcaacttgattgtggngtat

SEQ ID NO: 484893 - DNA, 144 bp, Homo sapiens
  misc_feature (55)..(55): n is a, c, g, or t
tattggggaataaggaatgtttgcacctccacatttttattgtgctttctgtggnatgtgttgaaatctcatgtgttaatttattttctgcgtgttattattaaaggtgccattactttttaattaaaggaaaagtgtacatta

SEQ ID NO: 484894 - DNA, 185 bp, Homo sapiens
tgggcgaatccgccctatagtgacagatcatccagttaaacatatttagtgaataagaaatacattaatccaatgaagactgtagaaaaagaatttttagcatctattaaggaatcttcagctcagtttacacccaatccacattcatagttatatgattgacgaccactaggaatataacaagt

SEQ ID NO: 484895 - DNA, 315 bp, Homo sapiens
ctgcatccaacgccgccactccggcattctgcgggatctgcagccctactccctttcgatcggacgagggtacggaggccatcggccgtcccttcggatacggcgctcgcccatctctcaggaccgactgacccatgttccactgctgtccacgtggaacccttctccacttcggccttcaaagttctcgtgcgaatattggctacgtaccaccaagatctgaaactgagaaggatccacccgtgcccgcgccctaggcttcaaggctcactcgtagaggtcctcataatcgtcgcggagtttggatgcagtcat

SEQ ID NO: 484896 - DNA, 405 bp, Homo sapiens
  misc_feature (2)..(2): n is a, c, g, or t
cncccagtgtaggtgcagaaaaggaattaagaaatattcatgcagccaaaaaaagaataagattgtcttttgtggtaacatgaatggaactggaggccattattcttagcaaactaacacaggaacagaaaaccaaatactgcatgttctcacctataagtggaagctataaatgataagaatttattaacacaaagaaggaaacaacagacactggggtctacctgagggtggagggtgggaggagggaaaggagcaaaaaaataaccattgggtcctgggcttaatacctgggtgatgaaataatacgtacaacaaaccttggtgacatatgtttacctatgtaacaaaccttcatgtgtacccctgaacctaaaataatagttaaaaaaagtatttaaatta

SEQ ID NO: 484897 - DNA, 401 bp, Homo sapiens
aacaggcattgcatcttggatgtctgtgagctacacagtatgcatctcagccacacgttccagtaaattctctttttttgcttgagctggtttctgaccccaccccccgccccggccaaaaaatcctgactctgctgagggcagcaataactgggacatcagacactccctctagaatcaggacagaagtgacaaggctagccaatcaggggcaagaggagaaagacacatgcattggcacacacaggctcacacaccagcagggaacagagaaaacagcaagtcccagggtgggccaagtctggtccatgtgtttcctgacacaaggtctaagtgggtctctgtcttcatctggggttccccagaaaaagactctgaggccaggatgtacattcaaggag

SEQ ID NO: 484898 - DNA, 219 bp, Homo sapiens
tagtcagctcgggcccggatagagcggtctagcggtctcagcctttctctactctgagatttgttattctaaaacatcctcaaatatctaaagttcatgtactcaacccagaaatcaggtccattcccctagagtctgcaactccattctaaagaaaaacccgcctctgtatttttaccaggcatcacatgacttagggctagttttgacttaggcagg

SEQ ID NO: 484899 - DNA, 1665 bp, Homo sapiens
ggtctgtggccggagggtgatcaggtgttctagacacagatcagacattgtggtaatgatgccttgaaataaacactaaaccacctcgacagggcagccaggttcaactccttggcagagatgtgtatccttatggcctgcacacgtgcacaataaaaatgggagcttgagacgcaagaagaatggtcacctgaacgagaaacattgagaacggattactggcatcgagcttttagctgtcttctaattcaacaccgaaaataagctatctgtacagccaaagatcagatgctaagattaccttatccaggtggttaacgaatacggtgtggtagtcatccattaagcaatccagccgagcttgaggaaagtgacgcccttggcagtgaggcgagacagcacagagacggtgaaagctgagcctaggaattcccttgtcagaggttctccagaagaactacttatttaacacgaatcactacaagctcagctgatggtatctggggtgaccatgcaaatggactaccattgggtggggaggcaagaatgtaacttggaaacccagaatcccaagagaattacaagccattggctatgtgtccacaggaaagacctacacgaacttttggaaatagccggccggtgtggcaattagaacacgcccggttcaaactttgcgcgacctatctcttcaggggggactacacatgacacggtcagcccaacatgcagtcttcatgctagatacacattcgttaactacagcggatactccactactatttctctcctgccttctctttttttttctctctacattctacttcatcaccttgtccacaccgatccaagacacacaaaacgaacagacatacacaacaacaaacacacaacacgcacacacacgaacacacacaccggccatcacacgacagcgcccgacactacacccacaaacacccaaaacagagaaacagagccgcagagaaaggaagagaaaaaaacaaagacaagacacaaacagagcgagagaggaggcagaacagagaggcacacagaagcacggagaaaaaacaaaagagaaggaaagaaaacgaagaacagaaggagagaaggaggagaggacaaaggagaaggagaaagaagagaccaaagaagacacgacgaacgaaaagacgaaggcggaacacaccaggaacaacacaaaggaaaggagaagacagcgaaacaacagacaggaaagaaaggaacaagccaaagcaagagaaaaggagagagagatcagtacgaagaaacaagagaagacacgaaaacagaagcgagacaagcagcgcaagaaagaaaagacaaaaacagcacaacaaaggaagacacaaaaagaaaaagagaacgagaaaagggcagggcagaggaaagatgagaaacaaagaacagaaagagctaaggacaggaagagacagaaagacggaagacaacaggaagcagaaacaaacgaagagacgagaaagcagagaagacacacagacagaccgcaaaaagggcaaaagaaagacggcaaagacacggagacacaaggcagagaggcgcgaaaacaacggaaccaaaaaagagaaagcagaggagagagaaggacagagaggacgtaagccggcagaggaagaggag

SEQ ID NO: 484900 - DNA, 439 bp, Homo sapiens
  misc_feature (357)..(357): n is a, c, g, or t
  misc_feature (429)..(429): n is a, c, g, or t
caggggtgggggatggtctgtgggccctgccttttgagtggccatgagcatggcggtgccagtaacagaagtgggggaatcaaggaaagctggcctggctgtgtggctgcagggtaccagcagtgtaaaggaggggacagtgcagttgaggatgtgagcactagaagtgctcttgctatcttcaaggacagctgtgtggatggcagctggaaatgtggcctggagattaaggcagaggcttggactggagacagaaatttgagtcttctacaatgagatgagatctgaagccttgtgaatagagaaggcagcctaagaaggaactcagataaggaagaaaagccagagacaggccgngtgcggtggctcacacctgtaatcccagtaactttgggaggccaagggaggtggatcacttgagctcaggangtcgagacca

SEQ ID NO: 484901 - DNA, 364 bp, Homo sapiens
gtgggtccaacccctttccccctttggaaacttccatccctcgggaagaacttgagaccctctgtcagctggaaaaatacccattggggaaactggaggccccatttggaggctccacctggttaataaaaaatggaattggggacccacttaaaaagagcagtttggccatgctctcatagggcagatctgattgtgttggggttctgcttctgcccctggtcagtttaggctctccaaaacctgaaagctggaatcgctaagtcccgcaaacaggaaagatggtggcccacccttccctctggtaactctgacccagataattttcaaatcgctgacagccagaggacaggggcaagggagg

SEQ ID NO: 484902 - DNA, 383 bp, Homo sapiens
acttacactgccttaccatatgaggcgtgaatacgagaatgcttgacaatacttgccactacgagttagccctcaatacaatttcggcctgtcactgtcattatagcaccttcacactgttgctccgtgtccatctagtacatcgccggttcacagatatttctcttgtcatgatagctccatactttcaagatgcgtctttgtagtatttcgtatccatttagtcattcattcactgagtctgtatctatcagacacctacttatggaccaggaactgttgattattatctttctgttcaggtcatgatgagctgttcatttcttagtgcttgccactataatattcagagctacagttcgctgagcacctgtctcaataga

SEQ ID NO: 484903 - DNA, 1024 bp, Homo sapiens
tactatttgttaaccaaatcaacaacaacctatatagctgttccccaaccttttcctccgagcccctaaaaacccccctcctatatactagactacctgaatcctacccctgcatcgagtcactggcgagaggtccaatcgcctacatgtatccaagggagactcgagggtatcgagctgaatagaagagacttgctaggctctcgtatacctatatctctccataaccagaattctcctttaatttattagactagttcgatcgggccgacaagaaggtaagtcgagtaattggtagtatccttccttcggagataccagagcttttttaccgcgatccttgtgcttttcatcgaccgcgatgaggcgagacagccaggaagcgcgctgatgcgcgggctcattactgtcctattcgtacaccctaggttagagggggcccttcccgctattgcatcggcgactgaatgttacatcgtcagcaaggatcctagggggtcactaaaacattgcctagcatagatcacttcctcagtgcccagagaagctagtgcagaactcctagaagcgaacagactgtattattgactaagctttgcacattgagctttttatgtgtagagagatgaacctctttagcggactccacttatagagtcccgctaaagcccatgtttgaagcccccatcgatggctcaatgagtacttgcccggagtactccttacaactaggcggtaaggtataatacgctcaaaatcattctcaacccctgagaaaagatagctaccctttcttgtactatcctatgaagcatattttacaagtccatctggttgaaaagagactaaatcgttcatggtttcttaatagccatagcctcggtaagatttttcaaacccgaattacgggcgattcttatgccggggaacctctatgttgcgaaccaaaaggccggggtatctctcgggactccctattttggtgagggccctccaacagaggggcgtacaagagccagcggac

SEQ ID NO: 484904 - DNA, 448 bp, Homo sapiens
  misc_feature (352)..(352): n is a, c, g, or t
  misc_feature (414)..(414): n is a, c, g, or t
ggcgataataaactaactaaaccacggactgcgttcccaccatatgctcccgctaagcataagccccattacccacaaaaggcaggaaagataatagctaggactcttgaatagcaagacttttattgctgcataaatgaaacaatgaaatggataagcacgagacccatgccaatataaaaattctaggatcgacacccagacacaccatattatggctcccctcctataatacaaactctcaagggggacctactcccaaggataaaatcagacctgcaaggggaaagattgactcacgaaaagaggctcttatcagccctattagcggaagaaaccaacaactcaagcnaaagctgcgagagaccccagctcagcccgggaaatcgaccagcaaacctcttatcaaacgancgccttaagccatatcactcaaactccacaaacc

SEQ ID NO: 484905 - DNA, 1165 bp, Homo sapiens
ggggcgcctcactagttgcctcccttagttatgtgcctcgcttttcctatgtcttccttcgttcaatagtccccctttccgtgggcgccttgttgcgtgaatggatggtgatactttttgctccacttgggctatcgtggtactgtcgtctctttctgggcacccatcttctcggccgtagtacaatgacttgcgtttttcgtgtcttcttgatttactctcctactttgacccgtgcctgtctccctatgtttatcttctgtctcgtgactcgcgcgtgtcacttttgtgtcttattgtcggcggcttatttacgggggcggcttcccgtcttttgattcgtcgtagtgaaatcgcgttttgtgactatccttaatgggtctgccatgtagttatgtgcaatttttttgtcgtgtttttgtctcttttttggtgatttatgtgtttgtgtatatgtagttgactgttgaactctgtgtggtaagttcgttttgtatgttgtatttaagatttatttatgtgacgtttgtctatgtttgattggtcgttatcgtgatgtggctggacgcgaagactcgctttgcagccctcagggtccgcgggcaacgtcagagctgtgttgataggacatacttttcaggttcctgacagtcactgacgctactacgcaataactaaagttgcgtgattcgcgtgtggaaagccagtgtcgtgtcacttgaccagcttccttttgcctgtccaccgtgccctctgctctgtctacctccgtttcgcgtatttcttcagtgcatgttagcaggtcttgctggaatttcccttcgtccctcgcatgttcaactgctagcatgatttgttacatttgtccacagcgtgctattattcatgtgctttgacatttttgtacaaagtcacgtttaaatgcgtgcgtgcagaaagaattaagagcacctagccctttggactggaactctctgcaggcgtgtggctgtccctggcccacttattaattctttggagatggctcttcgtgtgtaaatcagctgctgggtgcgttcggtcacacttcgtaggccagcgtagtttgtactcagcagaacagtagtggactcgactcaggttcgtaagccttatatttcacagacaaacaatctgggctgactgt

SEQ ID NO: 484906 - DNA, 116 bp, Homo sapiens
ctcaagagggagctttgccatccgtcggcccaagcgagtgagcagaccctcgtcatccagggcccccagtgtgtacagcggctccatggctgtgatcaaagtttccataggtggcg

SEQ ID NO: 484907 - DNA, 264 bp, Homo sapiens
ggtgggacccatggccatcatggagctgggattccacctgatgttctacaaatgaccttgtcctgccctggcccttcctgtcctggcctccagtgggcaccatgatctccacccatgttgcgtgaccacccctcaccccaccaatccctcagcgagattctagcagaggggagagagccatggggcctgtgggtccccatggtttgagaaatggggctggcagatgagcatgggtgtccacccatgggtcagtgttcagtgcct

SEQ ID NO: 484908 - DNA, 466 bp, Homo sapiens
  misc_feature (35)..(35): n is a, c, g, or t
  misc_feature (161)..(161): n is a, c, g, or t
  misc_feature (166)..(166): n is a, c, g, or t
  misc_feature (347)..(347): n is a, c, g, or t
  misc_feature (373)..(373): n is a, c, g, or t
  misc_feature (410)..(410): n is a, c, g, or t
  misc_feature (447)..(447): n is a, c, g, or t
cggactgcagtttctacacagcaaaggcattattnacaggtattgttggtgccggggactgtggggagggacttctgggaaggctgttgcttagcctgaccacaggcccagcacagctgagactggggcaggaaactcactgtccttactcagtgctgttngaaanggggcagcgcaggcaggtacagtgcctccatacgtgatgttcatctttctcactccaaagaccccagctgagcaatctaagatttcaccactaggcactggttccttaagtctttatccagtacgttaggctccaccctatggcggatcaacacactcaccagaagggttgaggctgtacnctgtgtgtcataggatatctgcatcngggtatatgtgagatgatactaaactatccggcaganactaccctgtggagccaagttgtggctttacacctcngtaatcccagcattgggaa

SEQ ID NO: 484909 - DNA, 1132 bp, Homo sapiens
aagttctggctagttctgagtcctgggtgttaattcggccgatgggtgtccctccccgcccggctggatggctgctccgtgaccgggatgcagagtttgcgtgacccgtgctgccgatgtgcggccaccctgagactgcgttgcgcactgttcctgtgcctgctgcagcccgtgccctggccatggctgtgcccccctgcccgtctcctcgctgatctccgtttcggtctcggctcctggctttttactgcccctgcatgaacgaatgttctggccctgtgtgttggccccaatatgcccaaatgtgaattcccttcctggccctggggacatgctgatgccgtccccctgtgcaccctggggcccatgctgctgcacagatgtggcctgggtgggctgatgattccccctgcctgacccacgctgggaataaaactattacatcatcatgtctctctccacacataccacacttgaattgtgaggaataggctgaacagaatagacaacatagggatagctctttgagtgaatttgtttgcactttaaagcttgaacgacacaaactacagcgacagatgaatactaaaagaaaatcaaggtattaccacatcattatgcagagttatgaaagtagatatacaaaaaaaccataaaacattatacagagataacagtatcaacaaataacgttaaaaacaaaaaattataacatatcataccacaaaaaaacatcacatatagaatacaaaacactctcaacacaacaaaaaatcaaacaaacaatacaaagtatacacacaaaataactatgtaactacgtcaaacaacctacatatatccatagcacacacagacaagactacaaataaaaaataaaccaagaaaacatataaaaataaaacatcaagcaacaataccaacacacaattgaacaactctacaaccaaccaaatacacaaaaaaaaataaaacaaccaacaacaaagaactacaacacaaatacaagcaaaacacagaaacacacttaacacaatacaacaacaatcaaagaacaacaaataacaaaaagtacaactaagaaaaacgataaaaaataaaaacagtctccttcctctccctactaaatatc

SEQ ID NO: 484910 - DNA, 393 bp, Homo sapiens
ctgaaggccttccagtgggacaagatgtagaagggaagacagtgatattgaagatcctgagtaggcctaggctaatgtgtgtgtttctgtcttagtgtttaagggaaaaaaaagttttaaaagaaaaattaatagaaaaaagcttacagaatgagtataaagaaaataatttttatgcagctgtacaatgtatttgtgttgtgttaattacaaaagagtcaaaagttaaaatgtaaaagtctgtaaaactcatgaacagtggcatgcacctgtggtcccagctactcgggaggctgaggaggcaggatcacttgaggtcaggagttcgaggctgcagtgagctatgattacacctgtggatagccccactgggcaacatagactctgtcccta

SEQ ID NO: 484911 - DNA, 128 bp, Homo sapiens
gagataaatccctcaagattttcaatcctgcagaaattgagaagtatgtagctgaaattgaaacaagcaaaagaagaaaacgaaaagaagaaacaaaagaaagcatcatgatgaatcaaatgtcttag

SEQ ID NO: 484912 - DNA, 115 bp, Homo sapiens
aggcatctctgatacatcatcccagctgttctcctcccactgactgcgattcacaacattggtccagacaccatgcgtgtcacctgggctcacccccatccattgatttaaccaa

SEQ ID NO: 484913 - DNA, 797 bp, Homo sapiens
cgaattctaggctttagttttttaacaagaaaaggacgtccagctcttgctttggcgcctgggagggctggtccccaaggttgcattgaaaggcggtttgtccattcccagccgcccggtggagggtcaatggatggcaatttgaaaactaactgttacacaaatgtttcctgttggagctcgtaatttctagtttcctggcctaaataggttcacgttcctcctcccgggtcagtttccagccacctcgcacatttctgagcaatttaaaactcaggcttatccctaccaaggcttttcgtaaaccctctttctgctttgagctcctaaagctgtttcatagaaggtatggccttattttttaataaagagggccgttaagaatcagtgaatgggcatgacccataatgctttttttgccaggcccaatgataataactagcattgtgaagtcctggctatctttggactcataggaggtgcacaccagagacagaggtctgcattcagtaaagtgcagttccccttcttcaggtgggagattttttttttttcttcttcggaatactgcagtgatatatctgcctgccagcttcatttagaagcttttaccagttaaggccaccatgtcatggccatccatggccgggctgcctgttggatttatggaaattcccatgcatggtctctccttagaataacgatgcaactttttctggatgtcttggttcagagtttcaggccagtccctggcaacggggttgcatttcaagtttgcctctacctggggcctaacc

SEQ ID NO: 484914 - DNA, 154 bp, Homo sapiens
actccagttaccatctccgagctagaacataccacactccccacgcagcgtgtggagggctagacataaagttaacaattccaactaaaaatcaccctgcttctggcttatctgaatcccttacccaccccaccccacacccagtgcttcaggc

SEQ ID NO: 484915 - DNA, 301 bp, Homo sapiens
gcgagagagaaccaggagcacggtgacgccgggagcaggtaccccgacgaccgttgtcgctgcgcagagttcgaataagctgccttggatgtagaggttctggattcttttctcagctttatcccacatatctttcgccccttcctggccatccgtaagggctgtgaccgtgcagctgtggaaactcctcccgatactgtgcaaccggacttgactgttcgtcttgtcgtccaggccctgcgggctagttggccctgctgtcgcccagcttgagacacgcgacggggactcctctagacgt

SEQ ID NO: 484916 - DNA, 642 bp, Homo sapiens
ttatgtgtatcactgtgtcatccagcaaggatgcctcttcgtacccagagaagttatccaggaactatatcgacagtgaactggcttcccaagcacattcggagttcgagaaggcaatgaaggagttggcttaaggaaaaaaccccacctggtgaagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaagggcattggaggggctaggcatggacgaagggggatggggaagggaacatcctccccatcatgcagagtattatgcagaacctactctccaagggatgtgctgtacccatcactgaaggagatcacagaaaagtatccagaatggttgcagagtcatcgggaatctctacctccagagcagtttgaaaaatatcaggagcagcacagcgtcatgtgcgaaatatgtgagcagtttgaggcagagacccccacagagagtgaaacactcaaaaggtcgtttgagatgggctggtcttatgagcagtacaagattttggcacctccaaagag

SEQ ID NO: 484917 - DNA, 296 bp, Homo sapiens
gctaccgttggaggctgcagtgcagcataaaaatctaacagagtaagaacgtgcccaggcttggtggctcatgcctataatcccagcactttgggaggccaaggcaagtggattgcctaagctcaggagtttgagaccagcctgggcaacatggcaaaacctggcctctacaaaaatacaaaaaattagctaggtgtggtggcatgcacctgtggtcccagctacttgggaggctgagctgggaagatcacttgaacctgggaggtggaggttgcagttagccaagatcgtaccag

SEQ ID NO: 484918 - DNA, 124 bp, Homo sapiens
cggttaagagatagcgttgagaaagtacttaatgtgtcatgtacattattcgggtgatgggtacactaaaagcccagacttcaccattactgcaatatatccatataacataactgtacttgcg

SEQ ID NO: 484919 - DNA, 90 bp, Homo sapiens
ccacgcgtcgcccacgcgtcgtgcccccatcttacctccccttcttctcgtcccctcatcctgagccccagacatccgagctgcctgccg

SEQ ID NO: 484920 - DNA, 250 bp, Homo sapiens
tcgactctacaggatcttacgctctcacccaccccctacttaggcaagtatggtggtcccccgctaccgggaggtcaccaatattgatgccgaacttagtgcggacacccgatcggcatagcgcactacagcccagaactcctggactcaagcgatcctccagcctcagcctcccgagtagctgggactacaggcacgcgccaccgcgcccggcggggtgggtggagagcggggggtgggtggagagcgg

SEQ ID NO: 484921 - DNA, 115 bp, Homo sapiens
ggcgctgacactcatggcgctgtcaggatacacaagggacaatagccaaagagttacaaaaaataaactcccatgcattctttaacacgaagtgtgccaacccacaacacacaca

SEQ ID NO: 484922 - DNA, 372 bp, Homo sapiens
gagatacgcgtgatattttatagatactcaattcatatctgacgtcaatataatttagggtatatgtttttccaaccttgaaagccctgtacacattccagcactcatttaagtaatgtcatggtgcactgaaaagtacctctaatgtactaccaatttgattttatatatactcttgaaaagtgatgaccttcatgatttttagccaccataataaatatacacatccagtcttagacatgtcagccagtcccataacacaggccaaggtaaagttaacacatgaaaaaacaaactgctttacatagatttgtagagcaagtggaaagggtaatttgagaaagagacagaatatattaatctcgattttct

SEQ ID NO: 484923 - DNA, 928 bp, Homo sapiens
gaaaaagagagatactggtggttatcaatgacccatgtataaagttgtttttattatgtaagctgtcgttcacaaatgtcttcttatgtatgatcattagaactgttctgtatactatactctgtaaaatttccacattatcgagacattactttcagccagtgaagtaagtccttttgtaactgccacttaatgaattcaataaaatcatagattctatggtatcttggctagtaagtacaactatggatgactatctgatgacaactttgcttgccactatgacattctaactggcttcatattctcgcaaactctcgatttcctgctattcctggtggcctattttgtacacttttcccagcccttcaaacatactagatgcagctcatctctccggtaggtcagggcacaaatccattacaaacttagaccagctctcgttccccatagcttaacataaactcctggccatatcggattccacgctgcccgtgggaagccaagggaggctaacacttccacggcagggcgatacctgcaaggccaaacaatttcgcagaagcacccaaacggccagcccattacgcacactcacagcggcatacacgaaggcaacccacaaattcctgcttacacctcattcaccagcccctactcgcgagcaacttccagggctcctctctgccccaactcttgcccataaacccccttgtcgacaacacacccttgtacagcccacacgacttcaaccccaaacccgttgtcgacccttgcgcgcgccattacagacgcttctccccctttaacttcctggctcacccccctgcctaccaaccacacctggacacctcactctacaccttccgccacaacgccacacttgcacccaccctaacctgtacccctctccacgacccacccctct

SEQ ID NO: 484924 - DNA, 446 bp, Homo sapiens
tcccctcgctatcatcggcaccaacgaatggcaagttaaacatacagtcgcctctgacaagccacgtatgcactacagtggttcgggtgatcttcagccttcaccgagtatgtcttgctactcaagttgggccacgtgtctctacctgtatcattgctataaagccacttgagatctgttctttctctagacgtgctcattgcttctagcacaaatcaaaatagatctggaaacacctacacgagacagcctctgcctcccacattgatctgtttggaatatttatatcaagagtggatgtcaggcagggtttactcctaaagcacaattttgtgtgaagtctatataaccatctcagcagtttctgaggtcttggcttgaggctttcccatcgatcataccatgtcggtttgcccttgtatttaagcatgtactcgtctgtctct

SEQ ID NO: 484925 - DNA, 103 bp, Homo sapiens
ctggtcgaatctagagcgatccccttacaccccacgatcactatctttcctagcctccctgatcttgccaagcatagtattgtggtgtgttgaattcaatacg

SEQ ID NO: 484926 - DNA, 273 bp, Homo sapiens
gttacgctctgaatccggccgagcagcggggtgaattccacggacgttcagcttgccgagcatcatggcttcaaacgcgcccttcacgccgtcgatcgagatgatggtgatgtccttgcccggcttgagccctgcctcttcaatggcctggatggcaccgatcgccatgtcgtcgttgtgcgcgtacagcacgttgatcttcttaccctcggccttcaggaaggcttccatcacttccttgcccttggcgcgggtgaagtcgccggtttgcga

SEQ ID NO: 484927 - DNA, 191 bp, Homo sapiens
agccaaatgccagggctcaagtcatcttcttgcctcagcctcccaagtggctgggattacagctgcgtggttaatttttaattctgtggacactgggtctcgccatgttgcacaggccggtctcaaactcttgggcttaaacaatcctcctgcctcggcctcccaaagggctgggattgcagcaggcatga

SEQ ID NO: 484928 - DNA, 85 bp, Homo sapiens
gggatggacaaatatctttatttacagcaacagatagaacagaccctccctcccttcccttcctttccccttctgtcgtcttctc

SEQ ID NO: 484929 - DNA, 430 bp, Homo sapiens
tgaatttttgtggggacaataattccaacccctcccacacataattacccaatttctgaatgtctttcctggttaagttgccataaaaacgtttatctacttgaactcctaggatgatagttaaaaaaaaaaatgttggcccaggcgcagtgatggatgcatatgatcccagcactttgggaggccgaggtgggcagattgcttgagttcaggagttcaagaccagcctggcaacatggtgaaatcctgtgtctacaaaaaatgcaaaaattagctggacatgatggcatgtgcctttggttccagctacttaggaggctgaggtaggaggatggcttgagcccaggaggcggaggttgcagtgagccaaaaatcggccaccgcactctagcctgggcaacagagccagaccatatctcaaaaaaaaaaa

SEQ ID NO: 484930 - DNA, 354 bp, Homo sapiens
acagaggctgaatggttcattcttgtacattctgtgtgtttggacaaatgtataatggcatgtatccaccattatactaccataatacttcaccgccccacagttctctgccagttcatatcttcctgcaaatcccctgacaattgtgagtctacggtttccatagtttttccctttttcagaatgtcatatagttggaatcacagtaggtagcctttttttttagatcggcttctttcacttagtaatacgcatttccatttcctccacatcttttcatggcttgatagcttatttctctttagtgctgagtaatattccattgtctggttgtaccacagtttatccattcag

SEQ ID NO: 484931 - DNA, 223 bp, Homo sapiens
tggcatgtaagggataagtgcttatattattaagagcgggtggagttcttaaatatcaaccagggcactttctccggaccccttccctaggggatgtcaggatagagaaatttttccatcgagcctttttaaaatggtaggactgtgttccggtgggcttcagtgatgggatagtacatacacttcactcagaggcattggcatctttaaataatttcttaaa

SEQ ID NO: 484932 - DNA, 80 bp, Homo sapiens
cctggatgttgttccagttatgctggattccacagtgaaatcatttaaaaccatctaaataaaccactatatattttatg

SEQ ID NO: 484933 - DNA, 167 bp, Homo sapiens
aagcttacgagggtctaaacttcctacctcccatcatccaaacatagtaatactttttgcctgtggctggatatgaagaaatatgagttctataatgaaatgcccatattcttttatttccgactgcatcctcccattccctgaccagatggcctggctgcctcgtt

SEQ ID NO: 484934 - DNA, 351 bp, Homo sapiens
ttatcgcccatgatggggttagagacccacagttgctcaaaagcagtttttgtttttcttgatagctggatttgggttatctctcaggaagcggttagcagtctttagggcaacctaattgcatttctttgtttacaaagcacttaacttcatccctctcaggcgcacaccagcactgtctatcactaatactggcagttctagggtgaggtgtacagttgctcttagtcagaaactcaatttgctgttttccactagattcccagatagagaaggacagttgtttcaggcaagcttaagaccctgtaacatttcttgccctttttgatttgaactcccatctccctagct

SEQ ID NO: 484935 - DNA, 133 bp, Homo sapiens
tgatgatatgactggaatagtactggtgatattgctagggtggcgctccaattaggtgcatgagtaggtggcctgcaggaatgtagcggttaggcgtacgtgcagtgctattggttgaatgagtaggctgatg

SEQ ID NO: 484936 - DNA, 174 bp, Homo sapiens
ctcaataaatgtggtcattgatgcattgtgtctatttgcactactgtgctgttgtcgaagcacacactttcgttcatcattcatgctagaggtgcggtgtcagacgtcgccaacaatgatggagatgcgcaatggttgcgctcatgatcaatgaccaacaatttattgaggatc

SEQ ID NO: 484937 - DNA, 381 bp, Homo sapiens
  misc_feature (42)..(42): n is a, c, g, or t
aaaaaggggatgtcctcctggaaaactggggagtttctctgnccctgggatgggtttgttattaaaaaaatttggatgcctgtggttccaaaattgaaccttaaaccccaaattaactggggggggggaaaggaaaaaagaaaggatccagtggtggggaactgggttccgtggggtttccccaggaagtccatttttggggctcccccagggggggggaactggtccgggggttataacctttttccttttttttgggaacagaccccgggttttttgggcccaatcccaaaaaacccatagctggtaccccgcggggggtggctagaaaggtctggatactttttatttaaaaaagctttgccttttttcccgggccat

SEQ ID NO: 484938 - DNA, 780 bp, Homo sapiens
tcccgaaagaaccgaagagggttcaaaggggaattttccgcccccagtcttaccctcggagggtttctggagctgtggtgttgttggggcacgcgcaaccctcttctggtcttgggtgtcccgccatgccgttgtcccgggtaaacctttttatcaggggcgcggggcgcctctcggtggtgggagtcttcccactctgtttgtccgggctctctaaggtgcgaaagggacagaacgctgggggggccccatgggcccgggtgtgtgggggcacactctaacaggtcttggggataaattaatgtggggttggagatacgttacaacgaaaagacacaggtgatggaggaatatctctggggactctttggtaaatctttttacatcttgagatctggtggaacttgtaaaaggagacctgcgggggagatctatctcttctgagaaaggtctccacggggttcatatcccgtggagaaaaagtgtccacagggggacaggtttttctggtagattttgtggggggaacatattggggtctggaccgggagccaatgagaacattcctcctcccagtgaaggaataccctattttggagaaaacctcttctaatcaccggtaggctcaaacgggggttattcatcaagaaatgtccagaaaatgttctggggcttttctagtggcacaattaagggcacctttgggtatgagctatatgagactctgtgagtggaactcccccgtgggaaagaagattgggctctacaaaatgggtttca

SEQ ID NO: 484939 - DNA, 170 bp, Homo sapiens
tggtccatggtgctgcgtacagtgataggtggagtcgtaaacttgttgatctgtgttctggaaggactaaggagaattgggaaaaagcccatgaattattcaatgatatccaccataacccagggaaaggaagaaaatccttctgccttcctcagagcggctacaagagg

SEQ ID NO: 484940 - DNA, 309 bp, Homo sapiens
ccagtggggttggcagatgccccattctgacatgtagatcgacaggacagctctgcaaataggaggtgatgtccatgcttccattttctaaacaatcactcctcaggaaaccctccaacatgtatccactgtacacagtgactaggtcatcatgtctccttattgattatgttcgcctcgagcaattgcattttctacgtgagctgatggaccacattagattttttcccgtttggcgcttgtctgtgtccacggtctcgtcgggttcgccggtcatgatgcccagcctcatctgcgggcggatcctct

SEQ ID NO: 484941 - DNA, 681 bp, Homo sapiens
  misc_feature (1)..(1): n is a, c, g, or t
  misc_feature (134)..(134): n is a, c, g, or t
  misc_feature (174)..(174): n is a, c, g, or t
  misc_feature (182)..(182): n is a, c, g, or t
  misc_feature (200)..(200): n is a, c, g, or t
  misc_feature (203)..(203): n is a, c, g, or t
  misc_feature (208)..(209): n is a, c, g, or t
  misc_feature (223)..(223): n is a, c, g, or t
  misc_feature (230)..(231): n is a, c, g, or t
  misc_feature (235)..(235): n is a, c, g, or t
  misc_feature (253)..(253): n is a, c, g, or t
  misc_feature (272)..(272): n is a, c, g, or t
  misc_feature (275)..(275): n is a, c, g, or t
  misc_feature (318)..(318): n is a, c, g, or t
  misc_feature (407)..(407): n is a, c, g, or t
  misc_feature (452)..(452): n is a, c, g, or t
  misc_feature (459)..(459): n is a, c, g, or t
  misc_feature (465)..(465): n is a, c, g, or t
  misc_feature (507)..(507): n is a, c, g, or t
  misc_feature (543)..(543): n is a, c, g, or t
  misc_feature (555)..(556): n is a, c, g, or t
  misc_feature (562)..(562): n is a, c, g, or t
  misc_feature (569)..(569): n is a, c, g, or t
  misc_feature (572)..(572): n is a, c, g, or t
  misc_feature (585)..(585): n is a, c, g, or t
  misc_feature (589)..(589): n is a, c, g, or t
  misc_feature (595)..(595): n is a, c, g, or t
  misc_feature (603)..(603): n is a, c, g, or t
  misc_feature (612)..(612): n is a, c, g, or t
  misc_feature (617)..(617): n is a, c, g, or t
  misc_feature (666)..(666): n is a, c, g, or t
naaacctgtttgttttatacaaaagaatataccctaacacagtagagtctcataatgccttggcgaacaccaatttgatgctttaagattttaatgtattgttaacaaattttcaaactcaggcaagtttaganatgtcttcatattgaattccttcaactctgcgtccttttncggggccngtctccttggcgattgtngcngaaanngtcttctcattggngggttcnngggngccttcatttcctctgtngcctccatttaaaactagnatnctttttcctggtgctggaattactgtctctaaatgagtctggncaagtttcagcttgtctcccgaatcaatcatcttcacaacagctgtatatttgtcaattacttccttaacaatagcctttttcttatgntatttctctcccagtttcttggttataattttcacaataatttcnggccgtngccagnagtctgttcgggcggttcttttcttttcctcttcggtctccntgatttcatccagtgcagatttctttttcaaaatanctttaaaaaaanntgagcncaggggnggntcttttcgtttcnctgntgctgnacttcctntcgtcttcngtgcnctcggtcccagagtacttgacttggaagatgttgctccggatgagctanatgctccttttttca

SEQ ID NO: 484942 - DNA, 452 bp, Homo sapiens
  misc_feature (417)..(417): n is a, c, g, or t
  misc_feature (421)..(421): n is a, c, g, or t
accgatcagccacagatgccgatgaggacaacagtggttggttaggggttgggaaggatgacgctgatcactccaagccaggcgcctggcgcccaggcccttcacccctgatcaatcaatacagcctaacagtgggactggatttgacgccacacgacactaagtctctgcttaagtgtgtggaatcgctgtccttcatcgtgcgtgatgctgcccacatcacacctgacaactttgagctctgcgtcaagactctacggatctttgtgcaggccagtctgaatggcggatgcaagtcccaggagaaacgtggcaagagtcacaaatatgacagcaaagggaaccgcttcaagaagaaatccaaagagggatcaatgcttcgccggcctcgaacctccagccaacatgcctctcggngcgngcagagtgatgatgatgaggacgaaggcgag

SEQ ID NO: 484943 - DNA, 880 bp, Homo sapiens
gaacgacattcattatctgcaaattaagactcatccttcactttccaacacatagctgagggttgttggcgttgttgtagctgaccaccaagaagcagtcactgcaaatctttctaattcttccctatcaccttttgtattctaatgcaattattttggtccagaactgacctgtattcttctgtattgtacacaaaagctaagtaagtttctgtgtactttgtgtatttcattttgggaggttgtagtagtgatcttcaacttgagtattaaataatttgcctagattaagcctacaatgactgaccagctaattaaatgagagatatttctcgaatctggattctgtagcctaaagttgagtacattcttagctaagaagaaaattgggaaatccatcatctatattaggcaacagattctcaggagtaagattgttaacttctatgatttatgagtaatcaagctggacttggatcactacaaggttagtctctagtaatcgtattggaccagaaatgtaaacttcatgggctcagatttgagaagcattcatgctcacaagtttagggacagtgaatgcataatgaaatcatcttggatttctaaaataaactttcggacattgaacaagaaatgcatctgtcttagaaacctggcagattatccgatgtagggtaaaccatgtacttggcactctggcacattaggtatcacgtaaattcgacaacttgagatactcaccgacaacacacgaattcttctcacaactttcagatcatcttttcttataagaagcacccttgaactgtacacacatgtgggtccagcatccatgctatttcggcacccctagaatggcatcctgtttgttgaccca

SEQ ID NO: 484944 - DNA, 840 bp, Homo sapiens
agcgggtattgtccgtccctccgggctttgtaaaatcgtcgccggcgttacctggccgtgggcgcgtcctggccgcgtgacagtcccggagcagggttgccagaccgccggcgccgccgccatggatgtccccgggtcactgtggtgagagagtgaaggaccctagactggtgtccgttcttgctagggccacctgcggtgttttttgtgctctggcgtgccctcgatctagccctatcgttgtgtcagctccctcatcaagtgcctgctctatcttctgcctctggctcttccttctggcccatggcctgggattcctgctgggtccgccccgagacgcttcacccgcatctttgatgcggggcttgtcttcgtctgctagtaggtgactgccttcctcatctggcatggaccaatggatacttcgtgcatggtctgctgatgtttgcttgtgacgccacattgttctacgcctcggcctttggcatgcagccactggctcttcggacaggtctggttgatggcacgcgcgtgtcgggcctgtgctatgccctccgtctacccatgcctctcaggtgccttcacctacctggtggggggtctactgtggcccttatcggcttctgtggcgctggcgagctatggcgaagtctgcggctggccgggtgcagactggcgctggacagagctggcagctggccagtggtgcactcttctttatcatctcagacctgaccatcgcctcacaaatactgtattcctgtgccctactctcgggcgcttattcatggtccacctactatgtgggcacaaattaaaaaaaagtaacttttccgggct

SEQ ID NO: 484945 - DNA, 212 bp, Homo sapiens
attggagtatctgcagcagaatggattgtgccatctgtggagctgagatctccctgatggggaccatgattgaagcgctgccagtatgtgacgcgaaggtgtggctgtgtctacaaggctctgagtgacaccacatcttactggaaggcgacttggttgaaagccaaaatgtgtcacccagggcatgcttgcactcagaagttttctcatga

SEQ ID NO: 484946 - DNA, 142 bp, Homo sapiens
gtagagaagagttttcgccttgttgcccaggctggtctagaacttctgcgctcaaacaatctgtccacctcagcctcacaaagtgctgggactacaggcgtgagtcaccatgcttggttgactgcccttctgtcgtcttctc

SEQ ID NO: 484947 - DNA, 423 bp, Homo sapiens
ggcatgtgtgtaggcagcgtgctctcctgagtgcggaagtcgctgagcaccaatgcgatgcccccgtggggatggggaccatgctgcgtgaggacctggtgctgagcaagcccagccgttaacacgcgcagcacacattcactcagaagcagacgtggcagcgtttccgttcactagttatttcgtatcgtaattcgtttattactaattaacagtatcatctcagtttactagttattacgtattgtaatcaacttattactaattaatatcatctcggttcactagttatttagttattatgtattgtaattaacttattactaattaacaaggtcagggcagtgttttgtcttcaccttccctcgtgagatacaggttccaagaactcagcctatggcacacgctggcctacagcacatg

SEQ ID NO: 484948 - DNA, 806 bp, Homo sapiens
ggcggctgctgtaggaccggtatgctccgagcgtcggttgcccgacaatgtgagtgccatatccttggggacattctgccactgcagccctcagagcctgctgcatgtggaagaacgagcttgacaaatatattgttgtacctggttccagtcaagcaaaattaattcagcaccagttcctcatgccatgcacctgctgtcacccagaatgaccaccctattataaggggtacagccgttgtacaattggagagttacaaagacctaagccttgatgactttaaggggaaatatatggtgctataagcttctatcctatgggatttaacctttgtagtgtcctacagaaaattgtatgctataaaggtgacaagagctaacagaatttaccacgatgtgacactgtgaaggttgtcgaccagtctacagtgggattcccacttaagccatcttgcctggataaatacaaccaagcaaagcaatggtggtattgggccacattgacacatcgaactcttgtcagacatataactaagacagatttcccgagactacccggtggttgcatgttacgaaaggtcctggatcttgcaactaagaggtctctatcataatttgcacccaatggaagtcctcaagcattaaagaacgtaacagaatatcccattgagaccaacaagtggagaaaactacgattggaagaaagcaatccaagttgacgaaacaatggaacaactgaaccgtgatgacacgggaacaaagaaaagaaagcacgtggccacaaagaatcaaaagaaaaaaaaaac

SEQ ID NO: 484949 - DNA, 290 bp, Homo sapiens
aaaaaaaattttttttaaaaaagggacccccccccccttttcccaaaaggggggtctttttttaaaaaggggggggggatcttctcgggggggggggccccttaaaaggccacaggggggttaaaaattcctcggagggggggggttaaaccaaaaattttccccccccccgttttttggccccaaaaaaaaaaaatttttccccttgttttgggcccaaaagggggccaaaaaattttttttggggtttttggttgggggtaaaaacaaaaaaaaacccccctttttga

SEQ ID NO: 484950 - DNA, 373 bp, Homo sapiens
  misc_feature (18)..(19): n is a, c, g, or t
  misc_feature (22)..(22): n is a, c, g, or t
  misc_feature (24)..(24): n is a, c, g, or t
  misc_feature (27)..(28): n is a, c, g, or t
  misc_feature (45)..(45): n is a, c, g, or t
  misc_feature (49)..(49): n is a, c, g, or t
  misc_feature (51)..(51): n is a, c, g, or t
  misc_feature (56)..(57): n is a, c, g, or t
  misc_feature (61)..(61): n is a, c, g, or t
  misc_feature (74)..(76): n is a, c, g, or t
  misc_feature (82)..(82): n is a, c, g, or t
  misc_feature (86)..(86): n is a, c, g, or t
  misc_feature (102)..(102): n is a, c, g, or t
  misc_feature (110)..(110): n is a, c, g, or t
  misc_feature (116)..(116): n is a, c, g, or t
  misc_feature (120)..(120): n is a, c, g, or t
  misc_feature (146)..(146): n is a, c, g, or t
  misc_feature (148)..(149): n is a, c, g, or t
  misc_feature (152)..(153): n is a, c, g, or t
  misc_feature (157)..(157): n is a, c, g, or t
  misc_feature (165)..(165): n is a, c, g, or t
  misc_feature (179)..(179): n is a, c, g, or t
  misc_feature (182)..(183): n is a, c, g, or t
  misc_feature (187)..(188): n is a, c, g, or t
  misc_feature (193)..(193): n is a, c, g, or t
  misc_feature (197)..(198): n is a, c, g, or t
  misc_feature (235)..(235): n is a, c, g, or t
  misc_feature (242)..(242): n is a, c, g, or t
  misc_feature (271)..(271): n is a, c, g, or t
  misc_feature (276)..(276): n is a, c, g, or t
  misc_feature (292)..(292): n is a, c, g, or t
  misc_feature (372)..(372): n is a, c, g, or t
ccatccaggccacccccnngcncnagnntgccacaacaaaacgcncgcngnccccnncccngaactcccgcggnnncccagntcanctggcgcgcgcccccncccccccngctccncccnccccccccccccccatagccaacgcncnnccnncccngccccatncccagactatagcnagnncccnnccccncccnnccccctgaatgtgtgctagctcaggtgccccactctntttcctnaaatccttgggagccggatctccccatcnccccnactcactcttcccttntcttctctcagtgttgtctgaataaagtgtgaaatcttttgtgttttctaaattgacattttcaatgaaaaaaagaatcnc

SEQ ID NO: 484951 - DNA, 163 bp, Homo sapiens
tctagagtgatccccactagtccacggttgctaggaggggtgaaccggcccaggtcggaaacggagcaggtcaaaactcccgtgctgatcagttagtgggatctgcgcctgtgaatatgccactgcatctagcctatccgtgtgacttggtgtggtacctgat

SEQ ID NO: 484952 - DNA, 1220 bp, Homo sapiens
agcggaagacgtacaggtgcaataatgcgaaaggtactgcatttatcgcgtgctccgaatgatgaattgtgcactcgccaactagcaggcccgtggcgccctcgagcttgtcatggaggggtgtcgtcggagtggtagacatgtactgatatgagataggcatcctacgcgagccgtctcaagtcgtccgtacggtatggaagggatccgagcacgcgtaccaagcagatgcgtacgacaggatagtgcggacgggagtgacttcgagggcactgtcagtgcgacttcgaaagagcccctcgaatctccgtggcgccacgcccgatgcatcaaggctatagaggtcacgcatcgaacgctgacttccacgcccaaaggcaacgaactagcttcgagaccacgacggctcgtgtcatatggtgacgcattccacttgtgtgcccttgtgtgggacctaatgtctgagggtctcggggaccccaagcacaaacttcccaaaaagctcgctgggacgtgcgtgcgaagggtccaaggcacctactcgcaagactttcgtcgccgacgccggaactgcatacagtggcttctcgaggatgtagaatgcaggtgttcgacatatgcattggggtctttgcgttgttaattgaaccaattcgtataaaagttctcttagcaatgcttaaaaagctttgggaaagaaggaccttggttgaactacaggaagaggaaataaggtccttattgcggaaggggaaggggagggatggaattaaacctgtgtgtgagtcgatcagttgacgcgtttggtcgagggctatgagtttggtgtggatttccttctggagaggacgaattgaacgggaaattgagagggtgacagagcacaaagagggggttatttcgcaggggggtcccgattagcatgattaaacacggaaagagagcttgaaaaaaggataatttgagaaaagggggaataaatcgttgtgtgaggaaggagggtatatggccaggaacttgcacattgttaaagtccccgcgaggaagtgcatgtaagagtttcggggtgaagataagtttgatggctgtaacaagggtagtatagccccatcggggtaggcaaagaaaaaggtggccctgattcattacgtcaggataaataacttggagttggagtatatcccagggtggacattccgagtgaaaaggcagatgattta

SEQ ID NO: 484953 - DNA, 483 bp, Homo sapiens
aataattctttcaatccatgaacacaggataactttccatttatttggctcttcagtttctttcatcagtgttttatagttttcatcctagagatttttcaccatggttaagtgtatttctagatatatatatatatatttttttttaattgtattgtaaatgggattttcttgatttctttttcatatagttcaccattaatgtatagaaatgatactggtttatggctgtaatcccagcactttgggaggccaaggcaggtgagttgcttgagctcgcgagtttgccaccagcctgagcaacatggcaaaaccctttctctacaaaataatacaaaagttagccaggtgtggtggtcccaactacttgggaggctgaggtgggaggattggttgagcccagggagttgaggctgcagtgagctgtgattgcaacactgcacttcagcgtgggcaacagagtgagatcttgtctcaaaaaaa

SEQ ID NO: 484954 - DNA, 156 bp, Homo sapiens
gacgtcgccacacgcagtgctagctgccgcagccttagtgcttgtagcccaaagcacagtcacagctgctcagtaaagaataataggaataatagtgtaagtgattattaacaggtaatgaaaggcattctagcatagactgaacggctctcctga

SEQ ID NO: 484955 - DNA, 164 bp, Homo sapiens
ttcagaaatgctggtaatcaatggctagagagaacaggtcttatgttagaacatttaaaaatatacatgtttgtcttacttctgcaatgtgttcttggttcctgggcatattgagtcattcctcctatctgtgactagggcaggttcgacagagcatccaaagc

SEQ ID NO: 484956 - DNA, 348 bp, Homo sapiens
  misc_feature (1)..(1): n is a, c, g, or t
ntgtgacctctacctgtaatttcattgcttcttgtgtatgtttccacctcttgttctgtgcgcctagccaaatcagggtgcttaactaatttctcctcagggttgccaaacttctttccagatcagggccctgcccttcttcctccaaatcgaggtgctccatgccctcggtcacgtccgcggtatcggtcactcgaatagcccgacatggcgtcaatggttgcggttgacggggatcgtagtatatagaagagcgtgcgtcaagtcgctggaaatggcctcgatgacggcgaagccttgcgtgggcgtcagcggagaaagagcaccgatgactacagccgaagctgc

SEQ ID NO: 484957 - DNA, 267 bp, Homo sapiens
gaggatccccgggccagtacggcatgtgggtgggcagatatgggaataaaagccaggccactgagcccagcagcggcaacctgccgggtcaccttcccacgccgtggaacgtttgtgtttcactcttcgcaataaattttgttgctgctcactgtttgggtctgcgtcacctttatgagctgttacactccacacaccaacaggtctgccagcttcactcctgcaagcccagcgcagcacggggcaacccccacagagcagcagcgt

SEQ ID NO: 484958 - DNA, 393 bp, Homo sapiens
aatgttgtttttttactgttaagtacttatgtgtgaataagtgaaaatgattgttaatttgtagcatataaattcaaagtcaggaataaggatgatgtcaaacaaccacagattgtccacatgagtggctgagataatgacacctttgccatctgacgattcagtgtacccacttatgtttcatgcgcattattaaaatagtgtattaaatgagcttcaggcggtgtgaataaggtaaatacaaaacataagtgctctttgtgtttagtcttgggtctcatatctcattatgtatatgcaaatgtttcaaaatcccccaaaatcccaaatccaaaactcttctgatcctatgtatttagaaaaacgcaaactcaaattgtgttaataaatgag

SEQ ID NO: 484959 - DNA, 367 bp, Homo sapiens
tgggtagggaggtgtcgtgtggcccaccgacttacacatgggtcagtaggagattctatgagtcgcagctgggatatatatatttgtgatgcagagaattatctcaaagtgttgcacttgttgagccttctcattagcgcaacagtgtttcgtgtatcttgggccactgccctcccatcgggcacaggctttgaagggtggaatggccggccagggacaatccaggcattctgccggtagtctttgcagcgctctttctcaaacgtatgttctggtgggaaagcacaatcttctgtgtgactctcccatagttctcaacaggtggcggcatggatccgcgtagagagagcagccaataagaggttct

SEQ ID NO: 484960 - DNA, 574 bp, Homo sapiens
  misc_feature (467)..(468): n is a, c, g, or t
  misc_feature (490)..(492): n is a, c, g, or t
  misc_feature (499)..(499): n is a, c, g, or t
  misc_feature (525)..(525): n is a, c, g, or t
  misc_feature (551)..(551): n is a, c, g, or t
  misc_feature (569)..(569): n is a, c, g, or t
tcccccgggctgcaggattcggcacgagcttttgacagataacatttaatagtaataaataagtggtaataagtaataaataataattgagtgcttttcacattccaggtgctgagctgttttgcatttcacgcccctcatcttcatttatattgttgttcttaattatccccattttaccgatgaggaaagggagattgtaaccaccccgaggctgcacagctaatacccagagagcagaatttcgccacatgcgaagattctagctaatcctgcattatctggtacccaccatttgtatcccggcatcatttatcttctccctaccttgttgccaaggcacgtgtgggtccctaacggctggcaccaattattcaagacaccctaagggagaccagaaggaaagcgatatttaagaaatgcaggcacagatttaagcattttagactcattctccatcagcaggnnggtctttgaagaggctgctttnnnacagcantagtctgactctagattcagcgctcnatgagtatagagacgcgtgacgcccntgtgtgccatggccgcangctgc

SEQ ID NO: 484961 - DNA, 628 bp, Homo sapiens
  misc_feature (277)..(277): n is a, c, g, or t
  misc_feature (521)..(522): n is a, c, g, or t
  misc_feature (544)..(546): n is a, c, g, or t
  misc_feature (553)..(553): n is a, c, g, or t
  misc_feature (579)..(579): n is a, c, g, or t
  misc_feature (605)..(605): n is a, c, g, or t
  misc_feature (623)..(623): n is a, c, g, or t
tcccccgggctgcaggattcggcacgagcttttgacagataacatttaatagtaataaataagtggtaataagtaataaataataattgagtgcttttcacattccaggtgctgagctgttttgcatttcacgcccctcatcttcatttatattgttgttcttaattatccccattttaccgatgaggaaagggagattgtaaccaccccgaggctgcacagctaatacccagagagcagaatttcgccacatgcgaagattctagctaatcctaanatctgtttttcaccagacgacgccggcccttccggcttgtcgtgcagcacggcattatctggtacccaccatttgtatcccggcatcatttatcttctccctaccttgttgccaaggcacgtgtgggtccctaacggctggcaccaattattcaagacaccctaagggagaccagaaggaaagcgatatttaagaaatgcaggcacagatttaagcattttagactcattctccatcagcaggnnggtctttgaagaggctgctttnnnacagcantagtctgactctagattcagcgctcnatgagtatagagacgcgtgacgcccntgtgtgccatggccgcangctgc

SEQ ID NO: 484962 - DNA, 148 bp, Homo sapiens
agacaatgataacttagcaacaatataaattaacaattagatttctaagaattaaaactcaaatttctaacccatataagattggcttccagtgcatagaaaatctgactgaataattctaactgcagtgctttggcttacccatcaa

SEQ ID NO: 484963 - DNA, 125 bp, Homo sapiens
cagaaaacagaactttattccaagggccagagcgtcactcataatctatatacactccttggtcatcgtcgtcagtggctagggtccaggttatcatagatatagagcccttctgtcgtcttctc

SEQ ID NO: 484964 - DNA, 953 bp, Homo sapiens
  misc_feature (62)..(62): n is a, c, g, or t
  misc_feature (66)..(66): n is a, c, g, or t
  misc_feature (295)..(295): n is a, c, g, or t
  misc_feature (301)..(301): n is a, c, g, or t
  misc_feature (349)..(349): n is a, c, g, or t
  misc_feature (428)..(428): n is a, c, g, or t
  misc_feature (465)..(465): n is a, c, g, or t
  misc_feature (493)..(493): n is a, c, g, or t
  misc_feature (508)..(508): n is a, c, g, or t
  misc_feature (547)..(547): n is a, c, g, or t
gagcggtcagggatcatgagggagagtgcgttggagccggggctgtgcccgaggcgccggcngggnggtcccgtgcacgccgtgacggtggtgaccctgctggagaagctggcctccatgctggagactctgcgggagcggcagggaggcctggctcgaaggcagggaggcctggcagggtccgtgcgccgcatccagagcggcctgggcgctctgagtcgcagccacgacaccaccagcaacaccttggcgcagctgctggccaaggcggagcgcgttgagctcgcacgccaancgccgncccaagagcgcgcggtgcgccgcgcagccccaggtgcagcggctgganggccaaccacgggctgctggtggcgcgcgggaagctccacgttctgctcttcaaggaggagggtgaagtcccagccagncgctttccagaaggcaccagagcccttgggccccggnggaccagtccgagctgggcccagagcanccggaggccgaagtnggagagagctcggacgaaggagccggtggagtccagggncccagcaggctgtcggcagcaccggattgcaggaaggtacagagcctccgaagggccctttcgggccggaaaggccctgaagcgccaacgatccactcccggtcagagccgcgtcgccttgggcctggcccggagcgcaaaaagcccaggcggaatgcccagacctgcgcttggagcccacgctggagccagagcctccgaaggacgaccgaggaagatcccgggagaactggggctgccgaaaaagctcttggtccaattggacgagtgttagccttgaagggctggatgtttggcctgactacccttgtgcttgtgcctttgtaccaaaataaatctttccgaccgtacaatcacgcctattagggagggaatccaatcaacaaggggggggctctggactacc

SEQ ID NO: 484965 - DNA, 322 bp, Homo sapiens
  misc_feature (17)..(17): n is a, c, g, or t
  misc_feature (86)..(86): n is a, c, g, or t
  misc_feature (91)..(91): n is a, c, g, or t
  misc_feature (130)..(130): n is a, c, g, or t
gaattatatagtatgtnatctttgaaactggattctttagtttgcataatgttttcaaggttcatccacattgtagcatgtcaganccttnttcctttttatgtgcgatggtatggatatagcacatttnatgtaagcttattcatcagtagatgggcacgttgtttcctctttttggctgcttgaataatgctgctgtgaacatgtgtgtaggtttttgtgagggcgtaggtttccagttctcttggggatatacctaggagtgggattgcagggtcatattaattccgtgtttaagtgtttgaggaaatgccgaactgtt

SEQ ID NO: 484966 - DNA, 501 bp, Homo sapiens
  misc_feature (37)..(37): n is a, c, g, or t
  misc_feature (279)..(279): n is a, c, g, or t
  misc_feature (404)..(404): n is a, c, g, or t
  misc_feature (467)..(467): n is a, c, g, or t
acttgagatatccgtttgacatggtcggccgcttggnagcaacccgaagttgggtgtcagccttgcccgcgtcgcaggatcctcgacgacgcggtccaggtaacgccgatacccggcattgcaccacgcgtcgaacctgtccatgagtggatgcacgatgctgcgcgggcccttgatgattccccgcaacaccaagtcgatgacgactagtgcgctgccgtgaagggccggttgcacgcccggcacgccagtatcgtcttgagccaagggggcacccgnaagtccggcttgggaatcgaccacaccggcgtgcgctgaaaagacggtcagcgtgccgacctcgggtgcgatggacggaatgatctgcaccgcactggctcccgttgccgattgattgccaactntttgggcccttcatgttcgttagttcgtggttcccagtcggtttggggcggtgttatttttgncctttgaacgaattttggggccagaaattccctt

SEQ ID NO: 484967 - DNA, 134 bp, Homo sapiens
cagatatgttggcggcaggataatagcagcattagtgcacggcttccgaaagtgtgcatgtgacagtaggaacaggcgttatttccttgtggtcacttttgcttccaatgtttaagggctctcggctcctcact

SEQ ID NO: 484968 - DNA, 136 bp, Homo sapiens
aaccaattttgaaccttgatataaaatgaaggagggagatgacggactagaagactgtaaataggatacccaaggatccacctttgtcatgctctccccctcccccgtcttcaataccgggtattcatttgtcaaa

SEQ ID NO: 484969 - DNA, 252 bp, Homo sapiens
ctttttgtatgtagcgtaaaatatgtactatattaacaagaatactgaataatgatgcagtgatcattgtacctgtattactcaacgtccctccaggaagaatagaaagtgatttcagtgtattcattatcataaggaaattttaagcaggaaatctggttatatagagttatagagcgaactatcacaggttatgtaacattagacaattagagacagcatgcagtcactagtcattccctaggcctagta

SEQ ID NO: 484970 - DNA, 335 bp, Homo sapiens
aagaatacattaaagagcacattatgatagatctatcatagagattaatggacccgagccctgacttcagatgagcttacaggatgtctcttctttttatcttcgagatggagtcgcaccctgtcgcccaggctggagaatgcagtggcgcgatcttggctcactgcaacctccgcctcccgggttcaagcaattctcctgcctcagtctccagagtagctgggagtacagtcatgtgccaccatgtccggctaattttttgtatctttagtagagacggggttttaccatgttggcccggctgactccagacctcgcgatctgcccgcctctgg

SEQ ID NO: 484971 - DNA, 157 bp, Homo sapiens
  misc_feature (4)..(5): n is a, c, g, or t
  misc_feature (102)..(102): n is a, c, g, or t
taanncgagtgcatcatgggaagtgtggacggtcaaggtgagccgagattgcgccattgcactccagcctgtgcaacaagagcctgtgcaacaagagcgatnactccatctcaaaaaaaaaagagagtttcacaattgtttgcccagtgtacaggtt

SEQ ID NO: 484972 - DNA, 700 bp, Homo sapiens
  misc_feature (700)..(700): n is a, c, g, or t
cccttgacggagcccactcgattatttgagcggcgctaggcccctcgtgcgggacatggccatgctcagggtccagccagaggcccaagccaaggtggatgtggttcgtgaagacctctgtaccaagacagataacctgctcgggagctatatccccaagaagatttctgagctggatgcatttgtaaaggagccagctctgaatgaagccaacttgagcaatatgaaggacccattggacatgccactgcctgatccagtcaaggtgaaagagaaagacgagcgtaagaaacagcacgagaaggaagacaaggatggaataagggggaggatgaagacaaaggtcctacatgcggcccggtgtactgccatgaaatgatcgtggtccttctggatcgctagaagcctgagatcaatgatgtgattgagcagataaacctggtcactacctgctagcagttgcagatacctggtatagaggatggcaacaactttcgagaggctgagcaagagaaggtgtttgagctgatgaccagtctatacaccatgctagaaggattacacactcagatatgtaagtatatctctgagcgtggtgaagcatggactggagcctagccatcccatgtgggtgataatcagtagatggttcagcgagctgttgtaagcagaatacccgggactcggctgatggtctttn

SEQ ID NO: 484973 - DNA, 228 bp, Homo sapiens
ggatttgctggtgcagtacaactaggcttaatagggacatgtgttgtttaacaacagggatatgttctgagaaatgtgttgttaggcaatttcatcattgtgcaaacatcatagggtgtacttacaccaacctagatggtataggcttctacccacctgtaggctgtatggtatagcctattaccctaggctataaacctgtatagcatgctcataaggaaaggttaa

SEQ ID NO: 484974 - DNA, 132 bp, Homo sapiens
  misc_feature (80)..(80): n is a, c, g, or t
cacgctctcgaagcaccagaacgtgcagctgccccgcgaagccaggaggaccagggcctgaccaaggactacggcaactnacccctgcaccggttcaagaaggcggggctccaagaacttccagaacatatt

SEQ ID NO: 484975 - DNA, 176 bp, Homo sapiens
gctgagtcactctagagatcccattgatagcggataggggtatactcctaaggcatcgctccaggtgcatagctgcagcttttctgtgtcttcgcaggacatggtaggtcggatcttggtgtgtctgctgtgaggaaccagcgtcccagtctgtaaaacactgcccatctttcgtc

SEQ ID NO: 484976 - DNA, 145 bp, Homo sapiens
aagtacgagcttcgtcatcctcattgtctccatctacttccctcttcctgagatgcatgctctcccattttctctttactagcagtaggtcgccaaatcattgtcatcctcactgtcatagtcatccatgtcattacagctcttc

SEQ ID NO: 484977 - DNA, 96 bp, Homo sapiens
agcgctcattaaggatgcctaaatcaaaggacttgtttcttcaagctcttctggcagtgattctgacactgaggttgacacaaagttaaagaggaa

SEQ ID NO: 484978 - DNA, 146 bp, Homo sapiens
gcagacttgaacttgaacagatagtcttcaagatgacaaacttgggcggaggcgcaaaatgtggagcctgttaaagacgtctacatgcagagactccagtgcattggaggagttacacagacgtgtttacactgcttgactgcagg

SEQ ID NO: 484979 - DNA, 471 bp, Homo sapiens
aggaaaggctttagaccaacacgccgagtttacagagatcccagtgccgctcctagccactgtctccggtggctcaatcaggtacaacatggcaaaaacttacgatcataccgtgactagatgagttgcattgagaccctgattggtgtgtttcaaaagcatgctgaaaaggaagagtgtaaatactctctttccacgacagagcacctacgcttcatgtatacggacctagctgacttaacagagaacctgtatgaccctgttgaccaagtaccgatgatgaagaaactggacaccatctgcgttgcgtatctagattgccaagaattgactattttatttgatgtgctagctaagggttgacatgaatccatcctgtaggctttaccttcacagacgcgccaccaaagacctcctgatcatgacgttgacacttagcacaataagcatttgaagcagcccctgacctct

SEQ ID NO: 484980 - DNA, 595 bp, Homo sapiens
  misc_feature (22)..(22): n is a, c, g, or t
  misc_feature (26)..(26): n is a, c, g, or t
  misc_feature (28)..(29): n is a, c, g, or t
  misc_feature (32)..(32): n is a, c, g, or t
  misc_feature (366)..(366): n is a, c, g, or t
cggtacctgcgtactgggggtntggngnncanccacacccccaggtgagcatctgatggtttgcagcaacaccgacacccacaggtgagcatctgacagcctggaacagaacccacacgcccaggtgagcatctgacagcctggaacagcagcctgcaccaccaggtgcgcatgtgacagcctggaacggcaccaacacccccaggcgagcatctgacggcctggaacagcacccacacccccaggtgagcatctgacagcctggaacaacacccatacccacaggtgagcatctgacggagcagcaccgacaaccccaggtgagcatctgagagcctggaacagcacccacaaccccaggtgagnatctgacagcctggaagagcaccccacatcaccgggtgagcatctgacagaaaattaacaaagatattcaggacctgaactcagctctggatcaagtggacctgatagatatctacagaactctccatcccaaaacaacagaatatacattcttctcatcacatggcactctaaaatgatcacataattggaagtaaacacccccgcataagtgggaccgagctcgatt

SEQ ID NO: 484981 - DNA, 485 bp, Homo sapiens
tcgctgttcaatctagcacaatcaaatgaaaatacaatagtccccgcttgtctgaaggagatgcgtccaagaccccagcggatgctgaaaccccagacagtaccaaaccctatatatactatgttttctcctatacatacatacctacgataaagtttaatttacaggctgggcgtggtggctcatgcctgtaatcccagcactttgggaggccgaagcgggtagatcacctgaggtcaggcgttcgaaacctgcctggccaacatggtgaaaccccatctcttctaaaaatacaaaaattagctgggcgtgttggtacgcacctgtaatcccagctacttgggaggctgaggcaggataatcacttgaacctgggaggcagaggttgcagtgggccgagaccacgccattgcactccagcctgggcaacaagagcgaaactctatctcaaaaaaaatgaatcagcaaggtaacttcttgcatta

SEQ ID NO: 484982 - DNA, 705 bp, Homo sapiens
  misc_feature (538)..(538): n is a, c, g, or t
  misc_feature (595)..(595): n is a, c, g, or t
  misc_feature (601)..(601): n is a, c, g, or t
  misc_feature (640)..(640): n is a, c, g, or t
  misc_feature (648)..(648): n is a, c, g, or t
  misc_feature (657)..(657): n is a, c, g, or t
  misc_feature (660)..(660): n is a, c, g, or t
  misc_feature (665)..(665): n is a, c, g, or t
gcaccttcaccccgaggtgggcatctggcagcataaaacagcacccctactggcagatgagcatatgacagcctggaacagcacccacacccacaggtgagcatctgacagcctggagcagcacccacacccccaggtgagcatctgacagcctggaacagcacccacacccccaggtgagcattgaggaacagcaccccacgcccccaggtgagcatctgacagtctggaacagcaccccacacccctagatgagcatctgacagcctggagcagaaccccacacccccaggtgagcatcggagagtctggagcagcacccacatcccaaggtgagcatctgacaacctggagcagcacccacacctcgaggtgagcatctgtcctcccggagcaggacccatacctccaggcgagcatctgaacccatggagcagcacacacgcccccaggcgagcatctgaccgaacggagcagcaccgacaaccccaggtgagcatctgagagcctggaacagcacccacaaccccaggtgagnatctgacagcctggaagagcaccccacatcaccgggtgagcatctgacagcctggancagcanccataccctcaggtaagcatctgacagactggaacagcncccacacncccaggtgngcntctgncagctgctcagcctgcctgctgctagccggaccagctcat

SEQ ID NO: 484983 - DNA, 874 bp, Homo sapiens
cggccctgcaggcggtatgcgtaccccgtcgttaccctcttgctcttcccgacgcgtgagttaggccagtaatgccttgcgtgtgctctcagaccccaagctggttgcccggcgtgatagcgaaatcgtccgcggcctctcaaggttagcactactttgctccacacggtgctcacttctcgcatggtggtccccttgtgatgtgacccataggtatggtcttctagtgcgatcccgtgggttcaggcatgacccattctccttgtgtgtgggccttctcgcatccaccagaccctctgtgctccgccggattatcgttcgtataccggctgctcctggaagaaggggtgggcccagtgtgttctctaccggtgaggtcatttgggtgacagccgtacaatgacctgcgagatgagaaaagtgtgccatcccgccagaggggctgtcttccaagttactcggactccgaagtttggggcaattatcacacgttaagtgacaatggtgtcgtgcacagcagagtagctactagtctgctgtgcagggcgtgagagcttgctcccgagaactatatcgacggaaggcatgttctatgtgaacaaattctttacagtcagactgcctcttaggagaggtaactgtttcgaaatacttctggggcgatctgtgtctgaaagtcctgtttgcaaagacaagacgaaggataaggagaataattctcgtagggtgtcctctatcgcgagcaattaatctgatgaacataagcttaattcagtgacaactgaatcagcttcctggcaggcggatctgccatgggatcgtatgcagaatttggggtcaatatatgaccgaggtgtgaaccagaccgtatggg

SEQ ID NO: 484984 - DNA, 865 bp, Homo sapiens
  misc_feature (22)..(22): n is a, c, g, or t
  misc_feature (26)..(26): n is a, c, g, or t
  misc_feature (28)..(29): n is a, c, g, or t
  misc_feature (32)..(32): n is a, c, g, or t
  misc_feature (698)..(698): n is a, c, g, or t
  misc_feature (755)..(755): n is a, c, g, or t
  misc_feature (761)..(761): n is a, c, g, or t
  misc_feature (800)..(800): n is a, c, g, or t
  misc_feature (808)..(808): n is a, c, g, or t
  misc_feature (817)..(817): n is a, c, g, or t
  misc_feature (820)..(820): n is a, c, g, or t
  misc_feature (825)..(825): n is a, c, g, or t
cggtacctgcgtactgggggtntggngnncanccacacccccaggtgagcatctgatggtttgcagcaacaccgacacccacaggtgagcatctgacagcctggaacagaacccacacgcccaggtgagcatctgacagcctggaacagcagcctgcaccaccaggtgcgcatgtgacagcctggaacggcaccaacacccccaggcgagcatctgacggcctggaacagcacccacacccccaggtgagcatctgacagcctggaacaacacccatacccacaggtgagcatctgacatcgtggagcagcaccccacacccacaggtgagcatctgacagcctggagcagcacccacacccccaggtgagcatctgacagcctggaacagcacccacacccccaggtgagcattgaaatctgattgtctggagcatcacacacaaccacaggtgagcatcggagagtctggagcagcacccacatcccaaggtgagcatctgacaacctggagcagcacccacacctcgaggtgagcatctgtcctcccggagcaggacccatacctccaggcgagcatctgaacccatggagcagcacacacgcccccaggcgagcatctgaccgaacggagcagcaccgacaaccccaggtgagcatctgagagcctggaacagcacccacaaccccaggtgagnatctgacagcctggaagagcaccccacatcaccgggtgagcatctgacagcctggancagcanccataccctcaggtaagcatctgacagactggaacagcncccacacncccaggtgngcntctgncagctgctcagcctgcctgctgctagccggaccagctcat

SEQ ID NO: 484985 - DNA, 448 bp, Homo sapiens
caggactctgtgggctggagagctgagcctgaaattggagaaggagaagagccgggtgatgtaactgtgaagaagagttggcagctgagagaaagagaggcttgcatgactgaggcccaggttgatgaagcagttatcatagtttgacatcgaaagggaactactgagagcaaaactgaaccgagaagagaaccggaccataaccctgaaagaagaaatggaaagtgtaaagaagattgtgaaggaactagaggcttcccaccagcacagtagccctgatgagcaatttaagaaaccagtaacccgtgtccaaaggcacagcaaatgagcctctcatgctaatgtctgtgttttgccaaacagagggttttctagcagaaagaacccatgtgagccacatagtctagatgacaaacactgggctgcctggtcctagcaatcctgctta

SEQ ID NO: 484986 - DNA, 652 bp, Homo sapiens
  misc_feature (22)..(22): n is a, c, g, or t
  misc_feature (26)..(26): n is a, c, g, or t
  misc_feature (28)..(29): n is a, c, g, or t
  misc_feature (32)..(32): n is a, c, g, or t
  misc_feature (485)..(485): n is a, c, g, or t
  misc_feature (542)..(542): n is a, c, g, or t
  misc_feature (548)..(548): n is a, c, g, or t
  misc_feature (587)..(587): n is a, c, g, or t
  misc_feature (595)..(595): n is a, c, g, or t
  misc_feature (604)..(604): n is a, c, g, or t
  misc_feature (607)..(607): n is a, c, g, or t
  misc_feature (612)..(612): n is a, c, g, or t
cggtacctgcgtactgggggtntggngnncanccacacccccaggtgagcatctgatggtttgcagcaacaccgacacccacaggtgagcatctgacagcctggaacagaacccacacgcccaggtgagcatctgacagcctggaacagcagcctgcaccaccaggtgcgcatgtgacagcctggaacggcaccaacacccccaggcgagcatctgacggcctggaacagcacccacacccccaggtgagcatctgacagcctggaacaacacccatacccacaggtgagcatctgacatcgtggagcagcaccccacacccacaggtgagcatctgacagcctggagcagcacccacacccccaggtgagcatctgacagcctggaacagcacccacacccccaggtgagcattgaggagcagcaccgacaaccccaggtgagcatctgagagcctggaacagcacccacaaccccaggtgagnatctgacagcctggaagagcaccccacatcaccgggtgagcatctgacagcctggancagcanccataccctcaggtaagcatctgacagactggaacagcncccacacncccaggtgngcntctgncagctgctcagcctgcctgctgctagccggaccagctcat

SEQ ID NO: 484987 - DNA, 735 bp, Homo sapiens
  misc_feature (22)..(22): n is a, c, g, or t
  misc_feature (26)..(26): n is a, c, g, or t
  misc_feature (28)..(29): n is a, c, g, or t
  misc_feature (32)..(32): n is a, c, g, or t
  misc_feature (568)..(568): n is a, c, g, or t
  misc_feature (625)..(625): n is a, c, g, or t
  misc_feature (631)..(631): n is a, c, g, or t
  misc_feature (670)..(670): n is a, c, g, or t
  misc_feature (678)..(678): n is a, c, g, or t
  misc_feature (687)..(687): n is a, c, g, or t
  misc_feature (690)..(690): n is a, c, g, or t
  misc_feature (695)..(695): n is a, c, g, or t
cggtacctgcgtactgggggtntggngnncanccacacccccaggtgagcatctgatggtttgcagcaacaccgacacccacaggtgagcatctgacagcctggaacagaacccacacgcccaggtgagcatctgacagcctggaacagcagcctgcaccaccaggtgcgcatgtgacagcctggaacggcaccaacacccccaggcgagcatctgacggcctggaacagcacccacacccccaggtgagcatctgacagcctggaacaacacccatacccacaggtgagcatctgacatcgtggagcagcaccccacacaggtgagcatcggagagtctggagcagcacccacatcccaaggtgagcatctgacaacctggagcagcacccacacctcgaggtgagcatctgtcctcccggagcaggacccatacctccaggcgagcatctgaacccatggagcagcacacacgcccccaggcgagcatctgaccgaacggagcagcaccgacaaccccaggtgagcatctgagagcctggaacagcacccacaaccccaggtgagnatctgacagcctggaagagcaccccacatcaccgggtgagcatctgacagcctggancagcanccataccctcaggtaagcatctgacagactggaacagcncccacacncccaggtgngcntctgncagctgctcagcctgcctgctgctagccggaccagctcat

SEQ ID NO: 484988 - DNA, 499 bp, Homo sapiens
  misc_feature (27)..(27): n is a, c, g, or t
  misc_feature (49)..(49): n is a, c, g, or t
  misc_feature (58)..(58): n is a, c, g, or t
  misc_feature (200)..(200): n is a, c, g, or t
  misc_feature (283)..(283): n is a, c, g, or t
  misc_feature (299)..(299): n is a, c, g, or t
  misc_feature (430)..(430): n is a, c, g, or t
cccaaccgtttaaactgttgcttgcanaatccagcagggcttgaacgtncggttatcnctatcacccgcatcttcttcgctcgccatcgctattttcgcttcgtccggtgattaatacatccatgttgacgatggcgtcacttactggtttcagcgtgaagctgtcgttaacggcaggcgttcctgtaaacgtcaactcncagacccatcaaatgccactttaccgttggcaatccggcgtcaccgtaaaagtggtattgcgtggcaaggcgggtgacctgtncacacgagattattancgaacgagattttgtaatctgtcgccagtaccgcggaggcatcagttaccgtggcaccgatcgcaacgtcacctttgtttttcgtgttttgcagaaccgcgggcttaccgatagcaaagaaatcttcgacngcatcgccgttagcatcaaatccggctttgtgttgggtgttgaaagcctcggcaaatgccagcgccgag

SEQ ID NO: 484989 - DNA, 118 bp, Homo sapiens
tgtttcttgttaatttacttgctgggcttcggcctttaggttctgtcaatcgtttttagcttacctcaaaggcgggcaatcgggttttccctatatcaggggatacccctgtgaaacc

SEQ ID NO: 484990 - DNA, 271 bp, Homo sapiens
catctgtcagacgcaaagagcgtgggatcacgtttcgatgagtgtgctgcccctttcacgatcaacagaactactgacaacgtaggccgcgcctgcctttcccatctgtctatctatctggctggcagggaaggaaagaacttgcatgtcggtgaaggacgaagtggggtggacgaagtggggtgggacgacagtgaaatctagagtaaaaccaagctggcccacggtgtcctgcaggctgtaatgcagtttaatcagagtgccatttata

SEQ ID NO: 484991 - DNA, 467 bp, Homo sapiens
taggagcttagagaaaatacaagttagcgtatcctacaggttcatccgtgtgttgcaaatgacagaatttatttcttttttagaggctgaatagtactccattgtgtatatgtaccatgctatctttatccattcatccatcaatggacacttaggtcattccatatcttgactattgtgaataaagccgcaatgaacacgagaatgcaactgtctattctacgtactaatttcaattgctttggatatatacccagaaatggaactgacagataatatggtagtcctatttttattttgcaagggacctcgatatcgttttccataatggctgcactaatttatattcccattagcaatgtataagagtttcctttttgtgatgaatatgttaagtagtttgatttaatcattccacattgtatacctttatcaaaaaatcaccttgtgctccaaagcctgttagg

SEQ ID NO: 484992 - DNA, 264 bp, Homo sapiens
gtgtggtagtatctgctttccgctatatacgccgttttttcttggcaaggggttggagctggaggagtctgcaataacatgcaagagtagcggagattcagcatagtgcaatgacttgcagaagtgtagaggatatgactgatggttggtgactgttaaaacccttgcgaggtatctcaggtggaggagtatacagggctgtgtgtgacacagaagagacggcaggcacctgatgggcactggtaacactgccctggagcgctg

SEQ ID NO: 484993 - DNA, 1084 bp, Homo sapiens
  misc_feature (1)..(1): n is a, c, g, or t
  misc_feature (67)..(67): n is a, c, g, or t
  misc_feature (77)..(77): n is a, c, g, or t
  misc_feature (106)..(106): n is a, c, g, or t
  misc_feature (115)..(116): n is a, c, g, or t
  misc_feature (122)..(122): n is a, c, g, or t
  misc_feature (146)..(146): n is a, c, g, or t
  misc_feature (169)..(169): n is a, c, g, or t
  misc_feature (174)..(174): n is a, c, g, or t
  misc_feature (188)..(188): n is a, c, g, or t
  misc_feature (197)..(197): n is a, c, g, or t
  misc_feature (214)..(214): n is a, c, g, or t
  misc_feature (222)..(222): n is a, c, g, or t
  misc_feature (242)..(242): n is a, c, g, or t
  misc_feature (300)..(300): n is a, c, g, or t
  misc_feature (389)..(389): n is a, c, g, or t
  misc_feature (392)..(393): n is a, c, g, or t
  misc_feature (396)..(396): n is a, c, g, or t
  misc_feature (404)..(406): n is a, c, g, or t
  misc_feature (477)..(477): n is a, c, g, or t
  misc_feature (650)..(650): n is a, c, g, or t
  misc_feature (800)..(800): n is a, c, g, or t
  misc_feature (926)..(926): n is a, c, g, or t
  misc_feature (948)..(949): n is a, c, g, or t
  misc_feature (996)..(996): n is a, c, g, or t
  misc_feature (1000)..(1000): n is a, c, g, or t
  misc_feature (1076)..(1076): n is a, c, g, or t
naggcataatctcataatatgatattttcacccctcgtgtcttttttagctctactcccattagtcnagaggaagcnagccaagtgttcactgatggagggacagngtgtggtannctcatnttacggaacattccattatatgtnttatacaggaaggtaatcctgtnacctnacacaacatggatnatccttgangacattatgctaagtgnaataagcnagttactaaaaagacaagtnactgtttgattcctcttatatgagatactgagaatagtcaaaaccagagagacagagngctgaatggtggctgcgggggctgggaggtgtgggaattactgtttaatgggtacagtttccatttttcaagctgagaagcctatgganttnntcngcggtttnnntttcatagctttttgaatgttttaacagtcaacgttactgaactgtgcacttaaaaatggtgaagacagtntgttttatgagtgttttacgacaatttaaaaattaaaagaaaaaaaaccagaacacactaagggttataggcacaaattctccttatgcccaccaccatctcagctggtagtatgacgggtgtagacaccattagaggcaatggtgaatctatggggaccacccaggaaagtnaccatccaaatgtccacatccctgcttggcaattaaaacgaagacacttttcttcagcacctggtgaagatgtttagtttctagtgctttccaagatccacctcaggagaagtcaatttgtccacaggaagcgtagtttccaaagctgtntacggtgaacctctgagagatgtgaattgaattcagctttagggagccaaagtagaagttctcaaacaactttaaaatatttcggccatcaaatgattctctttccttgaagatatatttgccttncgctgtgtagagattgtacctnnaaaaagcattggggtctttcctgaatagtgtattcataactgtagcntgcngtgtcacactattccactctttcactattagtccagatgcctgaaaccgttccgccctcgatcactaattcttgtngctgtggg

SEQ ID NO: 484994 - DNA, 126 bp, Homo sapiens
tctctgctcctgggattaagcgcattgagaaattgagatcattagagtggaaaacctatacccaataaaatgtccccaatgaagtaactagcttgaagagtattggtcaaaggacacaaccaaaac

SEQ ID NO: 484995 - DNA, 117 bp, Homo sapiens
ctagcagatccttagctcagtgatctcccgcctcagcctttggagaagctgggattacaggcacgcaccaccatgcccagctaattcgccatgttgcccaggctattgcccaattcc

SEQ ID NO: 484996 - DNA, 141 bp, Homo sapiens
attagtgttatgtataatggtttctgtatgctattagtgattcagtatgaaatatggtctctgtggttatagaatactcgcatgacacagctgagaggctgtctgttgtattcattgtggtcatagcacctaacaacattg

SEQ ID NO: 484997 - DNA, 325 bp, Homo sapiens
atactaaaatatattaacgcataataaaaagtaacaagtcaaaatataaaacatactgatcaaaatgggactacacatgccattcaaacaccagatggtcatagtcaagaaggaacaactcgctgaacatagggcacaccttccagtgactttcaacatgttcatcaaatttgctctgatcatagaaaggagaaaacattaactcacagaggagacacttcttgtgaacatcagagctggaatcaaagcaaaagcatatcccatgcacacataaatgatgacttggaagatcaggagcagtaggcacaaactcatcttcattagc

SEQ ID NO: 484998 - DNA, 1146 bp, Homo sapiens
agcggggggagcgcggcgcaccgactacgcaggccggagcggcttccccttccctcacgtgctctccgtccgtggtctgcgtcatcacacgccatcctggtggtcccgctgaccttccgtggatctgtcgcactggaagctgccctcgtcggcttcacgacgtcacgcaccacggtggtgacaggcctggcgagcagagctgatctgaccgatggggcccggcactcacggtgcggatggacgagaatagggactgctcatggtgtgtacacgcgggcgtgaccgtgcggtgcgagtgagaaccggtacctggcaccagacgcacctgaggtcggaccattgtgccgcaagagacggatctaggcgtggctacaacttcgcatggcctatggtgttggcattctgatatatgtaccttctccacaaggcccagcgaaagcgggtgtatcgggacatgcaggctaaacatctggattcacaatctggtacacgcggaacaggaagtactgggcttctccacctctgagcacacggatcactgcaccaccacgaaagggcagcggactggtaactctctggtagcaccccacgaagctggcctattccaacaccgcaaacggaacttagaactccgcccacggcagaggactcacgcgtgtcgaacaagggtaggttcaagcgaacggcaattcgtcgcagggacgcaatcctcgctggtggcaacgccatctggacttggtggtcggctaacgcaccacggcgtacggcatacaccacgcgggttagcctgagacaagagccaaagcccataattgggttcccaacgctgggttcccatgggaccgcgttgggtttcacccaaagttttccagcagggccgccgccttgacacttacattgcccacgcacacgaagaccggtctaccaccccaaactgtccacttggcgaccggaccctaggtccccgacgcgaatcccgctaaatttgagcggcttcgcatactacagccaccccatctcccacccggacgccggcaacaacaagtcttaccccccagctccacatccctggtggaccgcaaacctcatggggcgcgggacaccaacccatagaactccggactgatcgacttgggggaaaccagg

SEQ ID NO: 484999 - DNA, 501 bp, Homo sapiens
ctgcacgagagcgccagagcacacatgtggcgagaactacacctataagcgcacaatgtgagaggagaagactcatataaacatatggcggattggacacgtgtgatatcgggcaagtgcaccactatctgggcatctgagactataaaagccgtggcattgacaaaagaaccattggaaaatttgagaaggaagcttgtgagaagggaaagggcttctttaagaatgcctgggtcttggatataaccggaagcttagcgtgaacgcgggattaccattgagatcttcttgtggaaaattgagacccggaagtgctctgtgactatcaatgagggcccaggacacagagactttatcacacgagttccgggacatctcaagctgactgtgctctcctgagatggtgctgctcgggttggcgaatatgaagctgggatcttccttattggccgtggtacacaagggggttcactggacccactatagaccggagattggggg

SEQ ID NO: 485000 - DNA, 362 bp, Homo sapiens
ctgctctcatcatgccccccaggtgtctctgaggtggggagggagcccagagccaggactcccagccccgggcctgtgagggatgtgtagcaatctctgcggcatcaatgagggcagaggcagaggcagatgcatagacatgccatgagcacaaggaggcctcagaacctttcctgagaggacgtgtggtttggtgccgttacacacgtgtcaatccacacattagtcaatgttggccgggcgtggtggctcacacttgtaatcccagcactttgggaggctgaggtagaaggatctcttgagtccaggagttcaagaccagcctggacaacacagtgaggccccatctctacaaaaaaaaa

SEQ ID NO: 485001 - DNA, 218 bp, Homo sapiens
tggatttatagtggcacaagtaagccatgaggttaaagctgttgctaacagtttattgtttcgatgaatggtttaaaataatggtaatagagttatcaacagaaaggccaaattcaagttattgttgagtccatagcaacatgcatttcaaaacatgtccgtttcctgctgaacaaaagtattagatacttgactatagttcagataatttttttggc

SEQ ID NO: 485002 - DNA, 188 bp, Homo sapiens
acctgggtgttaagcagatctgtctcaaaacaaaggccaggtacagtggctcacgcctgtaatcccatcactttgggaggccaaggtgggtggaccatgaggtcaggagtttgagaccagcctgaccaacatggtgaaaccctgtctctacgaaaaatacaaaaattagccggggagtgatgctttga

SEQ ID NO: 485003 - DNA, 257 bp, Homo sapiens
  misc_feature (50)..(50): n is a, c, g, or t
  misc_feature (165)..(165): n is a, c, g, or t
  misc_feature (186)..(186): n is a, c, g, or t
  misc_feature (221)..(221): n is a, c, g, or t
  misc_feature (250)..(250): n is a, c, g, or t
gccatttaatagggggcagtgaatattgaggagcgtcttctgcatgaggncattccatggttcatcgcgtgtgtacttgtagcatctcaccaagctcagctcactagcgattgagtagtcctgtcagactcaacaccatcaggttctgccttcctgtgagctggngggtgatcaagagtaagcgantgttccaattcctggaagactcagcatcctcctcncagcatcccacctccctgctgcagctcantttgtgg

SEQ ID NO: 485004 - DNA, 436 bp, Homo sapiens
  misc_feature (1)..(1): n is a, c, g, or t
  misc_feature (6)..(6): n is a, c, g, or t
  misc_feature (423)..(423): n is a, c, g, or t
  misc_feature (426)..(426): n is a, c, g, or t
  misc_feature (434)..(434): n is a, c, g, or t
natcgnctgacggccaaggttgtcgagttcgccgacgacgatcagcgtcatattgttcggcgcgtaccaggtcttgcgcaccttctccagttgctgctgggtcaggtgcccgacctcaagccgttgcgggcatttcaggcccaagcttcccacccagctgattgctggcggtgtggcccaggtctggcggtcgagaaaacgttgcagacgcgtgtaatggccaccgtcctcgcgctcgaccacgcgtttggcggcgttgatcgcattgtcgtcaatgcgggtctgggtcagcagaccgagcagcaggtcgagcactttgcgctgattcttcgccggggcttcgatgacgaacgtggtgtcggcgttgctggtgaacgcgttccactcaccgcccaacgcctcatgcgctcctcaaggccaccnttnccaagtgngt

SEQ ID NO: 485005 - DNA, 124 bp, Homo sapiens
ttataaaagagtgatgtatcagtaaggtatcaataatcccagcccagtcaaagcaccgccaccggtaggcttctggtctcagggtaataactggggccgggcctcggtaagccggtgtatgtta

SEQ ID NO: 485006 - DNA, 180 bp, Homo sapiens
acaagagaagagacgagtatgggaaagttgctgagacaagaaagcctagtgtgacaactttagtgctagatacaaaattcacgacatgtgaaaggcactggactcatgtgtgtgagactgtggaaatgtcctcagaccatatcagcaccatgcaggactgagctctatctatagtttgat

SEQ ID NO: 485007 - DNA, 278 bp, Homo sapiens
ttaaaagaaaaaagggggctattttcccccttttttcccccccccccccgggggggcaaaagtttttattttaacccctcccctgtgaattttccccaatccacccttggccccttttttaataaaactgttttgttggaaccccgttttttattaaagtctctataatgttgatttttccccgattcccttttccccccttgaaaccccccctttaatttgttccccccttgcctttttttttaatcccatggataaaaaataaattggccttgtta

SEQ ID NO: 485008 - DNA, 143 bp, Homo sapiens
  misc_feature (36)..(36): n is a, c, g, or t
atgaggaacatggtcgtgcaaaatgggcgcggcagntcagcctattcgctgcactaactgtgcccgatgcgtgcccaagggcgaggccattaagaaattcgtcattcgaagacatagtggaggccgcagcagtcagtggacat

SEQ ID NO: 485009 - DNA, 731 bp, Homo sapiens
tgtttggagaacagtctcactctatggctgaggctggagtgcaggggcgcgatctgggctcacggaaaccgtctgccgccggggtttaagcaattctccgtgcctcaacctcccgagtagctgggattacaggcgcatgccatcaagcccagctaatttttggttatctttactagaagagggggtttcaccattctgggctaggcgggctcgttgaacgtccgtgacctcatgatccacccacttgggcctcccaaagtgtgcgtgggatcacagggtgtgagccacccgcgccgggccagcatagtattttctatgttataacggtgaaaaaatgtgaaaacagattatttcgactagcaaattttggaccccagagtttagaaaagatcttttatggcagcccaaaccagtaacttttaaggctcatattatacacgtgattgtggggcggccaacctgagaatgcagaccacacccagtggtgggcggtgcagcaagcaggactgtgcagggagccttccttgcctcacaaggtcttcagagcaagcgcagggttcttcccagtcactggtcaggaaatcatcattctgccagggcacgcagtggtttcttcaaaccatatctttagtaaatggctatgtccagatggtccccgaattattcttcaacaaagtggcgggtatctaaagctggtggttgagccccttagatataataaggtttttcca

SEQ ID NO: 485010 - DNA, 233 bp, Homo sapiens
acgtcagagatacgtcgtcatgcccagccacttcagccgaggctccaagagtgttgccgccggtctctcctaagcctggaggggccgaaaatggtgtaaaaggacctagttggcggtcgctaactgacacctcagtgacaaagatatctggacagaatcgcctgacaggtgcagctgccatcaagatgcattagatcaaaccatgtctgggttaataatttgtcctcattcta

SEQ ID NO: 485011 - DNA, 831 bp, Homo sapiens
ggaagtttaggagttgaggaaagaagattaaagagcgcgaggagacaaataaaaagaagtgttaagaattgcctttgggactctgaaggctgaagaattgatgaattgcaagtttgtgccccatagctgcacagactgcctgaagttacatttagagactgaaatcactgcaccttaaaaacaaaagatgagctgcactgtattcctggaaagcacctaccaaggcttcctattacctatttcacagcataagcctacagggtacgaagaatgaactctgagaatgttggagaatgtttcatcattactaacaggatatccctcatgacattgctgtctgattcagaggatacatgtgcaggcttgttacctgggtatatgtgtgatgctgaggttggggtatgtatgatcccatcacccaagtactgagcatgtactgaacagttagttggtaagtgtaggagtgtgtagagatggagtctcattttgtcacccaggctggattgcagtggtgcaatctgggtcactgaactcgtcccccggtcaagtgattctggtgcattagctccaagtagctgggattaccgatgcgcgcatcataccagtaattgtattttagtagagacggtttcccagttgtccatggtgttcaattctgctcaggtgacacttcctgctccaagtcgggtcgatggagaccggccggcttaaaatggttccgccatttggaaaggtgggcagggacacacttgactggacctggacaaaggttgggagtaccggaaacgtttaaagcgggggaatcccacgggttagagagaccttttttca

SEQ ID NO: 485012 - DNA, 391 bp, Homo sapiens
  misc_feature (15)..(15): n is a, c, g, or t
gtatcggcggaattncaggctggagtgcagtagcatgatctcagctcactgcaacctggccctcctgggttcaagcgattctcctccctcagcctcctgaatagctggtattacaggtgcccaacagcacacctggctaattgttgtattttgagtagagatggggtttcttcatgttggccaggctggtctcgtactcctgacctcaggtgattcccccacctcagcctccaaaagtgctaggattacaggcgtgaaccactgcgcccagtcggaagtaatagttattaaccaatgtgatggccgggtgtagggacctcgcctgaattcccagcactttgggaggccaaggagggaggattgttggagaccaagagttttgagaccaacc

SEQ ID NO: 485013 - DNA, 253 bp, Homo sapiens
tcttctcctgacacaaaagaatattacttattgcaaaccaaaaccacaatgagataccacttcacgcctactcaaatggctataatgaaaaagacagacgttaacaagtgttgatgaggatatggaaaaactggaaccctcacacagtgctcgtgggaataaaatggtatagcaatgttggaaaagtgcctgacggctcctcaaacaattaaacacagttaccatatgacccagcaattccatctctaaaata

SEQ ID NO: 485014 - DNA, 166 bp, Homo sapiens
cagagtggtcttgatggggtttggatccttttgctctcaccacaaagatggcacagtctttatgtttttgaagactccttaaaattattttatgtctgactcccctgatgaaagttggatgcttctattgtcaccccaaagatattaaagtctttataagtcttca

SEQ ID NO: 485015 - DNA, 198 bp, Homo sapiens
atagataaggtcttgctactttgcccagaccggtcttgaactcctggcctcaagagatcctcctgcctctgactcccaaagtgctgggattacaggtgtgagccaagcactcagcctcgtcttcttgtacagtacagttatagttgcttagaatgtgtcatcctcaatatgatgaaatacctaacaatttatcattgg

SEQ ID NO: 485016 - DNA, 337 bp, Homo sapiens
tggcgtagaatacgttgatcctacaatcccactctctcggtatccaaaataattgagagcaggctctttgcatatccattgttccatagcagcattattcataatagccaagaggtgaaaggaacccaaatgtccatagacagatgaatggattaacaaaatgtggtgtatatatacaatggaatattattcagtttttttactgtagctttttttttggtctttttttttttgttttttttgagatggagtctcgctctgttgcccaggccggaatgcagtggcacaatctcagctcaccgaaacctccgcctcctgggttcaagcgataatcttg

SEQ ID NO: 485017 - DNA, 1067 bp, Homo sapiens
ggcgcgcacttggccccgacccccggcagcggctgtgcgtgcagcctcttcgtcctccgcgcggcgtgcacttgctcccggcccctgcgccgggcggcggcggggcagcgcgcaggcgcggccggattccgggcagtgacgcgacggcgggccgcgcggcgcatttccgcctctggcgaatggctcgtctgtagtgcacgccgcgggcccagctgcgaccccggcccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggccctccgcctgcgctgtcctttctcatcccatctttgaaatcgtgccccaacactgcgagctcagatctgccgagtgaacgaactctggcagtgctccgtggggagaaatctccttcgggtggaggggcgaaaggcatgcgggttttcggacaggtggaaccggacctttcggaaggtgcccaattggatttttcgacctcatcgacacctgggctgtttctactctgtcccagagattacacgattcgtccaacagtcgggagaagcacactaagtaatttcaaccgcacattattttcccccgattc

SEQ ID NO: 485018 - DNA, 633 bp, Homo sapiens
ggcgcgcacttggccccgacccccggcagcggctgtgcgtgcagcctcttcgtcctccgcgcggcgtgcacttgctcccggcccctgcgccgggcggcggcggggcagcgcgcaggcgcggccggattccgggcagtgacgcgacggcgggccgcgcggcgcatttccgcctctggcgaatggctcgtctgtagtgcacgccgcgggcccagctgcgaccccggcccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggccttccgagcgggagctcaggtgagcccatggaaattccagtacctgcccagatacagacgatcgtccaccggattgcaggaagaaagcgtaagaaggacactcatgagacctctcaagagccatcattgacggaa

SEQ ID NO: 485019 - DNA, 105 bp, Homo sapiens
aatgtaaaaagaacaccatgaacagagtgaaagacactttaagttacaacatcatttttatgtgagcattagtaattctggccttctagatcgcgagcggccgct

SEQ ID NO: 485020 - DNA, 109 bp, Homo sapiens
cgagtctctcccatcagtctgctgctctgcagcctcattatcccatttgttagtagctgggcctggagtcccacacaggttagaaccacccagggggaatgttatgttg

SEQ ID NO: 485021 - DNA, 950 bp, Homo sapiens
gggtgcgtgcacatgtgtgagcggtatgtgtgcccaggtgtatgagtgtgtggataggtgcatgtgtgggatgtgtgcatggagtgtctgcacatgtgtgagtgtgtgtgcgcccacgtggatgagtgtgtggatgggtgtgtgtgggctgtgcatggggtgtgtgcacatgtgtaactagatgtatgatgtagtacatgtgcacatgtgctgcgtgtcactgtatccacattatgtgagtttagtgtgcacagaggctactgcctccacagtgtgtcttttcccacatgcgtcagccgtgaacctgccagagactcacagattccaccgcgtctggccggcgggacttactagtctttatctgctggtattaatgagtatgactccttataagagaacacatctttcttatttgtgccaagtgtgtagtatgggcacctgctgtgaaccccaccaggggtcacttacaccaaggtcgtcccttcccgccttcccatccgtgtatccctgtggctaaggtttcacttccaggtcagcaggggatatgacagctgtcctgtctctagtgattgagtcgtaagctgggggtgaacaggaagacacatatatcactggagtcggactcccaaagagtgcaggggaacacagggctcaacacgaggcggctctaacgcaccgcgcagggacaacacccgtcataccccacggggtttccaggaacgaccggcccgacggaacaagggcagatgccgcatgaagaccgcagcgaaccacgagacgtgccaatggaaggcaacggcccccacgacaaccccacacgcccccccacccatagcagagacaagcccaagcactacgggaggtgacacaaccacacagacaaagagcacaccaacgaaaagggaaaacgagaaccgcgaacacgcaccaacacagccacgcgaacacac

SEQ ID NO: 485022 - DNA, 557 bp, Homo sapiens
  misc_feature (332)..(332): n is a, c, g, or t
tggtatagcctcctgagattggatgaaaggcaaaaattaggaaatcttggagggagtcctcaagttgtattgctttgctgtgcttttggaagaagggacgacctggaggacacaggctcatgtgtgggtcttcatcctgcctgaccggcagatcttcctctacaccttggttaaagggggggcgaagatggtttcttagctctccatttgccatgattttcctcccattcatcatgagggagtttctcaaaccaggagtttatatttattttttagccccagtctctgcacctgggattcagctcaaggattcagcgtcttcatttttacanaagttcccccaagaaatcagcaaccagcctctgtttcatctgggagcccctcccttgcccccctgggtttgggggtgctgccctactgggaacagcagggttaatgcacccgtttgtagccgaccccccttagtggaaatcagggaaagcctccctttcttggccttcccttagtcaattaacatttcaaaggcatatgtcctcatgccgactgccatttacaca

SEQ ID NO: 485023 - DNA, 442 bp, Homo sapiens
cgtgtggtggagtactttgttctggatccctgttgatgtggatgttatgatgggaacgtttacagagagttttgctgcttctgcaggatatattgcaggcaacaaggagccgacagactacctgcgaacacattctcatagcgcagtgcatgccgcgtcattgccaccttctgtagcgcagcagatcattacctccatgtagagcatccatgcgtacgatggcaccagcctcgctatagagtgcttccaccagctagctgctctcacccctcctttcagcacactcctcgcccacatgccctctatcacctactctgaccactctttagcactgcctatgatgctctacatccctgcctcttgtcctcttcgcacgtcacgatgcttcatcgtcccactgttatcgactctgatactttctctcccccctcctctttcctcg

SEQ ID NO: 485024 - DNA, 245 bp, Homo sapiens
aacagacagaaggattaaaggatggaaaatacagcccaggcctagccaatggtttggacaacaagtccgtgaagacctggagcgactaaaaaaaattcgggcccataaagggctgggtcacttttggggcctttgtgtccaaggccagcacaccaaaacccctggcccccgtggccgccccgtgggtgtgtccaaaaaaaaataagtctgtaggccttgtctgttaataaatagtttatatccca

SEQ ID NO: 485025 - DNA, 470 bp, Homo sapiens
  misc_feature (135)..(135): n is a, c, g, or t
  misc_feature (419)..(419): n is a, c, g, or t
aacactggaccactcgaaagatgggcattgacagcggaagggggcacacttgggcctagggaggggctcgaagttcgcgggtcatcaggaaacttctggggcctatccccagaaagcctcatctttctagcatanaagtcaaaataagccctctcctgttggaaacgggtccaagccccaggaaaacctttgtgcaagcaagaagggagggatgattaggtggccctttcattgatttaattcttcaatgtaattttctcccaaaccaagggaaaccctttttaaatccttggaattttggccaccagggagcccctcaaaagcttaagatggtaatttccacttaaatatttcagccccaaggtaaaaagagttttgcaggtggtggaaaaggagggaggggggtagggtgctgctcntgtgactaggttgaaaaacctcctggctttctactcccatagcacagttta

SEQ ID NO: 485026 - DNA, 525 bp, Homo sapiens
  misc_feature (91)..(91): n is a, c, g, or t
atccggccaggggaaggattaaagggcatccaattgggaggaagggaggtcaaactatccctgtttgcccaatgacatgattctatatctngaaaaccccatagtctaggcacaaaagctccttaagataacaaaaaaaaaactttagcaaaatttcatgatacaaaattaatgtgcagaaatcacttagtattgttataaaccaacgacagccaagacgaaagtcaaatcaggaaggcagtctcattcacaattgctaaaaaaaggataaaatacccaggaatacagctaaccatggaggtgaaagatttctacaagtagaactacaaagcactgctcaaagaaatcagagatgatacaaacaaatggaaaaacattccatgctcatggatagaaagaaccaatgtcattaaactggccatactgatcaaagcaatttacagattcaatgctattcctgtcaaaccacctatgacattcttcacagaactagaagaataaactattaaaagttcgtataaagtt

SEQ ID NO: 485027 - DNA, 596 bp, Homo sapiens
ttaagctgcaggagcttttattttattttatttttccatatcccagtggcacctggaacgccagcgagacagaactgttcactcccctggaaagggggcctgaagccagggagccaagtggtctggctcggcggttcccacccccatggagcccaggaaagtaagatccactggtttgaaattctcgcttccagcacagcagcaatctgagatccacctgggacggtggcgcttggtagggggaggggcgtccgccgttgctgaggcttgagcaggcggttttaccaccacagtgtaagcaaagctgctgggaagttcaaactgggtggagcccattgcagctcagcaaggctgccgtgttcagactgcgagattgctcctccctggacagggcatctctgtaaaaaaggcagcagcccagtcaggcttggaacagacttaaacgtcccttgcttgagggctctgaaaacagaacggattctcccaaaaaagaatgcgaaccttgttaaggcccaacttgcttcttaagggggatccttgacccttgggataatggactggaagacacctccaatttgggctggcaggaacactaa

SEQ ID NO: 485028 - DNA, 383 bp, Homo sapiens
gattcggaacgagggttttgctcttgttgcccaggctggagtgcaaaggcgtgatctcggctcactgcaacctccgcctcccggattcaagcgattctcctgcctcggcctcccaagtagctgggattacaggcgcccaccaccatgcctagctaatttttctgtatggggtttcaccatgttggccaggctggtctcgaactcctgacctcaggtgatccacctgccttggcctcccgaagtgctgggattgcaggcatgggccagcgtgccggctgcatacagtaaaatttaacttagttgacttaaggattttgatttcccgtttctttttttttttttttagatgggagtttttgccctgttcaattcagggctgagat

SEQ ID NO: 485029 - DNA, 971 bp, Homo sapiens
cggaaagagatgtcggcgttttacaaaggcggatggatgctccccggttgaagacgaataatccgtggcaccccggtgtaaacaggagtgttcttgggaagcaccaaacttttctactgggctaccattctactatggggaacccgagcaaccagtgccaatcagttctccgagcaaaccgcctgtgtgcgaggacacaccaccatatgggcggttgccaaacaaccgttgtctaaactctggattatggaagcgctccctcctgtgtgcgtttatataaagatcttgggtagagacgccaccccccgggtggcaaaaaacgtagtctggtgtataacaccctcttgcgaaactcccaggtggtggactttggttacccccccctccaaaaaggaatatcttcagtagtaacaaaggttccccgcgcccccccccacatgtctaggtgcaaaaaattggtaagagatagaatccttcacaagctaagtatgcaggcacagaggagcgcttcatacgcagcaagctcacgcagcttcaagaaacatggcccagtaactctccgtccgcgtgagttatgtacttacagaacgacagtagacaaagctatggccgttactataggggccgcacgccattacttatgggggtaaaagattgtcgattccgcagcgccgacccgatgtacttacgagagtcgcctgtgatcctgaggtccgcacaacagtacttctccccaagtctatgttcggcagtcactaaatgtttcccccacccactagatgtgtcctccgcggcgaagccatttcaaagaaaagaggtgcggttcatatttctggccactccccgtaaagggggaagactggttatgggctacttgcggcgttcgtcctatgggtgatgaccaccacggggcccagagaggatgtagccataaaaacagctcaaattggaacgcccaaacaaagacaaca

SEQ ID NO: 485030 - DNA, 120 bp, Homo sapiens
cattggataagcggatgaggagaggcaggaagaagaggtataaggtgagatcacatacatagataggcccggaagaagaaatgttcctgttttcaaaatccctcatccgcttatccaatg

SEQ ID NO: 485031 - DNA, 251 bp, Homo sapiens
tgagacagtctcactgtgtcacccaggctggaggtgcagtgatgtgacctcctctcactgtggcccctgcctcccaggatcaagcggttctcatgtctcagctactcgggagactgaggctggaggatcgcttgagcccaggaggttaagtctctagtgagatgtgttcatgccactgcactccagcctcggctatagagtaagaccctgcctcaaaaaaacaaaacaaaacaagacaagagccagtcgac

SEQ ID NO: 485032 - DNA, 265 bp, Homo sapiens
taagcgcctggcgcttgctatacttatgcctcataggtgatacgtacaagggaatgggtaggctaggtgtttgtcagggggtagagaatagagtgtgagcgcgtattataccatagccgcctagtaataagagtactgcggcaagtactattgacccagcgatgggggcttcgagatgggccgtcgcggagtccatcaagtggcagtcccgtaaagcagggtatctttcactatacaaagctcatttgagtccagctcagtccat

SEQ ID NO: 485033 - DNA, 1369 bp, Homo sapiens
  misc_feature (625)..(625): n is a, c, g, or t
  misc_feature (815)..(815): n is a, c, g, or t
ggtgataacgggtggtggtggcgcgtggtggggggtgggtggttgcgcttggcgtagtgggggccggcgaggggcccgccgcgtggccctggttggtgccggcgcccttccgctgggggcttctcgcgcccggggtgcgaagttgtggcgcgatatgacaacccttttcccgctcccgaggggggtggttgcgacacacgggtgtgttgtccctgtgtatcgcacgccaggtgttgcagctaaagggggccccacgggtgtgctggttgttggtggtgccaccgccgcttgtttgagggagtgtgccgttgtgtaattcccgggggagggttgaaccagggttccgccctggggtggagtggaggcgagccgtcgtactaggcaggcccccggttgtggccgccggtggtggtcgggtcgccctagatgctctgagtccgccaggccctttggttcaagcccctttcttggggggccctattgtttgggggaggagtgggccttgcccacgggagattggggcccaaggctttctggtttgggctacgggagagagccgttcctggggggcacccgtctttcttggggaacgttgattgtccgcgcccccgtgcggagtgtgccnctaatatgagagggaaaaaggtgtctggagattctgtcacgggtggggagagaggttatggggcccaccaggcgcccacatggagggcgacccacgctggggaaagcaccacgcgtcccacacagtgtcacagagcacgcgtgtggcgcctctatagagagagaggagaataccccacttgacacacagngcccaaaatgcaacattgtccctctctcggaggttttgagaggaggcccctcgacccacaaccccacacacgcgtgggggcactgtctcggttggttggctcggtgtgtcttgagagtgtgtttcgtgttatgaggagtttatagtgttgaggtgttccacgccttgggtgttttcgggagagaaaagagaagaaatgcttacacccaagtgtttgtgaatgttatagggcgaagagcccccgcacacagttggaggtatattatagagagaagcctttgtcgtttcacacaggcacggtgtctctcgggggcttcacagggctataggagaggagaggggaggcctcgcgcgcttttatagcacgatccccacgtcacacacatgcggctcacaagtcacctcacagaaggcttttcgcactttcacagggctaatgttggtgcccttgtttacctcctaaaccaccacagctgtttgtggtttcacacacataatgttgtaaattttccttggttttttttaaaggaatgataataaagttacttgctttta

SEQ ID NO: 485034 - DNA, 415 bp, Homo sapiens
  misc_feature (16)..(16): n is a, c, g, or t
  misc_feature (36)..(36): n is a, c, g, or t
  misc_feature (40)..(40): n is a, c, g, or t
  misc_feature (56)..(56): n is a, c, g, or t
  misc_feature (202)..(202): n is a, c, g, or t
  misc_feature (317)..(317): n is a, c, g, or t
  misc_feature (361)..(361): n is a, c, g, or t
  misc_feature (371)..(371): n is a, c, g, or t
  misc_feature (412)..(412): n is a, c, g, or t
ggcacgagagcaaatnccaaacaaatgcacttcagngcangcagggaggcgcatcnacaagtaacttctgtttctgctaatccaatcctcccctgccgcccctactggttaaatgtgtttaactgttttaccaatgttggaattagccaaccccaccaccacagtaaataaataagaggaccacactttatcgaatataaanttgtttttattgaaggcagcagtcacatgaccttatatctaggcctttaggattagggcctgacagagtgaggccaggccctgaaaaagatgatgtttctttgttggcactaggnggacattaacatgttttacattacatgcatccagtattgggganttgaggcggnctccaaacacaactgtgttgggttaccgggggtagggtacnggc

SEQ ID NO: 485035 - DNA, 111 bp, Homo sapiens
aagccacggtacaacccacaagccacggtacaacccacaagccacggtacaacccacaagccacggtcaacggggaatacctactaagagtacgaactggcaggcgtagca

SEQ ID NO: 485036 - DNA, 610 bp, Homo sapiens
attttggggtatgtcttggccaaattgaaaaggacccaattatttgccccatggaaattcacctctttggtttgaagggtttcccacgggcgcctcggtttggttcaaaaaatgatggaccaggctttttgagccataaaagagaatttcatgcccaaatatttctccctgcatgttaggaagagtaaccgggccgccctgcacttttattccaacaccctcaatttttagatcagtgaagtggagcccaaatattatgcaaatggggaggacgcctatgccattaagggggacttcattcaaatggccgacgagtttaggcggcacctggagtttaaaaaaaagggcaggcacgtggtgttgggtgccattgaaaacaaggtggagagcaaaggcaatttccctccgagttcaggaaaggccttttgcgaggaaaagggcctggcttcccaggatagtggtggggacagcaaggccctcagcgaggtcagggagaccccaaagagcacaaatgtcaaggacagttcaaaggcctccgattcagcctcctagagcctgccccatcccctcctccccccccgagtttttccaataaatttgctccgtggca

SEQ ID NO: 485037 - DNA, 288 bp, Homo sapiens
cgcgttgaatggctggtctgaacagagttcacacagtctagctggtactggggtcaggagacgtgagctacttcacatctttggtcataggtatatcttgaggtacttgattctgtttgtgacctctctctcgctctctctcacgatatgtcttctgaccgtttgtttctatttctgcatttactgggtctaaacactgtacaaaggttaaaaacaacactccaatgggcgtttcccaagagggtggggtacagtttctgaactcacttgtaggtgtgtatttctttc

SEQ ID NO: 485038 - DNA, 305 bp, Homo sapiens
  misc_feature (28)..(30): n is a, c, g, or t
  misc_feature (40)..(40): n is a, c, g, or t
  misc_feature (43)..(43): n is a, c, g, or t
  misc_feature (50)..(50): n is a, c, g, or t
  misc_feature (59)..(59): n is a, c, g, or t
  misc_feature (81)..(82): n is a, c, g, or t
  misc_feature (84)..(84): n is a, c, g, or t
  misc_feature (92)..(92): n is a, c, g, or t
  misc_feature (102)..(103): n is a, c, g, or t
  misc_feature (135)..(135): n is a, c, g, or t
  misc_feature (149)..(150): n is a, c, g, or t
  misc_feature (165)..(165): n is a, c, g, or t
  misc_feature (186)..(186): n is a, c, g, or t
  misc_feature (211)..(211): n is a, c, g, or t
  misc_feature (266)..(266): n is a, c, g, or t
  misc_feature (291)..(291): n is a, c, g, or t
aaaaaaaaaaaaaaaccccccccccccnnnaaaaaaaaanaangtgtttnaaaaaattnaatttaaacccctggcaaaggnnanaaaaaaantttgtaaaannaactgtaaaaaattttgtggttgttgtaatgnactaatgtaataannttttaaaattaaganaatgtaagaaaataagctatnataaagtggtggcttgttttggaantgaataattttggtatgtaattttaccttttgtgtttttcatatagttgcctttnaaataatgtatataaagcctcaaanggtttcagcattct

SEQ ID NO: 485039 - DNA, 783 bp, Homo sapiens
taaagaagaatagctaagtcgaggcccccgtgtttattcggacatggggtcggccgctgacgtatggatgagaccggtgcgactcatgaaggagttcgtcaccctgcagtgatacccgacgagtggtagggtcgcgctcgcccgtggcgtgagactgtgagtgtggaggcagtgggactcggatgagcccatccctgccaaggagctagagcgaggtgtggctgtggggcccactggcctgctctgcctcctctccgaccacgtggacaagagtgatcctggatgctgcagtgggccaatctcacaatgtcatcagcaccatgtcttgtgtggcatcgaccacttggctttggatgaaatcaagaagcgtggtgatcctgagtttggctacaccccagatgtcctgacagataccacctgccgaactcgcagtctccctgctacttaccacctgccgcctggttgccgtgaggccatcgaggaagtgaagaatggtggctggacctcggttggaagcccctcttggctgtgtggctatgtgactcacgcagagcactgtcggcatcatcgtggctggggcagcataggccaggccattgcgtcgtgcgtctgaaaccattcgagtgtccagagatttcgtgtacacagggcggccagcccaggcctgaggaaacagcggaattccaggcaaagtatgtgtatacccatgagctggtgcccaatatgattacatcgtcgtggctgtccttaacacttcaacgagggatcataagatgatctccg

SEQ ID NO: 485040 - DNA, 112 bp, Homo sapiens
  misc_feature (78)..(79): n is a, c, g, or t
gggggggttttttttttttggggttttttttcccccgggggggggggggcccccccccctttgtttttcctttttttnnggccgaaaaaaaaaccccctattttttttttta

SEQ ID NO: 485041 - DNA, 341 bp, Homo sapiens
  misc_feature (214)..(214): n is a, c, g, or t
  misc_feature (262)..(262): n is a, c, g, or t
  misc_feature (266)..(266): n is a, c, g, or t
  misc_feature (285)..(285): n is a, c, g, or t
  misc_feature (298)..(298): n is a, c, g, or t
  misc_feature (330)..(331): n is a, c, g, or t
ggggggggtttaacctttttttttcccggtttttatttggggataaaggggggcccttttttgggaagcgggttttaaaaaatttttaaaaaaaaaatttaaaaaggaaaaggtttccagggttttttgggttatttccttgtttcccccgggggaaaaaaaagaagggttcccggtttttgaaaaaaaaaaaattttttttttttttaggggngggggccggggtttttttttggggccctccccaaggggggaaaatggnaaantttttttttttgggggaanggttagggggtgnttttaaaaactttaaaaaaaaattttttttcnnggggaaagga

SEQ ID NO: 485042 - DNA, 140 bp, Homo sapiens
acgtcgagcattgctgacaatctcatcaaaagtgatattcccactgtgattaatgtttttctgtttcttggcggtctcttggagttccttgagggctgtgatgatcagggcagaggcagaaggcaccacctcaatctggg

SEQ ID NO: 485043 - DNA, 856 bp, Homo sapiens
gaaaactccaggtatgtagtgaatgcatgatggtatggcacaccaaataccatgtggttttcatactccccctctctcccatcctgatgtctagcgcgtaatgattaacttgcgttatgataaattagttgcgtgtacaaagctgagggaaccggaaggaaagtgctaggtgttttcaggaactaaggtggcggggggacgaatttctcttcctcacatgaggttactgtttctttcctctggtgggggcattggatcctcccacagtatgccctggtgattggaacttgagggcttcccatctgtgtacatcccactttgaatccttgatcgtgacaagaaataccttaggccttcagtcaattccgaagctccttcagttgtatttataatgggcgtcttcacagtgcacatatgtgtatgcatgtatacgcccgatacagactatgcgaggacacagactccgtactccattagctaacataccctccctctccagaacccctgtcacatacctttcaggaggtgacagtgtgtctaagttgtcatctaccagacaaacgtctgggcccgtcctccctcctgatactgtggcctcttggtaccagggtgagtgggaggagaacaaagagatgagacatccagaggggtggggggaaaagactgtatctctctgactcatgcctttatggatattgaaagacttgatcctggtgcttaaacagacagattagtggggtgaggtttagaagtggtagccaaagctgtgtctggtgggttcattaggaggattctttaataaagtgggctcggggacagggaaagagggatatattaggagagcgaaaaattgtta

SEQ ID NO: 485044 - DNA, 486 bp, Homo sapiens
ggtaggttgtacgtgtggaggctcacaagatgtcttctcaggaggaagtcttacgagctacatgaagtatatactagggacatagggagatgttaaaaaaaaaaaaaaaagtaaaaattccaaacttggagccacaaatatgagagactttatgtaaaaggtagggtctgggcccgttgcaggggctcacacctttaatcccagcacttggagaggcgggagacggggcggatcgctggagcccaggagttggaggccatcccgggcaacatgagaaaccggtctctacaaacaaacaagcaaacaagcaaacaaacagtttttagtataaaagagtattggtccacgggggaaaatcgggaaaacacacacaaataaaaagaggaaaaattatccgtaatccttctttctacccagaagtgagagcacggttatttggctgatcatatataatcgtatttaatttatagtacaaccggccggtgg

SEQ ID NO: 485045 - DNA, 341 bp, Homo sapiens
  misc_feature (152)..(152): n is a, c, g, or t
  misc_feature (282)..(282): n is a, c, g, or t
agcgcgtgatcagctgtcggattggatcgacagaaactttggaagctgtctgttttgcgtctttggcggcgtctgccttatttgcggctaccgcgtcgcgggcctcttgatggacagcggcgaactcagcattacgggcgacgaaagcctgngattcttcggccatggccaggggcgacaacaacagggaagacaggacgaagacgctggcaatacccatactgttggacatttgaaactaccttcttgcggtgcaagtgctaatgaggacgggggtaaagntagccctttcaatgcaacttgaacagagcgaagtgcgataagcactgttgcgcaaaagg

SEQ ID NO: 485046 - DNA, 460 bp, Homo sapiens
gacactgataggcctcctgcgtggaggtttgcagtaagccagacgacctgtgggtcccagggagagacgggctgctccatggatgctcctgggacctgaggcactgggtggacctcaacagagtaatgagctggtccgattctcgagtttcctactcaagaactcctgatgaagcagattcctgtgggtgacaagtgtcagaagatagaataggaccttagggtcaggaaggatttcttgaacaaaaaaggggaaaaacagattgagagattcagaaagctgtaatatattctgtgacctcaaaggtgacttggaggagggctgtttttcaacgacgggcgtgtagtgaacactgggggcatttaaacggttcagatgctgaatttaatgttatatgtgttttactacaattggtaaaaagaaaaaaaaagtccacgcggccggagtttagtagttgtta

SEQ ID NO: 485047 - DNA, 194 bp, Homo sapiens
tccagtaatgtgtgccgatgtcttacccgaatgggatctcttcaccacacggccaatttatcacaaacccttctctaaacccttacaataggcaggaaactgctcatacccctacgacggctgatggcagaggataaaatattaattctaagaaaataggccgggcgtggtggcacacacctgtaatcctagca

SEQ ID NO: 485048 - DNA, 241 bp, Homo sapiens
cctatctatggacattctaccacctacgcagagatccaagttgctagtacagcagacatggttgtgaagagccctgacagggaagatccataaataacgtccaggggatcagatgacgttgacctagagacttgctcatcttccggccgtgagcatctcgcacgatggcatgaaggtaagacctctctaaagggcagcctgcccgtgagcttcaggcccagcatgaccatccgggccaccc

SEQ ID NO: 485049 - DNA, 191 bp, Homo sapiens
cctacagttaagagtctgaatcctggacgaggggacatatgggacttccggatcctgctccgaggccttcctgggcttgctgtcccccagggagccagctggctgtacgacagccgtgggctcccaactcctccagtggtccctgctgttgcttgtacttcgggggctgctgtgagcctattgcagtccca

SEQ ID NO: 485050 - DNA, 352 bp, Homo sapiens
ccttgtaaggagagatattcgccacatagcgtagctttccatccttcacatatgtgttaaatggaattcattggctccttggtgccaatctccatttaagcatttgtccaccaaggtatttctacattcatatcctcttatagagttcaccttcagaggaatctcatgaaagggggaaatgtagtgaccagtcacattcttaaagaagagccggtaattctgaacgcaggcctgcccgcgctccacatgtgtggcacaggcccatagcacggcgcgacgcgtgtccgtgcactgtgtccccaaccgcaggcacacagcgtctggcgcacccgtgcacaacagccacaacacc

SEQ ID NO: 485051 - DNA, 916 bp, Homo sapiens
cgggcgtctccattttggtctcagtgcgtggactcggcaagaaccagcgcaagagggaagcagagttatagctaccccggccgtcggagccggctcactgcactacccccgcccccttctttcctccagacgccgaagtcgcagggcgctcatggtcgggcctggaggtactgttcgcatcggcagcgcctggcctatcacctgcaggcaggacgcgctcgtctgcttcttgcattgggaagtggtgacacatcggttacttcggcttgggtgtcggtgaccagccgggtcccaatgataaggaatgtcagaactgctgccagctgggtggaacaacaagtgaatgacctgtattgtcctccggtatgagtataacggatgggtccacgaaagctccttgtgaaaggccatcaccgtggagagcagcatgatcctcaatgtgcgtggaatatggctcacagcaaagtggcagacttgaccctgaacttggatcgattatcatcgatgcagaacacctgggtgacttccacgaggacctacaagaacaagtgaggacgcttcggtctccgtattgtcgtctggcaatcagtcacgacctatccatgagcagtgcggaacaggctaatgtaagcaggtcccccaccgggaggttcccccctgctaccgccagagaggtggacccactccggattcctccatgccatccacacaccagtcggcagcctcgcctggtgtgatcccctgggcccgtgtgatgtccggggagaagactttgaccctttttgggcctcggcgcagagttggcatgacttgtggatccctgagatctggcttccccaagagccccttattgacccttcctcagggctccgaacggattcctccaggcgctgtgcccccggggctcggttggccc

SEQ ID NO: 485052 - DNA, 446 bp, Homo sapiens
gcctcatgcagcccattatcatttgttatttgggtttaaaaaaaattttgacatcttttccctcaaacccaaaaaaagtcagaactggggttatttactgttgatttcatcctcctggggatgaaaaaacaagcctagaggaatgaactaggggtactgaactgtttaaattatttttgggttaataggaccctttgaggatttttttccccattaaaaactttttgaattataaaagttttccttacattatttaacaatggaccctgttaaaaataaaaataaaaattcaaactttggggggttttcagcagccgttaattggacattttgccctaactttggggggtgggctttttgtaagattgggctttggggttcagtttgttacctttggagacttatttaatgaaacccttcaaataaacccaacttggttttgttga

SEQ ID NO: 485053 - DNA, 353 bp, Homo sapiens
ctggaagaaaggcgataatatttctttccgatggtgtctcccaagtgtgggtgctgttgggtttttataaggttgtgaaaaggaagatgcacatatcttcattctccactggtgtgcatggaaatgtgtgcgagtgtggatgtataataaatcgagtaatatcgaatgaggtggcttgtgaaatactgcagtgttggatgcttcacgaggtattatcctattttattagcacacatttgctagctcattagagttaatctttatagaaaggacaccgtataggttcgtaataaatatttacaggacgcacaatagatctattactactttaacgactattatcccttctccag

SEQ ID NO: 485054 - DNA, 733 bp, Homo sapiens
gccggcgtgtgaaggaagcatggcgagactgcgatagtatgacttcgaagaatggtactgccctgctgttcctggaggacctccaccattcgcccatcaccgatcatcagtgtggcgtcactgttctttcagagctgcgacctatcgaatcacaggctgcggcacgcctactctacctgaccaacattcagacgatgggcgcaagcttgttggacaacaccattccaatgctacacacgtactgacgacccacagatacgttatcctctgcgaagagccaccacagtcacacggcacaggacagcgacccaagagtcacacacacagacaacgctagataaggcacacaagacgctaggaacgccgtcgagcctatgacagcactgcatgcatacaacgagtgacatcattcacatgagcaccaacacgattacgacgtgtatggcgcaacgagacacgagcatattacatttacaaagaattgagaactcattatagcacttacgtgacattgatgatgaggacaagtacatgtaacagagtcagacagtgcatacaaggcaaagtaagatgatagaaataggcacacttgcaaacacacacaacaagaaacaacacagacagacaaagcacaaagagaaacacacaagaaaacacacaaaaagaacaaaacacagcaccacaaccacagagacaaagaaacacaccaaagacaaagagaacaccaacagca

SEQ ID NO: 485055 - DNA, 678 bp, Homo sapiens
  misc_feature (417)..(417): n is a, c, g, or t
  misc_feature (450)..(450): n is a, c, g, or t
  misc_feature (460)..(460): n is a, c, g, or t
  misc_feature (543)..(543): n is a, c, g, or t
ctcgtgccgattcggcacgaggaagattatatcccgcgcctggcttgaagggtcctacgtacacggagcttcgctcattgctagcacagcagtctgagatcaaactgcaaggcggcagcgaggctggggaaggggtgcccgcccttgctgaggcttgagtaggtaaacaaagcagctgggaagctcgaaatgggtggagcccagcgcagctcaaggaggcctgcctgcctctgtagactccacctctcggggcagggcatagccgaacaaaaggcagcagaaacctctgcagacttaaatgtccctgtctgacagctttgaagagagtagtggttctcccagcatggaccttgagatctgagaatggacagactgcctcctcaagtgggtccctgacccccgagtagcctaactggngaggcacccccagtaggggcagactgacacctnacatgggcgngtactcctctgagacaaaactttccagagaacaatcaggcagcaacattggcttgttagcaatattcgctggtctgcagcctncactgccgatacccaggcaaacagggtctggagtggacctccggcaaactcaaacggccctgcagctgagggtcctgacttgtagaatgaaaactaacaaacagaaagggacgtggcacccaaagatgggggaaa

SEQ ID NO: 485056 - DNA, 175 bp, Homo sapiens
cctggctctgaacttagttactaatagtgagaggagctggtccagtgcctaaagcaaagagtataacaagacggtagaaagatgcagagctaacagaagtgtcaattttgtctgtctctgtctatgaaaatgacctttagtactgcaaagcttaggaacacatcctatagttcag

SEQ ID NO: 485057 - DNA, 218 bp, Homo sapiens
ctggtggtgtagcctcatgtactgcgtgagtctgtccaggctgcatgatgggtcagcccttccttggggctcggatggaacagttgtatgcgcaggaacctgacagcctctgcttcgtaatccaccccgactcggttcagggcgatgttgatggtgacggtggaggcatcatggtgtggctacgagaacgtgccgactattgacatccacatgaacca

SEQ ID NO: 485058 - DNA, 280 bp, Homo sapiens
tcgcaatgctgaaaacacactcaaaatccctatcatgactttttacagcacaataaaacccagcttccacctttttcccatccccagggattctgatacagctctttggggatggatgaggcctgggcaactcttaataacctctccaggtgatacagatgtgtaggcaagagggagggccaaaagaaaaaaatatcagctaatacctagcaggagaagcagtcaatttaatgcgatgatccagttatcactcagtgtatgaaaagagcagctcatcgta

SEQ ID NO: 485059 - DNA, 353 bp, Homo sapiens
tggatgcctccattaagtgaaacaagcctttgctgaattggagagctttttaatggatcgagaagtggcgttgcttgctgaaatggacaaagtgaaagctgaagcaatggaaattttgctcagccgacagcagcaattggttgagctcagagctgatatcaagcactttgttagtgaacgtaaatatgatgaagatctgggacgagtagcccggttcacctgtgatgtagagaccctgaagagcattgattcatttggaccagtgtcttaatccaagaacaggtattcgaccagattccgatggagcttaagtacatctggggtcttgagtaggccagtgggctctggttgtt

SEQ ID NO: 485060 - DNA, 480 bp, Homo sapiens
  misc_feature (369)..(369): n is a, c, g, or t
  misc_feature (382)..(382): n is a, c, g, or t
ttattgctaggctggagtctgggatgcagaatatgagtattcatacgaagacagcaggggctatgcaggtggtctgagctcggctatgggggctcacaagcccgcggctcagctacagtctgggctccagctttggctctggggcgggctccaggtccttcaggcggaccaggtgctccaggggccgggtttgtgatgaagatcgagacacgtgatgggaagctggtgtctgagtcctatgacgtcctgcccaagtgaacagctgcggtagcccctcccagcctacccctcctgcgctgccccagagcctgggaaggaggccgctatgcagggtagcactgggaacaggagacccacctgaggctcagncctagccctcagnccacctggggagtttactacctggggaccccccttgcccatgcctccaggtacaaaacaattcaattggtttttttttggggtccaaaataaaacctc

SEQ ID NO: 485061 - DNA, 302 bp, Homo sapiens
cagcagcagaggtaaaggttgccctaaagagacgtaatgaaacaaggatgtgaacgatcattattagcacgccccagggacacagacgagatgagcatggaaacacagccattgtatgtgcagttgtgggcacaggtgaggccgcagaggaactgcatagctaaagtgaaggccttcaggagaaggcgtgactgggtgtatcatggtcataagataggttgtgcataggaatggtgcccgtgagcatgctgttcatggcaatcatgcgtatgggcatgcaggtctctgaaattattattatg

SEQ ID NO: 485062 - DNA, 908 bp, Homo sapiens
tatccacataaataccaaaaagaggaaatgcatgcacacaagatggggcaaagacagggactgaggaacgacacagaggacacatgtactatctgtggtctatattaagaggaaggtgaagatgtgagacgtcttccatgtatgcaccttttccaccaagtgtgtgtggaccacatggtgtgatataccaaataagaagtgccccatatgcagagtgcacattgaggcccaagcgtgccaagttgaaaagtgtggccaccatgtttcagaaatctgggcctccctctcattcccatccttcctggtactgaagtcaaccaaaagatggcatgactttacctgcgcaagatttgtggaagcatgtgaacttacgagtggtggctcgtgttatatggtaacaataatgtagacctacagtttatgtatacagttgatttggatgtatcaataaaagctttaagatctaagatgtgacatttttctgtatcatttcacttgtatttttgcatggtccttgtatggcatttcttgtgaccatattatgggtgtgtgaccccttaagcttgcagggcacggttagatgcttagtacgtagaatatagtggccttttagtattttcacatagtaccacgccttactaattatgactttataatccaattactaccttaaattacatcactccatgaacttcaggtcactgtaaaaggtcttaaaaatggaacaattggttaagaaattcgtatagcaaacggcgcgaatatacaaatgacgcggagtacagaccctcaatggaagacatacattataaatagggggacctacacaggggcaaacaatctggagtcctctttcacggacaacgatagcacataggggggcgtattcacacacaacctcatggtgg

SEQ ID NO: 485063 - DNA, 368 bp, Homo sapiens
ctcaagagtcaatgttctctctattacactgtttccctcactttataaatcagctttggaaaatgcaagttcaaagtcaaacagatctctgacgcagttacaaaataaatctaaattaaatgtctaaaaatacacagcacactagaaataccaatatgcattcagaaaacatcatgaaagatacgtagaatttttagcagggattaactctgggatttagggaggtaagacatgtctaatttgggggtagggacagcttcaaataatttgaagtgattatttaaggaattggagttagtttgttgttttttaattttgtggtttgtttttgttttgtttgttttaagacagagtctcgctccatcaca

SEQ ID NO: 485064 - DNA, 421 bp, Homo sapiens
aaccctcccactagcccagttaatccaggagacctgtagatacccagactacaatggggctggagtggcaggggaaacaggccggacagggcccacgaatcctgccaccactcctcactgtggtgtgatctatggcagcctcagccctgatgagggcaatgaggtcctggtatgatcaggaagacgaatcgcaaggctggacgatactgggtgggagaaaaaggtggcttaagacagaggtggcaccaaggaccaagttggtgtaactgactcagcacgcctaggtctcatcctggacttcctgcctcctccccagctcatctccagcagagagttggtcgctgaggcgccaatttggagccagagagcaacggccgaccatcgatgtagatgggccgtcgaccctcattggcaatgaaga

SEQ ID NO: 485065 - DNA, 190 bp, Homo sapiens
gaataaatgattgaatgaagatataataaataaaagctataattatagataacttttattagaattttttttagcaatattcccccccccccccccctgttttgcttttaatgtttttttcctttgggggggaaagtataccctggactaaaaaattgtccttcaataaatacgttttgagggctgtcca

SEQ ID NO: 485066 - DNA, 1198 bp, Homo sapiens
  misc_feature (617)..(617): n is a, c, g, or t
gcatagctcaatgaagtgcccacgtgagcagccgagacaggcatgatgaacactgctgctggatatgtaacaagtctagcgtcccaagagagcacgctgggataaggtgcagctcatggcagcggaacgcaggggttaaggccgaggttgagtgagctgcggtagccgaatccgggcacatcggaggagagggcatcgaatgggagagcaagaagatcgcggatgaggatgccctgcaggcgcattcggcaggctagaggagcaagatatgaatcgacctgctagcgcaaagcatgaggtgccacacattgcatgagcgcaggaggctctgttctcagagatggatgtgacgaggtctaggcgtttagatgtgacatgcaaggaagcagatacggtgccgggatgcctacagaagatttgctgggtaacatagtgatgagtgccagattttaatggtacatggtcaagtagcggattaatggccaaagcgagattgctctaagcttgattgatggtgatggagaacggatgcagttcgggacgtagcaagggctaccttggcacctccaaggatttccaatgggtggagacttgccctacgtatggtgtgaacttgntgtcaatcaaatgctgggcacgggaagaatgggtacgtctgacgtacatatagtcgacagttcgcactattcgggggaggctaatgggcagcaaacttgcatgcttgactgacgatagccgatatagccttatagagcctccctcgatgaacgttgcacacactcaaaagggggaggacaaggggtcttggttggaggacaaagcgcccttggacgccaagtcgggggtcccggatagaggagacattctagaaatgcgttgatacccggtttggagcaccgcatacgggttcgcaaagcgaacattccgtgaggttgcctcggaagtagaagcaattcccgaaggcgtctcttttgttggccatagtttgccaattgaaaggagatgccccgaggggggacctttgcccctcggttaggaatcgcaagacaagacaagattggcctggatgagaggccttctctcaccacgagatgtgggggcctaccaattcggataggaggagaaccactttctacaatagaggaggcagatagcaggagagaccggcacacaggcacgttggcaacgcgaggtcaca

SEQ ID NO: 485067 - DNA, 296 bp, Homo sapiens
cttctgtctatagtggcgtcatcctgggaattacagacaatttaacaagagattgggtttatattctctatggccaaaggttgcactgaagtactgtaaggacttttcccatgctaaacagctctttgctgcttgttatggagttggtacacacgacgttctcaccgaacggcttcgtacagggtcatgctgacatgagactgttgccttttggactacttcctaccccaccgacagcctggggaccacggggcacggcacggacgacgacgacccggccactcccgaccgctata

SEQ ID NO: 485068 - DNA, 324 bp, Homo sapiens
gatagcaggatgcatttatcttatccttcccaatcgtgatggccagttcgctgattattttaattaactttgcaatattgtctactgatggtttaattagcaagcattttacatttgggaacaatattcccgaatcttgctgacgcgcagcaaatttttactccggtgatgaatggctcagtcaatattatggcaatattgattacctttctcgttgcacgcaatatcgcgattagcttccagcaggacgatctgctgtgcggactaacggccattggcgccttttttgtggtctatacaccttataccatcatcgatggtcag

SEQ ID NO: 485069 - DNA, 311 bp, Homo sapiens
  misc_feature (6)..(6): n is a, c, g, or t
  misc_feature (15)..(15): n is a, c, g, or t
  misc_feature (183)..(183): n is a, c, g, or t
  misc_feature (189)..(189): n is a, c, g, or t
  misc_feature (240)..(240): n is a, c, g, or t
  misc_feature (255)..(255): n is a, c, g, or t
tcgccngtttggctnggccctaaacttgcccttctcccctgctgtcgccacttattgttgtgaggctgtggccatatccgcctgtgtcccatcctcctcctcctcggccttctgcactgcatctgccctgccctcccactgtctcctctccatggtgcctccgcttgggctgaagcctgtttntcctcntcactctttccttgccctccccttcactgtgggccccttagcccgtatccntctcgccatttcgcngcccactttcctctggctgcctcgggctcctcattatcaagatagggtccatggga

SEQ ID NO: 485070 - DNA, 176 bp, Homo sapiens
cccaagggctgggggcttttttaaaaaaaaaaaaaaaggggggtggccttttttttttttagaaaggtagaattggtttttcccaaagtttatgtgggggttgattcccccctcctcccttgggtgggacctgggttgggggtttgatagaaaaattaaccccgctttttgttcca

SEQ ID NO: 485071 - DNA, 174 bp, Homo sapiens
aggtgggcgagaagcaaagacggagattggagcgcatgttagggtgcgtggagtggaaggcaatggtgccatactaaactgcagaaatactaaagggcatggactacagcgactccgcgacggagccttgcctgggtgagggagtctctgggacgcagggggctcctgtagctt

SEQ ID NO: 485072 - DNA, 940 bp, Homo sapiens
  misc_feature (348)..(348): n is a, c, g, or t
  misc_feature (444)..(444): n is a, c, g, or t
ggctcgggctaagactatttggggtagcctaagtatctcttctatatcccctggcatgttcttttttgcgctgtcacaaatgccctattacttgaatcatcctgggataggagagaagcttggggacagcatgtagcacagtgctgagcccaggattgagatgttttcaaagtgaacgaactatgtagctaggaaaaggagcacgtgtgtttgtcagcagggttggtaggttgagagtattttctctttggccgaaaccatcagtccatactgatacttgatttgtgctatgccttagatatgaacgatggagtggtcaggatagccatggatgccattccaaagttngtgatttgaattttcataaatcatattttaaccaaagcattactacttaaaggaatcttagggtgaaccctatgaatccttcagtgcgcttggatntgatatttggggtccatttaaaatggagtacctgtatgtatttggattcagctttaacttggagataatcccgagtcatgctttaaagaagttccttctgagatcaggagctcaggtgtttggtgaactctgggaaaactagacactcccctttacctgtatatagttctccttcgtgggctcctgggtactgggggacctgggtacgattggaggcaatttacgaggctggctcctcaatatttggcgtcctccaggcccaaggctctagactttcgttggtgggtccccggccagggttctctccgttactacgcaaagttggggtaggcggcgcggcgcacactggttttcacttgtgctcacgctctgcgcgcattcacagcggggggtatgttccggcgccctatgttttccagtgccccaaaaccggggttccaggggtctcgggcccacataggaggccggcgccactgggccgcggagcgtttctccg

SEQ ID NO: 485073 - DNA, 534 bp, Homo sapiens
cggacgcgtgggtcgcccagactccgccatacatagggacagacctagttcaatgaatctgaggaggctactcagtagacagtcccaccctcacacgattcttgagctttcacttcatcttgcccttcattattgcagccctagcagactccagctcctattcttgacgaaacgggatcaaacaactttctaggaatcacctcccattccgataaaatcaccttccaacctttactacaacaaatcaagaggacgccctcggggtttacgttgccttctttccctgtctctcgcttaatggacattgaacactattgctcgaccaggaagctcctagggcgagccagacaaattatacccgtagccaagcccttaaaatactccctccccgacatccaagcccgaagtgatattatcctataacgctacaccaattctccgatccgtccctaaacaaactaggaggcgtccttggccctattaactatccatcctcatcctaggcaataatccgccattctccatatatccaaa

SEQ ID NO: 485074 - DNA, 228 bp, Homo sapiens
agaatgaagtctactttctgctgtgagaggtggacggagacaggaacaaaggacgcttggatctctgactgtcctctctgccgccgcgtcctctctgcttcttgtgtttgtgtgcctccttggtccttaccagcaaacgcgcaagggtgccgggtgccgggggcacggaaagtccgagggtggagggttgagcgttgagcgacgtctgtgctccttgccccctgacga

SEQ ID NO: 485075 - DNA, 659 bp, Homo sapiens
  misc_feature (34)..(34): n is a, c, g, or t
  misc_feature (79)..(79): n is a, c, g, or t
  misc_feature (83)..(84): n is a, c, g, or t
  misc_feature (103)..(103): n is a, c, g, or t
  misc_feature (110)..(110): n is a, c, g, or t
  misc_feature (184)..(184): n is a, c, g, or t
  misc_feature (222)..(222): n is a, c, g, or t
  misc_feature (244)..(244): n is a, c, g, or t
  misc_feature (246)..(248): n is a, c, g, or t
  misc_feature (284)..(284): n is a, c, g, or t
  misc_feature (289)..(289): n is a, c, g, or t
  misc_feature (299)..(299): n is a, c, g, or t
  misc_feature (309)..(309): n is a, c, g, or t
  misc_feature (318)..(318): n is a, c, g, or t
  misc_feature (326)..(326): n is a, c, g, or t
  misc_feature (344)..(346): n is a, c, g, or t
  misc_feature (353)..(353): n is a, c, g, or t
  misc_feature (357)..(357): n is a, c, g, or t
  misc_feature (366)..(366): n is a, c, g, or t
  misc_feature (396)..(396): n is a, c, g, or t
  misc_feature (404)..(404): n is a, c, g, or t
  misc_feature (417)..(417): n is a, c, g, or t
  misc_feature (452)..(452): n is a, c, g, or t
  misc_feature (464)..(464): n is a, c, g, or t
  misc_feature (470)..(470): n is a, c, g, or t
  misc_feature (474)..(474): n is a, c, g, or t
  misc_feature (479)..(479): n is a, c, g, or t
  misc_feature (488)..(489): n is a, c, g, or t
  misc_feature (493)..(493): n is a, c, g, or t
  misc_feature (500)..(500): n is a, c, g, or t
  misc_feature (503)..(503): n is a, c, g, or t
  misc_feature (506)..(506): n is a, c, g, or t
  misc_feature (513)..(513): n is a, c, g, or t
  misc_feature (522)..(522): n is a, c, g, or t
  misc_feature (525)..(526): n is a, c, g, or t
  misc_feature (528)..(528): n is a, c, g, or t
  misc_feature (536)..(536): n is a, c, g, or t
  misc_feature (582)..(583): n is a, c, g, or t
  misc_feature (632)..(632): n is a, c, g, or t
ggggaggcggtgatgtggaaaaaaagtaaaaagngcacaagaaactgcagcaggttggtgctcacagtggatctgaggnatgnncgtacatagaaggaccttngccatgncccctgaccaacccctgtgcaccaaacaccacactgagctcagaatccgggcagagagggaaccactggtacantgaggccaaggcacacgcagccgggcctgccgactcgngcccagcagggaccattaggtntnnngaggaggcagctgagggcgacaggatttgcacagancagtnaggggcagtngacgcagggnccagatggntctcccangtcaggtgagcccagatnnnttctttncagntcctctggngggtgggttggggggagtagctcaccaggnccaggagnagcccatcctggnggcaaagcctatcccaaaacctggccctgcctctncctgaggtgacnttgagnccgnaaaantgaagcccnnaggntgacacntgntanccggaanctgttcctngtnntnagaggggnctcggtttctcccggggcatatgggcaggaaggccctcgggatctnncatcagttccacggccgcggtgcggtcgtcacctgtgatcacggctgcntggtgccccctgccggccccacctcag

SEQ ID NO: 485076 - DNA, 219 bp, Homo sapiens
atcgatacgacttttttttataacaactggattttatatttgggaaaggaagggaaaaataattttattcccaaaagagatggcgcagaaagaaaagaaattctcaccccttagaaaagttattagttttgggtggcgaatttctggtttaaggatggcttcgttcccctctgaaaacgtagctcatcctgactggccaaccccttctgtcgtcttctc

SEQ ID NO: 485077 - DNA, 305 bp, Homo sapiens
  misc_feature (242)..(242): n is a, c, g, or t
gctggaccaatggtcggtggcccaaaaagagctgctgaatttgtgctgcacatgcttaaaacgcggagggtaatgctgaacttaagggtttagagtgtagaattctcgtggtcattgagacatatccaatgtgaatcaaagcacctaacgatgcgccgccgtgacctacaggagctcatggctcggattaaacccagtacatgagactctcccgtgccgacattgaggaggatccgttacgngaaaatggaacaggattgttccttaaacctagaagagtgagggttgcccatttgcgataatag

SEQ ID NO: 485078 - DNA, 131 bp, Homo sapiens
  misc_feature (107)..(107): n is a, c, g, or t
taataaggctaggcccacagttcctctttctcttgcccactggcttcgtttacttaccctcggtgattccccaggtgactccccaatagtgtgaagtgtactccctnctcttgagaaactgtagagtataa

SEQ ID NO: 485079 - DNA, 264 bp, Homo sapiens
tctctgaggatccccagactgtcgacaggttgatttctgcagctggtgctcccggtgccctggctccctactggtgcgctgtcgcatgtcaggtgcagggagctgcatttgcccttgtttctgtgcccttctgtcctacgtagcgtgttggacattcctgcggggctgggagaaggtgatggtggttccgtaggagtcttccccgtcattccacaccatcagttctgctttcagctccgaggttactccccaccagtatggcac

SEQ ID NO: 485080 - DNA, 3054 bp, Homo sapiens
  misc_feature (1793)..(1793): n is a, c, g, or t
  misc_feature (1801)..(1802): n is a, c, g, or t
  misc_feature (1837)..(1837): n is a, c, g, or t
  misc_feature (2036)..(2036): n is a, c, g, or t
  misc_feature (2643)..(2643): n is a, c, g, or t
aaaaaaaaaaaagcatatcaaaacaaaattttaactactaatgggaaggttaaaaagctgccacgtatttctagtacaatgtatccaataagagcaaggacattgttaaatggaacaagacagctgggaaaggccccactatctctaatagaattgtgctactataaaacatgaagatatcagcaatttggccacttgcagtttttttcagcatgttaaagcaagtgctaagtactttattagtactttatttagtactttattttaaaggtctagaaaacaacagtcttcctggaggccccagaatccctttcatgggattcataagggactcaggtattcttattttctgccaaaaggtgtgcttatttagggactcttttacgatactttgtttctgaagttaggtagatcttggtttactgtgccaaggtcctacctagcattccctgtaggaatatttgaaattccactagctagtctaagaagtcaaagcacaaaattaattgtcaacgcttctctcatattcttaaaattgaagcagtttgcagggaagaacaagaatgaggtgtccctgccttggtaaagcaactgccaaattttgttctagaaagaatccccaagtgtgtggatctattataatttctttatcttttatgaatgagggcatcttttctacttgagcaagatcatggtccttgaccagtgggcttttccttcatatctgtcttgtgtagttgtgcttttcctttggctcgtttttggtctgtcagggtaaccagcagtgcacaatatgagacaaatgctctttagagagaaatctggtgagactgtagaacccagagcaaaactgtttttttttcagtctctgttttcttttctaaatgctatagaaaataaaggcacctgaaaagaaactactactttaacactgctgtggaaggccttgctttataagaaaaatattattagctatgggaaagtaatgttctttatgtaaagacttaaaaatagactaatagtttacagagttattatataaaatacgatgtgaatttatttcaaacaagttgtgaaggtaccaaaaaccacaataaaagttaatatatataaaaactactagaacaaaaaagcttgaaggtgtgggggtggagggtatggaagaccaaaagtaaatttaaaaaagaaatttttgaaaggaaacagctttatcaggggaagttaaatataacactccgtttttttcttctttctaataatgatatggatcaacaaatgcaatttgaactttttaagataactctaaatgtgttttgtttcttaaatgcacaattgattcttctatactgtaatgcttctttgctgacgctggaaaatggtcagactgctgactttgtgcctttaaaatgcattctgctttgacagtggcagactttttggtgctggagaagattcactagcagtcttatatgtgcttttcaggaaatatctttctacttaaggccttgagagattcaaagtggcatgacttaggcttggaccaaatataagatcttttacattgcaaacaaaatgttgtattgaataaaagggttaaaaaaatcataatgactagtggaaattttgatgggttgttaattatttaaaatgtatttgaaagtatacagactgaaaatttcagtatgaatatcttgaaaattttcagcacttttccttgtttacaaaacatctttctaacttaaaaaaatgactatgccttagaaagttttaaaaggcacagttacccttacatnacatatannaggaataaaatattaatgcatttgctgaactgtanaagaaaatttaaaccttgatttcagagtgaatggatggctttcacttgagagagtctttaccttattcccaaagaaactgcattaaaaagatgaaactatttctttagactaagtctctgctactccagctcatatatatgtcagatctgctctgtagtatttctgacatggagttgttataagatatgtgaaatcacntagaaaataaaatcagatgtgaatagtttagcaggatgaccaagccagatgcagactccttggctatggcaaagttctgtgccagtgattttatttggagtctgggaactgatagcttgatataaaatcacctggtgtcaattaaatatacaaatctatcttttttaatagaatgaatcttctttgtttgttcaataattgtaacttattatgtcaggtactaaattaacatccttaaggaggtcacaatctaggaggaacatgggcaaacagttacttattttatggcatacgctaactctgaaagttcagcaatgatgttttaaaatgttattttttattaagggaaaagcaattttaggtaatcattggctgttataaacggaaatgtcactgacaacagggattagagtaaaagtatctccaaactagagggatcccctccccaaccaggtcacatagcatctctctcaggaccccctcttactgcaaaacccagcctctactcaacagttctggtgatggggagcatttattccataacagtgttttttgtctttttttttttttcccccagtgtctcttttaaagaaaacttacttaattngggctctaaattggtgaaattacccaaaactttggatagaatttaacctctgtcaccggtgttatttatacctaagatccgggacagtcccttgagatcatacggtttaataactaaagttgggccttttgtttcaccacctgtatggtccatatttatcggactttcaccaatgggtaaactgtcatgaaaagcatcccattgtgtaactttcagtaggtgctttctcggtatgcctaatttaatttcatattacataactcaagttccccaccaaaatgaacacttttcccaaattagtagcgtcacaagtcttggggctaaactggtgtatggccctaaaggttcataaagcgagctctctaccttttacctccaaaaataaaaacaacgaaaaattttcggcaagaa

SEQ ID NO: 485081 - DNA, 250 bp, Homo sapiens
  misc_feature (29)..(29): n is a, c, g, or t
  misc_feature (39)..(39): n is a, c, g, or t
cgtcgggtggaccagcagggaaaaggaanaaagtatacngcaggcacgtgagagggaaacaggatgagccatcacgagggaaaggaaggtggaacgcaagggggaaagaacaattaactggaagtaagacaggttccttattatccccacctcatgcctcatccacatgctcgcccccagacaacggtccaaccggtccgacttctcagccatctgcggtctatcctttaataagcttcaactcattcca

SEQ ID NO: 485082 - DNA, 148 bp, Homo sapiens
gatctttctgtgccgtgtggtctgtgctctgtggtctgtgctggcgtgtgttcttgtgcttcgtgtgttctgtgctgcgtgtgggtctatgtgcttcggtggtcttgtgctgggtgtggtcttgtgcttcggtgtggtcttgtgctgg

SEQ ID NO: 485083 - DNA, 437 bp, Homo sapiens
  misc_feature (57)..(57): n is a, c, g, or t
  misc_feature (184)..(184): n is a, c, g, or t
ggctattcaggtggttttaggccggcctatggggggcttccaaacccggccccaaanaaaaactggggttcaaattttggtttggggggggggcccactcccttaacccccccaagttccccaagggggggggttttaaaaaaaaccaaaccccctattgggaaatggggttttagttcttttncgtccctccccaaagaaaaaattggggagcccccccccacccacccccttttgggtggccccaaaacttggaaagaggcccccttttcaggggtacccttgggaaaagagaaccccctttgggttaaccccaaccccccaccccccttggggggttttttcctgggggcccccccttgcccagccccccagaaaaaaaaaaattaaatggtttttttttttggggccaaaaaaaaccccccccgggtttttga

SEQ ID NO: 485084 - DNA, 1297 bp, Homo sapiens
gcttcattcgagacccaggcaggtgcgcgcagtcctaatggctgatcatcattccgtggagcacatgtgccgcctggacatccgattcctaaccatcccatcacagcctctggacacacgtgggcatctatcatgatacgcgacttggccctggcttgcgcacgaacctagatggcagtacggatcgaaagggagcatgatcaaggatcgtgcgagtgtaatgtggtcgtacgacgtagaacttgcgtcggtcatgagaacgtcatcgatttaccatagcggatggaatgcaagtacaagcaagtggtcgcgcacaggtccccgcggtgacacaggcggttccgcggtgtcatggagcccacatgtcgcgtacatacccggcacgcgcgtattgcggcatgggtgggacattcctaagaaccatgcgtatagaccgggaacccgtggaaggattcccggaaaccagtgggagacgtcgaaatacgaagtgtgagccacgccagcgggacaacatagggcaagagaaattgttacggggaccccctagtaaacagatcagtgggaatgcccacaaaggttcgtacccataagatcccaaccggtcggtggcgaattagaacggactcctaatccaagtagtggcatactagcacgtttgtcgcaccggcaggaaaatccaattcacctagttgcgtggctttgtagcgacactcacacgcagtaggaaaaagccacgtccttcgtccaaccaggggatggcgatcgcgaaaaacgggctggaggagccaccgaccaaagcacctccataaccgatagttgcgcaagttcgaactgcgcgaccttccaaatagagtacgatccgtcgccgattcagcactgctaaacgagtcaacacagcagcaacgcgcgtggcccacgccaaccctagtcagccgtggaacctttggcacactcggcgcaagaccggtacgacgaaatacccagaatagtaggctgttgcgagatagcacagatcatgcacagaccaatatagagaataccagcaaagcggagagagatgacacggaacagagatactgtcatacccaacagacggaaggtcggtatcgacgagtatgttagaaaggaacgctaggcatgatacacaatggaatatagagaagatatcagcgatcgagagacacacgaagtcacaaacacgtagcgcaaagcgcacaatcagtggagaagaaagaacatacagtagggaggataagaggatagagcccgataatgccagatatggtgtcaacaggaa

SEQ ID NO: 485085 - DNA, 424 bp, Homo sapiens
ctatcacagcgcaaataataatcctggtttgcaaagcaagccacattagcaaggattttttatttcccatgggttcttagccgaatgtctcaagctgctagccatctgcaaagagggtatgggtttagctttccagctgatcttgcaccacgaatatttttctaagaaatgcagactcatccatgagcagggccctgtctacacaatctaaggagcataatgaccgtaatgcttacactcatcgcaagttgagtagtcagcgacactgacagttggaagggtgaaagacgaaatgaatatgtttgaacatctacagtgtactttggaataaggtggtgcggctgctatcagaaatcatggctttgagccctggtgagatatgtcagttctctacagctcgtccgctcgtcctgcagtcctgcag

SEQ ID NO: 485086 - DNA, 640 bp, Homo sapiens
tccagagttaacaaaaaaattaatttggtggtctgaaagccacgatggagaactttaaaaaggtcccccggggaatgtaactggggggaaaggtggcgaaagggcaggactcggcagcccatggggcattgccacaagatgcgcccaggcgctcggggggtgaactcgtggtggtgacttcaggccagagggtttctgcccccgcaggtgcccgtgacagctgaggtggctcggaaggccccggtctgtggagaaggatttcacttggggaatctttctttcttctttctttttctcacataagcggttctctctctaggtggtagcgctcctcgggctatctctagcggggttttggcagctttttctctccctctcctctttgtggggctctcgaggggtgaagctccgggcccctcagggggcggcacatgggtccccgggatccggagcaagaggcctgggaactcgggtcccagcgccaccggtgcccagagcccgagagctaggtccagcaaaggccccggggtccgggccaacagggggggccgggacacctcgggcatcctcgggtggctgaaggaacaggctatgacgtcatggcctatctgggcaaaatgggccagaaggaagacttcga

SEQ ID NO: 485087 - DNA, 127 bp, Homo sapiens
agaaatacggctttgaaccaaagaagctgttggaccaactgaacggatatttacttacagctggactgtgctcggttcgggaaagcaattgctgaacgaccaggaggattctaacagtacggggatt

SEQ ID NO: 485088 - DNA, 1591 bp, Homo sapiens
ggctggagcgcagccctcaggtgccagggatctgctccggatgcgggacccgctccggccgggagcatggcacagcgaggctttcctggattcgcgcgggtacattgcgtgagagcatgaaactatccaggttcgacgtggaaccattgaataggcacgatgagaagtcatgaaggctaggaatggaggcttggtacgacgtgcgggtaggccaaagggttgtgagtgattactgatccaaaagcagtcttgggtatgtcggacatgatggtcagacttcatcacctgtcgccctctctggccctgtgagtgtcctgtgactcgtccgttggctacggagcctgcccactggggaaacgagcttccaaggatccgtagtcccctagtatggacccttctggcgaagcacagatgcgtgattccactcccgtaatcggacggggcgacacggacgggaagcagaatcgagcccactcgtttgcgtcgaactgaggcacggagaaagtggttcgcctataggcgcatagaacccccacgttaggaaactcggcggcttgctgcggcacaaagggtttaaccggtgcggaccaagtccaggccgcagacaagacgcacgcatacttaacacatgcctgtactgcgaaccgtgcttaacctggacacgcacctcgggagcgccggccgcctgaacattgcgatctcgcgcgtcccaccccgtcgcccgtatcggaattgggcagccaggtgccagagacgtacccacgggcggcggcccgaaaggatgttcatctcttgcgcacgtcgaggactccgcgtcttcgaaagtggcgccggatttgcctgggcctttgggaaaagcggtgttccacaaggcacacggatctcgggcccgataatcgtaaaccattttcgcaatgttcggtccgagggaatcgcgggacgtaaccaccgcaagtccggttgggaagccccccaatgggcgtttcgaaggggcgagaccacctatttgagcacgtgtgtttttcgggcagaaattcctagcttggttccacgcccccccgggacagacggcaagacatcgcgcattcgtgggatcctaagcgcgtaaacttcgttcacagagcgttcccctcccgtctttccgcggtgatgccttccttttgcatgaaaggccatccttgtgcgtcgatccacagggcccctctagggacaggaagaaaacattgaggagcgggaaggcgaagggagtcgaattcgtaggaaagtaggcgttagggagagagcaggaggaggatacattgcgggtgaatagaagggcaggggggacaaggaaggaacatgaaacctgtgtagggaaccggtgtgaagcgtggaatgggtgaggacagtgaaaggagcatggtgagagatgaaatgaagtgggaagggtgatgtggaatcgcgtccatgggtaacgggggggttacgagatgatggtgacgtggagaggcgttgagatggacagagtcatgatagtatgaggtgtgatcattgttggtggttaaagagatgatctgtgggaagtaaactagtgaggatgacgagggtgcag

SEQ ID NO: 485089 - DNA, 796 bp, Homo sapiens
  misc_feature (251)..(251): n is a, c, g, or t
agcgggctaaacaaattgcgaatataatgtgatagagttctttaaagagaggtaagagcaacgtgctttgggagcagagaagagggagaaagcaagtgatcttggcgctggatgagaccaggggacaacagaagaggaagcccagctatcgtcatttatagtctttagcgaatcgtcttgcttgcaagagttcccatgcgttcgtgaagaatacagtgagataaagtcatgtagaggccacgtatcatccntccttgctgctgtgcacgaagtttcctgggctggaccgttgtcagacagagaggcttattgtgacattgtatgctagaagatgaggcgttctgggataggcccagaagttcctgatgaccggcgacttcgagccctcgctaggcccagtgtgcccgcttccgcttgtcaatgccatcttcgagtggtccagtgttctgattggggtctggacaagagtgccagaggatcttgccccttgacagcaagctctgctagacgctgcaagaaagactaagataaccgaaagtcagggatggagactgtgagaacctgaagaaccttcacgcattgattcttgtcaacgagataacaagttagcaaagttagtcctggagcatttacaccttttggtgaagttggaacgactttatctgtccaaggaatcagctgaaggaatcgtcagagaaaatgccaaaatcttcgaggagctgcgtgcccatgagaatgagatcaccaaagtgcgaaaagtagcggtcaagtggactgaaccagatgaatggcgaga

SEQ ID NO: 485090 - DNA, 838 bp, Homo sapiens
  misc_feature (414)..(414): n is a, c, g, or t
agcggggcctgcacgaaggagggcagagtccggttgcggctgccggcccgacgcccgcgcatccccgctcgccgatgcgccgccgtcgtgatgtccggggccggactagccgcggtggtgagctgcctgcgcccgcaggccggcgaggagcctgagagcctgtcaggacactttctccctgggcagtgcgtgcctgtaatgctgtttgggatgccccagatacaacagtaacatggtgtcacatatgtgcaaacgtcacaccgtcaggccatctagacgtatatacatagtagtagaataaacccactagtacaagcgcaggttagcgcgctgctacgtatcctgtatatgtatgctgttacgacgctccgctcgttgcactctggatgagacagaagatcttggagattgctntatcctccctgaccctctgtctgtgagccaacgcttcaaataagccatgaatgtacgtacatgtcgcgtgatctgcaatacttttgtgagcagatctgggttacagttatatgcaaaaaggtcaacatcctcaaagtagcgcttttggcgtggagcacatgggactatcaagataggaacgaatcgtagacgaacccaattggattagagccaacaggcgtggctgatgggtggttccaatgagtgagttgactcgtggttaacggaacgtttttagtagacccgcaaggctacgggagaccaagttgacaaggaatagagaaggacgtcaaagtaggaaattttggccttttcgaatggaaaagcaaagcaaaatcatcgtttcgccataccaggttgaaacgggccgaaataaggcaaccaa

SEQ ID NO: 485091 - DNA, 312 bp, Homo sapiens
tccactagtgtaggcagttgacacaaaatagactacaaaagaggctttgacatatctgatcacacaatggctaagacccaggctggaatgagataccgaactatgcttagccctaaacgtcaacagttaaatcaacagaactgcatcgcagaacactacgagccacagatgaaaactcaaaggacctggcggagcttcatatccctctagaggagcctgatgctgtaatcgcaaaaccccgatcaaccacaccagctctcgctcaggctatataccggcatgctgaggaaactatgatgaatgctacaaagc

SEQ ID NO: 485092 - DNA, 823 bp, Homo sapiens
tgcttccacctgtcccgggagcgtgtgttctccgaggaccgggcccgcttctatggcgctgagattgtgtcagccctggactacctgtgactcggatgaagaacgtggatgtaccgggacctcaagctggatgaacctcatgctggacaaggacgggcacattaagatcacagacttcgggctgtgcaaggaggggatcaaggacggtgccacctatgaagacctttgcggcactagctgagtacctggcccccgaggtgcgtggaggacaatgactacggcgccgtgcgagtggactggtgggggctgggcagtggtcatgtacatagatgatgtgcggtcgcactgcgccttctacaaccaggaccatgagaagcttcctgagctcatcctctgtgggaggtaggatccgcttcgcgcgcgcgctgctgtggtcccgcagaggctcataggtcctctggcgttttcaggggctggcgtcgaggcaagacggaccgcccgattgtcacgaggcgttgggctgggggctcacgaggtatcgccactgggagatcatgcggctatcgcttctttgcctggtatcgtgtggccagacagcgctgtacgagtaagaagctcaggcccacccttcgaagctgccaggtcacgtcgcggagaactgggcagctaggtattttgatcgaggggttcacggtgccagatgatcatcattgacagcacctgaacctcagtatgacagcttgggggtggggtgggctgcgagcgcgggcccaacttccccccagtttctcctactcgggccggggcgggctgagcggcggta

SEQ ID NO: 485093 - DNA, 1470 bp, Homo sapiens
  misc_feature (131)..(131): n is a, c, g, or t
  misc_feature (238)..(238): n is a, c, g, or t
  misc_feature (539)..(539): n is a, c, g, or t
gcaagacgattctgcagacgcataatatgaagtacctatacataggacccaacatggatactgatctacatgcttgcgtcgtttaagtcattgtctagcttgatcctagctgacatgaggtgtacaagagnacaaaggtgtgccagatagaacggcgtgtgctcgtgtggaagcctggccactggggcaaccacagccattgctgacgacacgctattgactgcttacgctatatgangctttcgtgtcaagtggcctacctgtgcagtgcccaagcatggaaacctccagacaggaacaagtctcaagcacaagcgaaagtacacaacgcaggtggcagacgcatagaagtgttacgatgcgtgtacaggctatgcgagcgttacatggccacagcagcgtctatatggcagaactggggtgtatagcgtgtagcataggctgacgcactcgtgcatgacggtggccttgtcgctcttcagagcgctcgttgccctcgtggcgttgattgttgtgtcgtagctcgcggtagcgtaggntgaaccccggttgagtggccagattggacccggatcgctcctgaggggccaacagatcgcgcatgagttccacatacccagagcatctatcctctttcgctgagacgatcgatcgttgcgcggcatcaggaatgtaggtgcgacgtgcgcacaatttttttctgggcaacttttgtggggaactaatttagggtgaattgggtggcgaattcacctatagcggcgtgactgtcctagtacagtggccaagtgcgtttcctaatgaacggtgccgtaaactgattgtcactcaaacgtaagttagtaaactgcccgccaagcaatcttaaaaccttatcccgccaaaagtacgttaaccgtgcgtcacctctaaagactgggatcttggcgcccggttttcgacatgtaactaacttcgccgagtcccatttgtgtggcgacttccgcgacgcgcttgaggtttgggcccttggttttgggggctacgatttgccaattgtcccgccaggccctggcctcaagtggcaccctaacctccggttttctgggttggaaccctctaacactctatctggggttgtccccccaaagggatcccacagaggttttttccccatggttcttccccaattgtgttgcccttctcttttcccccacgttgtgtatacgcttttttaaccccccatttttcaatgggttacggcggacgacctttcgtttgtgcatacccggggtccacgcgccggttttaaagcccggttcctgtaagcacttgatgtgggcggccaataaccacttgttttttgtggctcgtccatgcatctcattggttgttccccctcttttatacatagagcgttgcgtcgcgatgacgctcagggggtctctacgtttacgggcaacgggcgcctcgtgctgtggcgggtggtag

SEQ ID NO: 485094 - DNA, 459 bp, Homo sapiens
ctttagtaagaatagtaattgtattctttctataaaggtacatagaaaaactgagggcatgttggggatgatttgtgttgtaccatgagctacactgaatacaaatggaaacgctgatgattatttgcttatccagtgagtagtggtgtaatgttcttaaatccatcagatggcaggataacgtttagtagtgcaatgatctgacacccttcttaaggtaacacaaactaattggcccaaataactagaaatggaatcaaactgattttcttcacattatctttaaggtagttattggatgaattctgctgaatttactcttatggaaataagaaagcttatgttgagggatttagtgaaaggtgaattgcttggtctagtatacaacagaaggcagatgttttagagtttatttacattcttacatctttttgttgaaactctgtctcaaaaaaaaaa

SEQ ID NO: 485095 - DNA, 314 bp, Homo sapiens
caaggcgggaaaccctgcagtttttaaaagtgagccccatgatgaatttgccttttaagctgggagaaaaaggaaaaaaagtgtgtttttattatggcctcgagaccctgtagcctaaaaacctgcccacatagtgtttgctaaggcagtaatttagactttcccttatttgtgattactgtagtgattgattgattgatttctttttactcccaggtattattttctatccccttattttaattttttgaattaatttgaatgtttttttccctaactaacttttccccataaagtcccctattaaaccccca

SEQ ID NO: 485096 - DNA, 135 bp, Homo sapiens
attagaggaccccgcgctacggcattaagtgaacggatccacacgtggagatggttcctggccctttcaggagggagtgaagtgggtggggcgtttgccttcggaaaccacacgttcacttaatgccgctagcgc

SEQ ID NO: 485097 - DNA, 249 bp, Homo sapiens
ccccggggggggacccccccccgggtttttttctttgcccgggggggggttaccctttttccccgggaaccgctttttccctttggccctttttggggccccttttaaacccggttttttccaaaaacccggggggggccgggccgggattcccggggttttttttccccccggggccggttttttttttttttttgggcccatttttttttccccccggggccttttaattccctgtttttgggggca

SEQ ID NO: 485098 - DNA, 694 bp, Homo sapiens
ttcagaagacctggtggggcaagtccgtgggcatcatgtgaccgagctggagaaagccttgaactctatcatcgacgtctaccacaagtactccctgataaaggggaatttccatgccgtctacagggatgacctgaagaaattgctagagaccgagtgtcctcagtatatcagggaaaacgggttgcggacgtcgggtccagagattgggtatcatcaactgattgagtgcagtatgaattctagcgaggacgctcacttcatggcggtttgatatggatgtggcgtggcagaccacaaaaaatggccatgagagaaagccacaaagagtagctgagttactgggcccagaggctgggcccctggacatgtacctgcagaataataaagtcatcaataccacaaaaaaaaaaaacaaaaaaaaactaaaaaactctggttcgggcgcgcctccggcgcccccgaggaaaaggttttcgagaacaatgtcggttggggggccgcggggcacccagacgaggtaaagttggaacactgctgtcccacagcgtcgtcccccaggagacgacatctgggcaccgtaacatacgcgcctggtggattttccacaccatttaaaaaaagcgccgggggcgacaccgacgggttgtcggacaccaactcccaagggagggtccgacggcaccgtagcggc

SEQ ID NO: 485099 - DNA, 185 bp, Homo sapiens
gatgtaaagaatagtggggtagctgatacttagccagtttcagagttagtctaaaactaccaacagagtaaacaggcaacctatagaaggggagaaaatatttgcaaactatgaagacagacaggggcaagtccaatgtggcctcccggataaacctcaatgcactattctttacagagcccagg

SEQ ID NO: 485100 - DNA, 266 bp, Homo sapiens
  misc_feature (51)..(51): n is a, c, g, or t
cgcatcttcagagataatgtcacagtcctcttccttcacttctggtgtctngcagccattttcatggattctttctagggaaattcatctgtagagtgaagcatgcagaggctgtttctttttttttttttctctggaccagaaaaagattggtttacctaccatttcatgggtagtagggcccagggggcccatttttgggggtgtcacagggtcagtatagatgggggcatcctctaagaagtcgcaccggcgggcttgcaagc

SEQ ID NO: 485101 - DNA, 147 bp, Homo sapiens
tgcttcgatatcaaacacatgctgtgagaaagtcgacatgtagatactgtagggaaccaggagtaagaaaagctttaccagctttactacaaatgtgtgaaagacatcaggatcccaacaacggaagggtaaagtgacttccccttt

SEQ ID NO: 485102 - DNA, 337 bp, Homo sapiens
cgcttcctgggttcaagcaactctcctgcctcagcctcctgagtagctggtatatacaggcgggagccaccgtgcccggctaattttcgtatttatagtagagaccgggcttcaccatgttggccaggctagtctcgaactcctgacctcaggtgatctgcccgcttcggcctcccaaagtgctgggattacaggcatgagccactgcgcccagccagaagaccaagtatgctattctggaacccgcattatgtaatagagacagcccatgccatgggctgggagttgggctttaggtccttgctctgcgcctaacttacctgtcttgatgagtctt

SEQ ID NO: 485103 - DNA, 102 bp, Homo sapiens
tcctggtgaatgtgtttgatgtcattaagggagagaaggaagacgaagtaaacctgagggcgtctttgattgtgtagtaagggtggaggtgtattacattcg

SEQ ID NO: 485104 - DNA, 170 bp, Homo sapiens
  misc_feature (69)..(69): n is a, c, g, or t
  misc_feature (155)..(155): n is a, c, g, or t
  misc_feature (164)..(164): n is a, c, g, or t
tggaaatgggtcatcataagggtaggggagcttggtcttcaggtaggcgaagaaggatgctcgttctgnccattcacctcacatttttggacagggtgaaggtgggctggtatcacccccaggacggacatacttgagactgttcagggatctcnctcattcgntgacag

SEQ ID NO: 485105 - DNA, 355 bp, Homo sapiens
gttgattttctttgcttttttcctcttaaggagctctcagtgtgtgaaagttctaaagccccaaaaatcaatgatgttttagccgctaaaatttaggattgatcgtttcttttaaaaaagatttggggaacctgatctggccggtattttacctaaattccctgggcaaaggtgggtatggcaattaaaagtcaaaaaatgggttgtttagcttggtttgtttccccaacttttgattaactctctgtatgacaactctacaaaagttgggggcgggctttttcaacagcatttttccttcaaaatcatctttttaatcaacagtcattaataaatggacatgggcgatattcca

SEQ ID NO: 485106 - DNA, 368 bp, Homo sapiens
ccccccccctttccccaaatggggggggggggggggcggtggggggtttttttaacccgggttttttttgtccccctcttttcccctggggcccccccccccgtgttttttcccccctttgaagcccccggggccgttccccccccgggttttttccctgggccggggggggggtaccatttttccccgggaacccgctttgccccttgggcctttttgggggccccttaaaaccaggtttggcccaaaaaaccggggggggcccggcccgggtttcccggggttttttcccccccggggcccgggggggggggggtttttttttaataaataatttggttaataagggtggtttttttgaaaggcca

SEQ ID NO: 485107 - DNA, 81 bp, Homo sapiens
caattaggggattactatggttcggggagttaccactactttgactactggggccagggatccttggtcaccgtctcctca

SEQ ID NO: 485108 - DNA, 300 bp, Homo sapiens
  misc_feature (252)..(252): n is a, c, g, or t
  misc_feature (262)..(262): n is a, c, g, or t
aatcatgctccattgtgtacgtacgccattttgcttatccattcctccatcggtgggtgcttggcttgcttccacattttagctattgtgaatgatgctgctctgaacatcagtgtacacataccttgttttgagaccctgctttcaaatttgttggggtatatagccagaagtgaaattagtgcatcttaagggtgattctgtttaaattgtttgaggaaccgcaatactgttttccacagcagctatggnaggatggganaattgtatgatctatgaattatatctaagtaaaactgt

SEQ ID NO: 485109 - DNA, 801 bp, Homo sapiens
cgaggaagaggaacgaggatggctatcagagctgtctgatgcaatacttgaaggataccccaagtagcaagaagcagttctttggaggaagttgggatagtacgactggtatgaagattacaacgtcacatctcccagacccctgaggggcccacggtcaggactggtgggtactgcaggatgtcagaagagtgagatgtcttgcactggctacctgtgtttttggttggcttttgtctgttgttcctgctactttcaccttgtaagcagagcagtcaggagacaagcataaaccagagcactgggtagagaggatgagggctggtggtctgggggtagacccagcctcatttcattgtctaaattgcagtagcttgaggttaacatttagacttggaacaatgctaaaggaaagcatttggcaatatgttagttataactttaaattattactagtagagaatagtatgtaactcttgccttcttggtactatgtccagaatcactggccacgatatcataaccgtagaggtaacgcgcagacagtgaactttggagaacctagaggtagacgagaggttgctataaaagcgagcattataggaagggcccacggcttcactgcaggacctcctgcgcttgtgtacctcaggagccgttttaagtatcttttgtagcgcttttcaccccacccccaagtcatgggagaaatgcaggcaacactgagacatgggagagggccaagatatgctgacagaaagggtgattttgaggctcagtaatactcggatgtaaccggtt

SEQ ID NO: 485110 - DNA, 114 bp, Homo sapiens
gaggatcccccccgcgtacagttgcggacgacaggttagtttaccctactgctgctgtgttgtttgcatggtaatcctggtccatacgagagggaactgaggttcagacatttg

SEQ ID NO: 485111 - DNA, 275 bp, Homo sapiens
ccattgagcctggattccatcttcctcacagtctcactccaacgctccactttattccctgttcccttctactggtttggaagccggtttgcatccctttttctctccctttctttacctctaactgacagaggatctagaattttcccttcccatttcccttaggctacggaaaaactctggactccatcatctctcggaaaacccagggattttttggggaacccaaaaggaattgcctggggggcaaaagattggaaaggaaaaattccctt

SEQ ID NO: 485112 - DNA, 205 bp, Homo sapiens
attcgcgggcgggtcgacccagctactcaggaggttgagatgggaggatcactggagcctaggaagtcaaggcggcagtgagccactgcactccagcctgggtgacaggaatgagactgtgtcttaaaaattaaaaacaagttacagcttttgctgtagaaatcttggaaagtacagatattaactaatataaaatagaaagtcg

SEQ ID NO: 485113 - DNA, 748 bp, Homo sapiens
  misc_feature (661)..(661): n is a, c, g, or t
ttttgggacagcggcaatcatggcgccacctgtgagatactgcatccccggcgaacgtctgtgtaacttggaggagggcagcccgggcagcggcacctacacccgccacggctacatcttttcgtcgcttgccggctgtctgatgaagagcagcgagaatggcgcgcttccagtggtgtctgtagtgagagaaacagagtcccagttactgccagatgtgggagctattgtaacctgtaaggtctctagcatcaattcacgctttgccaaagtacacatcctgtatgtggggtccatgcctcttaagaactcttttcgaggaactatccggtaagaagtatccttttcacatataccttagcaactggaataagattaggatagactaggacaccagaattatgagcaacagctacacttcctatatttcttctgccctgtactctttcttctttgagctctgattctgccctagtagtatccgatacatggatgatctaggacaaatggaaatattaacgagagggtctagacgtacagcacaggcttggcgccgatgctcacgccctgtaatctagcactttgagaagctgatgcaggtggatctattgagatcatgagtttgagaccagacttagcgacatggtgaatacccatctcntgtactaaatacataaggtagccaagctcagtggcttacaccttgtcctatcactttcggaggctgacgttgggtgatcacgctgcg

SEQ ID NO: 485114 - DNA, 175 bp, Homo sapiens
atctttcttaggttacttctcccctcattacgcctgcactcccaccatcagtgtgcactgtacatagtcgcatttgatgctcactgattaatgaacttcaacatggagccatcacaaaccacaaaaaaaaaaccaaaaaacaaacaccacacaccaacataccaacacaccccat

SEQ ID NO: 485115 - DNA, 1711 bp, Homo sapiens
agggaaggaggcggcggccatggattttgggcgagctgctctacaacaagtctgagtacatctgagactggcatctgggaacaaagtcagtcgccagtacagtgtatgtgtggaagccagaaccatcgttctcaatggacacgacccctatgtgactgacactgacctgtacttatccgagagcgagactctggcaaactgtaacgacgcttggaccgttcatatgctgtagtagaacaaggtacgtactcgtcataagtgccaccaattacaagaacgttcagccaaagagctgattgcactttcatattccatatataacatattagagaagcaccactgatacaaaactagaaggcaagcatatgtgatgagtccaacagcgagccaccagatacggataaccataatgatccaatagtaaggagaactcaacaacttggtcaatgacttcggcggcagcctgaatcgctgatgatggcaacacgacattgcattgcgacacacacaactatgaagaaaaacaccagataatgcacccatccaaagaaacaacatgtttggatacgcacaccatatcaaactagatcgattcatacaaggtggcaatgaacaacaagatgacaccttcatcgccagtccacggggggcaggacaataaccacggcaccgtggcgacatatcatgggcaagagtagactagaacattcgagaccgatataagtcccaaaagtaacggcctaaattaacgcaaaggacacacgatgcaggaagtcagcacaataaagcaaaaccaaagaataagaaaggacaattcataattagaccgtccagggtgattggtggggcaaaattgcgaggacataaggatagaacatcatacacagcaagtcaaccaaccacttggagagagcacaccagacgtacagacccagagccaccacggaacgcctacagcacaacgagacgcgatgccaccggctccacgcatgacgcacgaagtctaaagccaaaacactaacaatagccaagaaaggcagacacaacaagagctgaacgagggacagtgacatagaagcaccatgatcaacgggaagacaataaagaaatcggccaccacagacaaatctcacaagttataaaagagcaacgcacacacagagcagtggaacagagacaatctagaacctcgagaccgctgtgaatgccgctcagcgacgaccatcagcaacaaagaacgaacagaaacccgatggaaagatcacgatgcacgtagttgtaacaggaacacaagctgaagagctgagaggcaccaaagactgtcgacgcctaccagattgcacaacagtgtaacgagagagagcaacacgacacgacagaagagaacaaaagcaacacaaggaaacaacgagggggtatagagaacacgacaggaacagagagacacggacacagcggaccgcgagcggagcgcacaagcacaggacgacacgcaaccaagcgggagaaagcaggcaacagcgaaaagcagcggcaacaagtagacagaagagcactaaaacacagaacgccgcgccgcgcgcacataaagacacgagagaaagaaacagcgccagcaccgacgaccagcacagctactggctgacgcacgcacgacagccaaggcgagcggagaagcagagacagagccgaacaggcagcagcggccaga

SEQ ID NO: 485116 - DNA, 170 bp, Homo sapiens
acttggtctgtccagagtggcccgaaggtcctcgatctcagcctagcagcaggttggctctgggctcgaagatggccagctgttccttcaggtcctcctggctccggagagcatcatccaggtggatcgtgggtatccgttgaggatcgacttgagccgcagggtacccg

SEQ ID NO: 485117 - DNA, 166 bp, Homo sapiens
gctcggtacccaaagggaaatgtattaatatttgttataaaaaaccgtacaaaaatactgttcttccccttcacaattttaaaaattttgaagagtgggggaagagtgaaattgcaatgacctaagtcgttttatcgcaaacacttttcgtcgaaataacatttcg

SEQ ID NO: 485118 - DNA, 108 bp, Homo sapiens
tacgtggttccgcactcctggatgatgacgagtttgcatacgagacactcctcgctgacctctggctgaggatattccgactcgacgcgaggcgatttgatagtctgc

SEQ ID NO: 485119 - DNA, 526 bp, Homo sapiens
  misc_feature (28)..(28): n is a, c, g, or t
  misc_feature (511)..(511): n is a, c, g, or t
cggcctgatgatgagccccggcccctcnacaccatgttcctgacctgtttgggtgggagttaatggcacaatcctgaagatgtcatcagaacgctttgcttgctttgatgagaagcaacggcaccttcaggaagattacctaaggagctgctgacaacctgggggatcggtttacgatgaggagtggatgagctgtacgagagcacctttgacaaaaggggatttcattacatcgagttcacacgcatcctgaaacatggagccaaagacaaagatggctgaaagaactttagctaaaatcttccagttacattgtcttacttttttttacttttcagacacttcccccaccctcatagaacctgttgcatgcaacttagtttcccagctttgcctcttctttttgatgtatttattccagacctttctgccccttagcacttgtataatcagactggaaatggggatgagggtgtaaattgtattgaaaaagatcgcgaataaaaatcancaaatgtgaaagccc

SEQ ID NO: 485120 - DNA, 601 bp, Homo sapiens
  misc_feature (28)..(28): n is a, c, g, or t
  misc_feature (511)..(511): n is a, c, g, or t
  misc_feature (540)..(540): n is a, c, g, or t
  misc_feature (547)..(547): n is a, c, g, or t
  misc_feature (557)..(557): n is a, c, g, or t
  misc_feature (575)..(575): n is a, c, g, or t
  misc_feature (577)..(577): n is a, c, g, or t
  misc_feature (580)..(580): n is a, c, g, or t
  misc_feature (590)..(590): n is a, c, g, or t
  misc_feature (596)..(596): n is a, c, g, or t
cggcctgatgatgagccccggcccctcnacaccatgttcctgacctgtttgggtgggagttaatggcacaatcctgaagatgtcatcagaacgctttgcttgctttgatgagaagcaacggcaccttcaggaagattacctaaggagctgctgacaacctgggggatcggtttacgatgaggagtggatgagctgtacgagagcacctttgacaaaaggggatttcattacatcgagttcacacgcatcctgaaacatggagccaaagacaaagatggctgaaagaactttagctaaaatcttccagttacattgtcttacttttttttacttttcagacacttcccccaccctcatagaacctgttgcatgcaacttagtttcccagctttgcctcttctttttgatgtatttattccagacctttctgccccttagcacttgtataatcagactggaaatggggatgagggtgtaaattgtattgaaaaagatcgcgaataaaaatcancaaatgtgaaagcccagaaaaatatattngtatttntggttttgcnggatttttacatttttananaanaaaaatgttnttttgnaatta

SEQ ID NO: 485121 - DNA, 151 bp, Homo sapiens
ctgttaatacagaggaagaaggctgcgacggtggtcgtgactgagcggcccggtgacaggatggctgggcacagattggtgttaggtattaggagatctacacatccacaccgttgcaacagttttgccagctaattcaaaaaatcctgtg

SEQ ID NO: 485122 - DNA, 172 bp, Homo sapiens
aggactcgtttggggaggtggcctgcgcttgtagagactgcatccccgagacgatggcggagggagataatcgcagcaccaacctgctggctgcagagactgcaggctgggaggaccagctgcacgaatggcgagaggtgatgctgatcgctgataaagtcctccgatggga

SEQ ID NO: 485123 - DNA, 878 bp, Homo sapiens
gatccctgagctgttctgccgtggaatcttcgggactccgcccgcgcgcggcctgcagccatggagtcaccgccaggagcccgagtgaaggagcgcgtcctctgcctgttttgacggtaggacgggaccctcacgccgtgttcgccagaaaatgtgacccctgagtgtggccgccttcctgcagaagctaacgaaggtaaggtgcagactcgggttgtggagggcaggggtctggatacttgtacaggatcgctgagcagctggttgacggggatgaacgtcattgggacaacgtggcgataatgtggtggggcgggagacaacggggaggggtgcagaaataaacgcagggggacaggacttgcttctccaaggcaagaccatcaatgaaacccactctggggagatgcagcttgtttgaaggacttgtggatccaatttattggcttaaaggtacatgggccatgtcaaggttggcccaaaaaaaagcggtggaacctttcatccgagttccgggaaagttgaaatggtggaacattctcggccaaatggggcgcgaagctggcaccccgtggagggaaaagggatcgagggtccctccagaaggtgtccacggaaacgaggaacgatcccggggaagaaaggttccgtgtggaaacgccccttggaaaaacagatggtgggctggaccacagggggctagagggtactccccgagggaaggcaatgatccaggtttgggagggtcatccccgagggcgtgggaccagcggcaaactgccgtggaatagctggacacgacagctttgagccccaccacttcttggggaagcgagaagcccggggggaacactttgaaacttgccgccccgggatgt

SEQ ID NO: 485124 - DNA, 309 bp, Homo sapiens
acgttgacacttcagggtctattttggttaaattttgcatggagccgttccaggagagaactcatcttactcagcttttctgactctatgatttaaatcagaaaacgttatcagtaactgttctatcaagaccatccacagttttccttgcaaaataaattcccacacttcatcacagtaagaattcagttaaaatattttccaaaatcattttacttcaaaacatccaaagaagacatttttaatggcaagatgacacacaagttatgggtctgatgtaaggaataccataccactggactgttatct

SEQ ID NO: 485125 - DNA, 160 bp, Homo sapiens
actcgatgcgcagtcgatgctccggtctgctgtcgctggtccgcgctcgcctcgtctcctggtcctagctgtcctgtgtgaccttgttctccgctagcccgtcacgaggttgtacacggtccccgtgtgcccaggttctccgggaccccggcacaccggg

SEQ ID NO: 485126 - DNA, 826 bp, Homo sapiens
gaaagatggtgtcccgcgaaggaaggtaccggctctacatgccacctcttccagtctccaccgctcggcgcaccatgggaaaggcacaaggcaaaggcggctcgggagattcagccgtgaagcaagtgcacgatagatggccttggtggtattaaaggataagtcaaagcatttatcaatgaagacaggacacaggaacgtgaatgttgttcaaggaagtgcttttggcgtctgggttgtatcaacgtatcaggcgtctgcaaagtttagccaactgctgtctcactttcacctcaagcagcaacagcagcgcagtgatgctagagctttgagtgaatgttccacattatctacgatgtgaatattgattgcgtgagcactttcgcccgatgtaagacattgatcattcgttctactgtgggcttgtgtatctagtcctacatacgtattggctcagttcagtgacctcgtggcactcgctggtactctcatgttatatgttaccgagcatgccatttgaatgcaatcgtgatcgttctgcattctatgagtcccataaaaaactgcccgaaggatctctcctcactaaacggcatactagactgactcctaaacctgattggaagttagtaaagaaacaggatttttccccatgagggcattgacaatgagcaaagtatcaggcttgtgagtacatgtcctgaagaagtgccgatctgtacttaccaattcaccatctgatcacatgtcctactgtgggaacttgaacaagaagtcagctgttgcagataaacatgaattggtcaggcttgccagaagtaagtca

SEQ ID NO: 485127 - DNA, 1273 bp, Homo sapiens
cgcatgctgcagccctgttattgatgctgagatggctctgagcctaacattccatgatccaggatcgtgacacgatgtgcacaggctgctgctgtagctgctgtgggtaaatttggaaccacgaggagaccccagggccagaagacgaggtcattctgtctgcctgtgatgtgtgtcgaacctctcttgccatacattgatatggtgggtatctggagagggggtgatcctagcccaccacgacacactcactgtaggcaaagcacaatgatatatatcttagttgtggctggcgagcttcaagagtgacccagtccgatgctgataggatgtggcatccgccatgctgggtcaaccaagtacagtcgcttggcaatgttgcacagtacgatctgtctgcctgactatgcactaggtcacaccgttgatcctcgatctggtgctggtgcaaaagccctccgaggcggggcatgtatggcctacagtgcgggggatggacgtgtccgcggtcaaagcctggttggtccaatcacacaatggcccaaacgtgcagtcgaatggaggtcctgtacgggactctactaacgatccctccaagttgggatgaagcggtcctgcacgtactaagcacgcacgcacgaagggaagtcttcaatcgctagtgccggggcctcctccatgtcagggaggcatccaatttcccaggtgcttcttggggtagccccttgggaaacgcgttgccaagataagttcattccggctacaccttcccacttgggggaccaaccgagaaaaggccaaatcatatcgttggcaggcaccttgtgacttgtttcccaacacctgtacccggtgctggagagttattggtaagaccctccattgggtttcgctcaggggaatgaccataagagccattctagaggccgtcttagggagcgacccaacttcacgtggactgcgaaacacgggccctttggttgcttcattatcccggaacattaacccaatgtggtgggcgctacacccatcgccctaggagatcgcggtaatgaccaggcgaattgtatcattccccgggggattatcctagggcccccccagagtggtggcgtaaaagattggggatcttggggccgtgtttcggggcactggcacgatagttgtaccccaatcactaccaggttgtcatatcgaccttcctctggaagactcttcccacgttggtccccgcgggtcaaaaactctgactagtcctggcacgatttcccct

SEQ ID NO: 485128 - DNA, 291 bp, Homo sapiens
  misc_feature (184)..(184): n is a, c, g, or t
tctgcatgtgggtgtgctgtctctctgtactacttatctgtgctaagatgtatgccagcatcgtaccccaaaatgtcatatacttgagttgggggtagacagtcagctgacaggtggcaatacttatggaggcgatggaaaaatttacattcagcagaagagcctaattcctagcaaggattgnattgagaaacaaggagcattagaaagctccagaaggcggggtctcaggcctgcacatctgtcaatatatgatgagtgatcgggcctatgcctgagtgtaaccctcct

SEQ ID NO: 485129 - DNA, 218 bp, Homo sapiens
ggccggctacagcttctgaaaacttcccaagtcatcataaccaagaaagtgggctgggcgcggtgactcacaccttaatcccagcacttcggaaggctgaggcgggcagatcacaaggtcaggagtttgagaccagcctagccaacatggtgaaatctcatctctaaaaatccaaaaattagccgggcgtggtggcaggcgcctgtagtcccagctac

SEQ ID NO: 485130 - DNA, 110 bp, Homo sapiens
atttaaactctagacacaggtttatcctggattaacttagataactttgtagcagtggttatattgcttataatttaatgtacaatgctattgaaacttctaaaactagg

SEQ ID NO: 485131 - DNA, 450 bp, Homo sapiens
aatcagtcgtcccataaagcgcgtttgcgtcaggaaggtgatgaggctgctgggttccacatagacccagccgcccctctctcctcatgctcgcctcccgcccacctctcggggagccaaggcagccccagcaaggagtaaatgagtgagtgggtcctggcgccccaggacagggcatgtcgggacaagtgttcaaatggcaggcggggggtcgggaggagtttgtggctttggcactgacttctgtctacatgggacctcagcccccaaacacacacgacacacacatacaacacccacacagacacacacatacacccactcacacacgccacacacacagacctcacaccacacacacacggacctcacacaccacacacacagacgccaccacacagacatacacgcactcacactgcacacagcacacacgcagaacgcgcctaa

SEQ ID NO: 485132 - DNA, 543 bp, Homo sapiens
  misc_feature (21)..(21): n is a, c, g, or t
acggacctaaagtcactcatngcatatcttccgttagccacatagcacttgtcattgttgccattctcattcaaacaccctgaagctacatagaagccaccgccctaataattgctcatggtctcacatcttccatacttttctgcctagcaaactccaactatgaacgagttcacagccgaacaataatcctagcccgcggcctacaaacactccttccactaatggctgcctgatgactcctagcaagtctaactaatctagctctacccccatcaatcaacctaatcggagaactatttgtagtaatatcaaccttttcatgatctaacatcacaatcattctaataggacttaatatggtaattactgctctatattccctctacatactaatcacaacacaacgaggtaaacatactcaccacatcaataatattttaccctccttcacacgagaaaatgcacttatatcactgcatatactaccactcctacttctatccctaaacccgaaaattatcctaggccccctatactaaa

SEQ ID NO: 485133 - DNA, 480 bp, Homo sapiens
ccttcttcctatgagaaggaaaaacacttcatgtgggcatcacttccaaagacaactcaacaaataatagtactcgacattcgtcatatttattttactaaataccatggttcaaaagaacacaaaccagaagacatacttaaactagtctacatgggtggggttaaccacacccagtctccacattctctctatgtatatggagctagtaccacttcagagtgactgattactcgtgtacgctgccttttctgttaaaatgaataaatttctctgaacataaaaaaatttctctgaaccaacaaagacatgaaatattacaagatacaggcactttatgttcccagttttagaaataagccaagtgaaaaatatttaataaaagtaactgggccagagttttctactttagttctagacacttaaactcaattgaaaataaacaagttttagctgggattaatgcaatggtcatatttg

SEQ ID NO: 485134 - DNA, 363 bp, Homo sapiens
actccagcctgggcaacaagagcaaaaacttcgtctcaaaaaaaataaataaatgtatacaagacaatgtacataggttatatgcattttatatcagggacttgagcgtctgagattttggtatcctcacagcatcctagaaacagtatcctgcacatactgagcaacaactgtatacataaaggttgagggccgggtgtggtggcttatacctgtaatcccagcacttaaggaggccgagacaggagaatttcttgaggccaggagttcgataccagcctgggcaacagagcaagacctccatctctacaaaataaaaataagagaggagaagattgcttgagcccaggagttcgagctgtg

SEQ ID NO: 485135 - DNA, 244 bp, Homo sapiens
attaggcgcgttctggtggtgcccattggtgagacactccattagtgagacctagagtccagattcttgataggagccaagttcgtgttctatagctatttatgtaacaacaagcagaatcacgttttcccatttgtacttcagtcgctagcccctgttttgcacagccaagtactggctagtatgttctattttgggcctcctgctgctaaagaattgtctgagcacgcagaacgcgccatat

SEQ ID NO: 485136 - DNA, 666 bp, Homo sapiens
ctgtatgctctgggcatccccaatgtcctccaaggagctgcagtcggtggagcaggaggtccgctggcgcatgcaggatagctcaagtacaagcacctggccttcctggcagagtcctgtgccaccctctcacaggagcagcactcgacaggagctgctggctgagtctgctcgacacacctggaaaggcgttgtgacagaaacttgaatgattcccacacattagtggaccgtcatgactgaaggtgggacacctctcggagtccatcgtaatgagatccgcctgtgaagactaatggtgcctggatgttggctggagcactttggtcccctttgagctgcgtgaaggtgctggtgtagtgctggcagctctagagccggcggtccgtgcccttgctgcgggccatctcctaccagcctggtgcgagagaggcccttctctctgacgaagagatgtgctcttggacgtggacctatgcctatggacaaactcgagctttcaccagagcccaggtgtcccagcgcctgggcagcgacctgttatccctcatggcccagtctgacttctggtgcggtggcccactgtgccagtccttcgcttactcaagtggctctactgtccctgtttgaggcctttgaccagcacgtctgaacgagcgcaggaat

SEQ ID NO: 485137 - DNA, 214 bp, Homo sapiens
tgtttcctttgtctctcagtgggggctgagtgagacttggaatcgtcaggggcacgtacacactcactttgggcccgggaaatcacaatccttttgtttcctggcagagtggcaggaaaggggggatgaagaaagaagaacaagcgttgttgtgcatgtgggggacacagaggttgtttaaggcaatggttttacgaaagtgtaagcctgcttg

SEQ ID NO: 485138 - DNA, 1322 bp, Homo sapiens
gcaccggggcggacgcggaaccgaggcatgtccatgaaaagagttttttggtgtctggggacaactatcctcccccgcaatcctctggatatcctgggggggccccagccacccatgccacccatatggtcagactccctacactgggagttaacggaccacacagaggaacaaaacataccaagaaagcagagaaacgcagaaagaacacagaacacacagacacacacaagaacggacaaccaaacaaacaaaaccacaacaaaaaaacaaccacacacaaaaacaaacacaaaaaaccaacaaaaaaaaaaacaagcaaaaacaaaaaagaaaaaaacacaacagaaaaacgaaaaaaaacacaaaaagaacaacgaaaaaacaaaaaaaaagaggagaaaaaacacagacaaaaacaaaagagcacgacaaagcagaaaagagaagaaaacaaacaaaccacaagagacagagcagcacaggccgcaacgagaagagcaggacaaacacaggagcagacagaaaacacgaaggagcaaggcgaaagacgacagaagaggaggagcgcgcagagacaaaagcaaaggagggagcacagcagcgacgcaacggacacaagcgggacgaagacggcacgacaagaagagaggcgaggagggaacagaaacgaacaggagacgacaggaagcgaaagagaacgagaaggggagaacgagcgagaaagacgaaagcggacaagacggcaagagaaggagaaggacagaaaaagaggacccaagaagaaagacaagagaagagcaacaagatagaagaagcaagacaagaacacaagacacagaagcaagacaagacaagagacgcaccacgaccacgcggcgaaggaagcagccacgagcacgcagcacgaagcggagcgaaagaataaacggagacacgcaagcaacgacagacaggaaaaggagggagagaacgcagcgcgagcacgcgaggagaaaaccaaggatagggacaccacggaccgcaccaccggaccagggcagccaaggccacaagcgacggaggagggaggagaagcgaagcggggacagagagaagaaacaaagcgacggcgaccggagcacgaagacagggagcgagcaggcgaccgcgagagagagagaggaaggacagacggaggagaggccaacaagaggagagccggcgcgcagagcacgaaagacgcggaaagaagaggcaggacacggcagaaagagcacggacaaagacaagaacaacaaggactaaaaggaggacgacgagagaggacagagcacggagaa

SEQ ID NO: 485139 - DNA, 541 bp, Homo sapiens
agagaagtagaggattctaccactggggcatcgtagtcccctaaattttaattttctttagtacatgtaattccatgagataaaccacatctacataaactaaattggtaaaaaccataaggttcagtaactttaatttttaccaactaaccaccgtaagtagaaggtagtggtgagctatggatgtcttctcgtgcatagataaagcattaccaaagcagatcatcccattttaatatgatgcatccaaattagctgtgccaaatatactctaaattcctgatactcttcctgcctctgcgtcgttattttctgaataggtaaattactgtaagttccccaaatgaaagatactctaaagcaaaaaagaactggaatttaagaaatattatgtgctctttctataaaatagaaataaaatttgtaggatataagagtctcaatacagattatatcactgccccatgcaaatatgattttatttaaacaaataatgaaatattactttttggataatactatttttatgtttacattattt

SEQ ID NO: 485140 - DNA, 309 bp, Homo sapiens
  misc_feature (17)..(17): n is a, c, g, or t
  misc_feature (19)..(20): n is a, c, g, or t
  misc_feature (22)..(22): n is a, c, g, or t
  misc_feature (71)..(71): n is a, c, g, or t
  misc_feature (116)..(116): n is a, c, g, or t
  misc_feature (127)..(127): n is a, c, g, or t
  misc_feature (131)..(131): n is a, c, g, or t
  misc_feature (139)..(139): n is a, c, g, or t
  misc_feature (144)..(144): n is a, c, g, or t
  misc_feature (167)..(167): n is a, c, g, or t
  misc_feature (171)..(171): n is a, c, g, or t
  misc_feature (174)..(174): n is a, c, g, or t
  misc_feature (181)..(181): n is a, c, g, or t
  misc_feature (194)..(194): n is a, c, g, or t
  misc_feature (229)..(229): n is a, c, g, or t
  misc_feature (276)..(276): n is a, c, g, or t
  misc_feature (292)..(292): n is a, c, g, or t
  misc_feature (295)..(295): n is a, c, g, or t
  misc_feature (308)..(308): n is a, c, g, or t
aagaaacagataagtananngntgcttctgttgcaactgttgcctcaattcaggtgaatcttgaggtgttncaagttgcaacagaagcagcagtatactaaccagcttgccaaagnaacagataagnacantaaagagnttggntctctggccaacaaccccagtgnacancgncaaaggnaaatacagaaggntcgcttagtggcagagttcacaacatcactgacanacttcagaaggtccagaggcaggctgctgagcgagagaaagagtttnttgctcgagggggggnccngtacccaattcgnc

SEQ ID NO: 485141 - DNA, 148 bp, Homo sapiens
ataatcaattattgtgagctaacggtatgtaaattatatcgataaagatgtccttcttatggggtgttcatactgatcagacttttccacataaattgaaaacagtaattttatatatactgtaaataaagattgaaagtttttgata

SEQ ID NO: 485142 - DNA, 264 bp, Homo sapiens
  misc_feature (39)..(39): n is a, c, g, or t
actctgacgctatttgcggtgcctttcagcattgtgctntacttgtgcggagaggtgagggcatcactaacctgggataacccagtgatttactgtgcccatgccaatggtgacgcccacagtgcagggtgtgcctgtgtcatgggtgttcctggtctgaggattgaaggcagaccccagttgtgagatacttgcccggggggaggtctcgcaagggtacagaccttgttgggtaccagcgttggtattgggagcagaatggtc

SEQ ID NO: 485143 - DNA, 100 bp, Homo sapiens
tcttcaaagcgctctcatacgaatggaggctatggaagccacttccacctgggctgaggacgttctcttctcaaacttaagctccccagagtacatcatg

SEQ ID NO: 485144 - DNA, 320 bp, Homo sapiens
  misc_feature (60)..(60): n is a, c, g, or t
  misc_feature (88)..(88): n is a, c, g, or t
  misc_feature (171)..(171): n is a, c, g, or t
  misc_feature (222)..(222): n is a, c, g, or t
  misc_feature (282)..(282): n is a, c, g, or t
ttctgctacagcgacatggcccagtcccaaaggcgcaagggcccacttgtgtcagcagtntgcaccagcagcgtgcgccggcaagatngcagaagcatgaaaagggccggccagaagacacctactctggctggaagacacgtacccctgaagatcaagaaagaagctatntgggaacaatgtagcagttacgtcagaccaggacacttcctgtttacaggngactataaaacctttgtcctatcatcacttgatgtggacgccattttagcctcagcccgnctgcacccaggcactgattaaaacagcatgttgctcca

SEQ ID NO: 485145 - DNA, 294 bp, Homo sapiens
gataatgctcttctaagacggtcaagtaacagtcatacagctagtgaagtccctggttattacaattgttaaggagtgtaatagccgttacaaaatgcacaatgcagcttagtattcggtcagtcgtatgtggtcatgttggcgatccccatttcaccatataatcctcccaccgtacggctgcgttatggcaccgtaaactctaagtaccaccagctagaaggaccgcagtctcggatgatgttcaatgattctgggtaatgtttaggtcagatcattggatatggatggtcg

SEQ ID NO: 485146 - DNA, 628 bp, Homo sapiens
ggtcagttcggtaatagcgttgttaccatgcccacgtcgacgaaactccggcggctctaggaaacgagtctcggatcagaattcttcaagtgtgaactctttctctttcgcgtccgaatcggatctttctttagtccgcggggaaatttttatccaaagggatttccgcgatgaggattgagggcggccaatgctcccaggtcgtgggccaaccaagcggggatagaggggctggcaggaatggtaagttgggcggaattgatgacggcgaggatgtcagtcattcgctcgactggcatcgagagcgccgggggtgggccacctagagagttcacggccggattaatcgaaggaatcatcgtgataggaattgcctcagcggtcgcagttttgtaactggcgtcttctggatcgaaataatggagttcgaatggaggcacgacggttttcattaccagcggtaaaagctccctgatgaaacacggcggtgccggcaattttccgccgctcatcaccgcgcgggatactgaccgggctgttaactttccaggctgtttcattcggcagctttggttgatgaaggctattcgaattccggtaccgcgcgcggggagatttccgcgagtgt

SEQ ID NO: 485147 - DNA, 630 bp, Homo sapiens
  misc_feature (21)..(21): n is a, c, g, or t
cgcgcaagccagagaaaaganaactttggattgcgggatacagacaaatatgtttcaaaggatgcccctgtaacccacctttgggttctccaccatgtcgggggaaagaggtccaattttttaataaaagtgtagccaacaaacttgtccagatggtggtttataaaccgcaaaattaccggtttaaggttagtttccaacaaagacactctgcacagtatccacggctccatccataaacaatttgtaattcaggtcgtatcatcatgggccaaagcaacggcatggttgtaatgtccatttcgcagcacggatctttgatacaatggaggcaacatagcttcacagctgtctgatatctatacagctgattggtgcatccatggtcactcgcggatgtacacatggtgaatgaatcattgcgtgcagaccttttttgcaggagtgtaggcaaatagcaaagagttgaactgcatcctgccatactgatagactcgccttcccggcagttctcggcaagaacactgtcactcttaatgccatacatggtcgcagaggagagcaggagtgtgtgtattcgatgatctttcaaccccccccaaaaaggtgtggcgtggacctgcatccctg

SEQ ID NO: 485148 - DNA, 389 bp, Homo sapiens
atcagtggttctgcataggagttgcattgtcagcagtttttgaattatcaggtactaaatccttgatatatattcagcattatctccatagttcgagtctaacagctaaaccaagtagccagtcaatagcttcttgtcgatcttgaatcttgaaaggacagttaacatctctgagatacttttcaaagaacttgggccagtcgctgctgtggatgtttcttaaattccctctgtcttcaatcttgtagtgcctgattttctggtcttcaagccaaacgatgaagtttctaaattctgtttcatctttgcagttgaagccggcggggttgtggtagtcgagagccgtcaacttgcgtcggaacatggtccccgctcctcgctctggtcct

SEQ ID NO: 485149 - DNA, 1172 bp, Homo sapiens
  misc_feature (224)..(224): n is a, c, g, or t
agcgtagggacgacgtctagaagatgcgaggcccatgcattgttgagacgtggctcttacctgatctagcacgagggacgaagagctcctccacttccctcattcaccaaaggaaggcttcggccgcagccgtacccaaggttaccggtgagcattgggcgcggcgtggtgaaaaggcggcttcgcgcagagtctgcctctatctatgtcggtgctgtgaatcnatgaggagcatgaaactttgcaaaggaggaggttcttacgttggtgcggacaacggaatgtgggtgaacaagacagcgatgaataaacgtaggtgtaacacacgcaagactcgacaggacttctgcagaaaaagcgtgactgacgaatcttgtcggaaacatacatgaagtcacttgggcacttctgcagttgcccttcttaaacagggcaccgcctctcagggtgcactcaggcatcacacgagacaactcacgacattagaggactccccagtgtctaagaaaagggccactcgtgttggaagacgctaacctgttaaggactggtctctctcacccctgggggccctctttcccggaaaggcgacgactgaacccatatttgggggtaacgacctccccatttgggacagttactgccttgtaccggctactgggttgacagaacggaaaccactgccccaatgctttacccaagcatcgggcgatcatattgaaaaaggggcacggacttggggggatcgggcacactcgggcgcacaccactaagtactttcacatccaagcacttccaccggtttattggccacaggcctccacggtacatgaaggcccttacattcccagccaacccgggtattagtacgtcgttcctggcagccacaccattacccacgtggccaacacttcgcacccagaaaccacaggatttggtacacgccgacagggaacaacccccttcgggatggatccaaattctcctgttaaacacgtcttcagcagccaaatcttcgccggacacgcaagagataataactaactccacagtgctcaccagggacgcctgggaccccaacgggtagcctttttccttcactaccgtttcactagcttcgatattcctacagttacctccaactctagagcagactggtcacctcaccttta

SEQ ID NO: 485150 - DNA, 411 bp, Homo sapiens
  misc_feature (264)..(264): n is a, c, g, or t
  misc_feature (273)..(274): n is a, c, g, or t
tctggctttatggtattccattaggttcttttcatttaaagtagtcttaaaatcaaagtatccaatattttaaagccacaaagtagattacataattagcagagattttagtcagtaaaatgttagaaatcaaactataagaaaattcaagtcctttattttgtgtcttgggtatatgtcattattttaaattccacactcccttatttaatcactttggtaagtgcctttgatgttttgaaatgtatagtgggagaggacganaaatggtannaaatgtccattgggtgccctggttccagtttcaattcctcaaccattttacaggtgcaagttagcctttgtgttaatcaaagtgtatttgtagcccctccatagtgaacaatgaaataaactatttcatagaaaaca

SEQ ID NO: 485151 - DNA, 1076 bp, Homo sapiens
agaggtcatgcgttgttgtgtttgtgttgtttgtcgtattattgtattgttcgctggtctgtgtgtgctgtgattcattttctgagtccagaagagaataagcagttggacagaataacatggcgggcaagttgtgtggggtgttgccagctgtgtagatctttgggtgtgtcggttccaattgtttgataattcgatcacggcccctgtggccccggggtaacctgcccttggacgccgcaactctttgtccacgtgggcccctttcccgcgccctgtttgccgtccctgtgctgtcccctcgcctgtgggttgcgccagtggttgtgtgtgtgaccccgcgtcgcgtgacccgacccccggggcaagctcctcaaccttggaccctccgtatttaatttgtgcgcgccctttggcctacgcgcggtaaccacagatcctctgatacaagggtggagcattcacaaacttcataactacgcccctgattcggccccactgcggacagttgcgccgaccatctcatatgagtcaccctagccatcattgtgactatgcgcaccgtactaataagtggctcctttaacctcgcccccctttgtcgccacacccaggacccctctgattactccggccctcatgacccttggccctaatatgatgttatctccacactagcagagacccaccggacccccttcgaccttgccgaaggggagtccgaactagtctcaggcttcaacatcgtatacgccgcaggccccttcgccctattcttcatagccgaagtaccaccaaccttattataataaacaccctcacccactaccaatcttcctaggacccacatatgacgcactctcccctgaactctacaccaacatattttgtcacccagaccctacattcttaacctccctgtttttatgaattcgaaccagcatacccccgattccgctacgacccactcatacacctcctatgaaaaaacttcctacccctcaccctagccttacttatatgatatagtctccataccccattaccatctcccagccattccccctccaacctta

SEQ ID NO: 485152 - DNA, 259 bp, Homo sapiens
  misc_feature (234)..(234): n is a, c, g, or t
gctccccgtgatacctgggtgttgtgagtgtaaatcagttgcgatgagtaggggacagggagcctactagggtgtagatatagctagaggtggcgcttcacaattccggtgcatatagtaggtagcctgcagataatgttaagcggtataggcgatacggccacgggctaattggtttgacacataacctagtaccttacttattcactttacatctaactgtgacaaatactnacttattccacttctctaacaactg

SEQ ID NO: 485153 - DNA, 739 bp, Homo sapiens
  misc_feature (4)..(4): n is a, c, g, or t
  misc_feature (52)..(52): n is a, c, g, or t
  misc_feature (134)..(134): n is a, c, g, or t
  misc_feature (137)..(137): n is a, c, g, or t
  misc_feature (145)..(145): n is a, c, g, or t
  misc_feature (147)..(147): n is a, c, g, or t
  misc_feature (182)..(182): n is a, c, g, or t
  misc_feature (201)..(201): n is a, c, g, or t
  misc_feature (256)..(256): n is a, c, g, or t
  misc_feature (264)..(264): n is a, c, g, or t
  misc_feature (317)..(317): n is a, c, g, or t
  misc_feature (319)..(319): n is a, c, g, or t
  misc_feature (323)..(323): n is a, c, g, or t
  misc_feature (337)..(337): n is a, c, g, or t
  misc_feature (347)..(347): n is a, c, g, or t
  misc_feature (460)..(460): n is a, c, g, or t
  misc_feature (467)..(467): n is a, c, g, or t
  misc_feature (472)..(472): n is a, c, g, or t
  misc_feature (480)..(480): n is a, c, g, or t
  misc_feature (621)..(621): n is a, c, g, or t
  misc_feature (739)..(739): n is a, c, g, or t
cagngtgtcgtgaaaacataccccctaaaaaccaaaaatgggaaacgaaaanacttcaataatcaacacttgtcgctcatttggacacgtattaattccgggcaaagtccaccacatacatggccaatccttantcntaataaantncggttggcaatcgacaaaacaaccatttgaaaaantttgaaaaggaggcatgcntgataatgggaaaaggcccccttcaagataatgccctgggcccttggaataaacntgaaaacntgagcgtaaacgttgataactaccaatttaataatcccccttgatggaaattntntganaccatcaagatacntaatgtaacntaatcaatttaatgccccagtacacagagacctttattcaaaaacaatgatttacagtggacactcttcaggctgtacctgttcctgttccatgaattgtttgtcttcttggntttttgnttaantttaaagncattgataatctccaaaaatgggcaaacccgatatcatgcccttctggcttacacactgggtgttaaacaactaattgtcggtgttaacaaaatggattccactgaaccaccctacagccagaagagatattaggaaattnttaaggaagtcagcacttacattaacaaaattggctacaaccccgacacagtatcatttttgccaatttctggttggaatggtgacaacatgctggagccaagtgctaacatgccttn

SEQ ID NO: 485154 - DNA, 177 bp, Homo sapiens
gtcccgaggctttcctcctcagcagacgcagctcccatggattatgctatcgccgcgctcgtcgtcgacaacggctccgtgatgtgcaaggccttgcttcgcgggcgacgatgccccccagtgccgtcttcccctccatcgtgggtgcgccccagtgcaccagtgacgtgactggtg

SEQ ID NO: 485155 - DNA, 275 bp, Homo sapiens
tcagtcggtaccactctcagaacaaagcaaacaacaaaaaaaaaacaaaaaaaagaatacgatatggatctggtgctgtagccgggatggaccccaaaaacatgctaattgaaagaagccagatacaagaggccatgtatgatccttggatatgaaatatccacgatagactcacccatggagacagaacacagattagtggtgggctgggaggagtggggaggagggagtcatggctgtgggatttctttctgggatgaagacaaagggaaaca

SEQ ID NO: 485156 - DNA, 166 bp, Homo sapiens
tgcatgtgtgacggaggacgagtaagtggaaagtggcttttccaggctgacatttgatgccagtgggatctctgatttttttcctctctccctcccctccccctgtaggaaacaatgcccttttgataataatttgctctctgcctccatgattccgtactcccca

SEQ ID NO: 485157 - DNA, 450 bp, Homo sapiens
ggtgctctcatggcacatgcaactcaagtaagtctacaattactctacttcccctatcatagaaaagcttggcacctttcatgatcacgccctcataatcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacacatcctttacataacagacgaggtcaactgatccctcccttaccatcaaatcaattggccaccaatggtactgaacctactagtacaccgactacggcggactaatcttcaactcctacattcttcccccattattcctaaaaccaggcgacctgcgactccttgacgttgacaatcaagatcaccaccaataca

SEQ ID NO: 485158 - DNA, 162 bp, Homo sapiens
gtgcctgtgtttctagagatccccacgatatccggtcagtaatgcattcgcgaagtcatccatgtgagcggacgatccacctgaatgggagccctgaaggagcccattcacatccctaagacctgctcccgccacaatgacagacagggaatggaggtgatg

SEQ ID NO: 485159 - DNA, 318 bp, Homo sapiens
cctttttcaaaccccccccccctttcccccctactccttcccttcctttgagggcccctcccctttggggttgccccttggttttggggccccccccccccccccgcccccctttattttttccccccctttcccccgggcccccccttgggggcccttccccctttttgggcttttggagggccccgattgttcccaaatttttcccccccccttccccccccccccaaaaggattttcccccccccccttcctcccccttttttttggtttttcccccctttcccttggttttttttgggttaaggggggttggca

SEQ ID NO: 485160 - DNA, 241 bp, Homo sapiens
tcccctttaaaatcatcgccttgaaagcttgaaactgattccagtgatggtaccattagccctgactttcctgagacttgctttgggggttctccttcagagcctgtgatatcttctttggaatactaagcagagctgtctttgtcctttacagacaaaaataattctgaactaagaaaatgactcaaacaccttaaagtgccctgcaaggtccttgccttcctttccagcttctttcatg

SEQ ID NO: 485161 - DNA, 379 bp, Homo sapiens
tctttgctacccattaaacagtaactcattacttttcctctcttgttcccagtaactcttattgtatcctctatgaatttgtctattctaggcacctcatataagtggaatcatactatatttatcctcttgtgattggcttaacttagtgtatattcaggggtcatccatgttgtaagcatgtctcagaatttacttcctttttgaggcttaatattctctggtatgtatagactacattctgtttatccattcatctgttgacgacacttgggtttttcccaccttttggctattataaataatgctgctatgaacactggtgtagaagtatctgagttcctgcttccagttcttttgggtatatacctaagagtgg

SEQ ID NO: 485162 - DNA, 107 bp, Homo sapiens
ttatcaggtcaggcagtgattagtttatactagtgcacctgcccctgtgtccagtgcacaggtcctatctgctccactagtagagggtaatcacagctcatggaggt

SEQ ID NO: 485163 - DNA, 930 bp, Homo sapiens
agcggagctccgggacccaggtgacgggaaagcaggcagccccagcggcgggagcagtcggcagcagcccagtgcccggggcactgggcgtgggggtggtgcagtggtgaaatgggcagacaatcgcgcagtcagttgtcgagcacatgcttgtctcatgcttttacacttcatcgtcgagtgattttgtcatgtgtacttgagtgcagcagtcggtcgtgtcgtctatgtcgtagatcacaagacactcaacagtttcgacagacaggccaatcgagaatatagagtgcctaccccaatctctacggaggtgcccctgttgagcctttcagaggttacgctaatctcgggggcctcttatcactctatagtgatagagcgcggtggcgcgtcccctcggtcactcgcagtctactctcagtgtctcctactccttaacgcatcgtctcaacacggtgtcaaccacatttatctcgagccagccccatgcgccgccagtctatgctacctcctcatcgtgatgtctcatctcttagctccggtgggctgtccagcccagatggcatggtggtgaaacacaccttgtggtgctataattcaacgatgttgctcactaccaacccatacctcatgacctactctgccctccgcatacactgcgaagcaccaaaaccgtgctgcatgacagcctgattcccgcagcctgcagccgaacgatgcactctttgctctgaccaccaccacatctccgcacaccccatcacacacgactagccgccgagcctcctccaacaccctgcttcataccatcaccactcataaatccctcgcaccgccgagtactcatgttctctggtggtgatgtcgcgcgggtcgcttcctgctctcggccgtagctgacgagtttctcactctgtgcttgtttctttt

SEQ ID NO: 485164 - DNA, 175 bp, Homo sapiens
cccgggtgtactgcaaaaacgggggcttcttcctgcgcatccaccccgaggtcgagttgacggtgtcctgttagaagagctgaccctcacatcaagctacaacttcaagcagaagagagaggagttgtgtctatcaaaggagtgtgtgctacccgttacctggctatgaaggaag

SEQ ID NO: 485165 - DNA, 418 bp, Homo sapiens
atctccaagtcagaggactcacacttcccagtttcaaaatttacaaaagtactgtaatcaacacggtgtggcgtggacttcaggatagatgcatagacctatgaagagaactgagagtccggacatccacacagctatggctggatgattggatgatttttgataagggctccaagtccatttaatgggaaagaatagtcttttcaacaaatgatgctggggcaactgggttcctgcatcaaaagaagggagttggaccctatctcatatcaggtacaaaaattagcttgaaatgtatcaacgacttacatttaagagccaagagcataaaattcgtaggagaaaacataggggtaagttttcatgatgttggatatggcagtggattcttagctataacacccaaagtatgaacaac

SEQ ID NO: 485166 - DNA, 1469 bp, Homo sapiens
tgatgactggtcacccgcgcttgtggtgtggtggttctctgtttctgtcgctatggcgtgtcgtatctggctcgagggtatgtgttggggtggggctggctttggtcttcgtctgtctctccgttgttgtttgcgtgttggactggtgctgctcgagttgtgtgttgttttcttactctctcttcttcccctattcggttttgtccgtgcggccgctcgtggttggtttgcgcgtctcttttatgtgtggcgtgtagtgtgcgcgtgttgccgcttcgcgcgtcgcgtagcggtttgctcgctcggtgtgggaggctcggcgtggtctaggtagggtctcgtgtggtgtgttcgattcgtattgcgtgtgtttgtctcccgcgctctatggtggtgtggcgcctgttgatgtatgggtgggcgcgcggggtgtgtgtgcgtcgcctcgtatttcatcggtctcgtggtggggtgtggtggtcgtcggttgtctgcgcagtatgagtcctctttccctgcttattggtgtctgtttggtttgtatgtttcgtcactccgctgggtttagctcttgtgtgtggtctttcttgttgttaagagtatgtctcgcttccgcgttctatggtgttttgtgtgcttatggttcttcttgtgtgtgtgtggcgatcgctgtgtattatttgtctgtcgcggtgttgtttgtgtttgttctgtctgtttctgttcttcgtctccgattcggtttgctgtttttgcttttgggtgtgggggttgttttgtctgccttgctgtgctggtgttctctcgcttctctttgctggtgttttgctctctttcccttgttcttctctctattgtgttttttttgtcctgtttgctcgttgttgcttctcgcttcttctttgctcatgtcttgtgatgtgtgtctttctgctgtgtgtcggtgtgtgtggttgttctgttgggtgttgtttggttgtttgtgtctgttgtcggtgttgtgtcgtgctgtgttttggtttgttgcattggtggcgtcgcgtttcttcttgtttctgtccgcggtgtttttgtttggtttgtgcgcgtgtccgctcgtcggagcggcccgttcgcgccgcgtctttgtatagactgacgtcttcgtgtgtggtgtggccccctcgggtgcccctccccacagttttctctcaagttgctttccgtcgcatagtccccccgagttatattcatctgttagatctctgcggcccgcgacacgctctcttatagagaatatgtaggataacctccccgctaagacccctcctctctaagaatttatagtggttctcccgggtttgttcttttttaaagggttctctctcactatttttcaccccccctctccccgctcttatcatatagcagcacaacaatcgagcctactattcaactccgaccggacccactcaataatacagaaaaac

SEQ ID NO: 485167 - DNA, 651 bp, Homo sapiens
cccttaaagacccaaatttatgctaccactaaacaaaaatacccactcagtctgggttaaaatggatgtctttttaaaggtatttaaagattcaactaagctttaaagagggctgagcagctcaagaagcctgtaatgtgggcataactctttggacctgatcttgatgcttctgctgctctgttagcctctgaagagcaatatctaatttattattactcggattttttaaaaagctttaaagtgcctcaggggtcccctgaaactaattttctatttctgggattccctggattcattatatgagatggtgacatgattagaggaattcttttttagtatgaaaattgtgccttttcttcttcagtacttgcctccttgctggcattgaattaacacagggacaaaattttggtaattttttatttctactctcccaccccctgttgcccagaatttgtttgtggcctttaccaccttgaggatgaagctattcagctggcataattatctatggctgtagcagtacactgagttgactgtgccaggatattgagaagctctgggggtgatttgatacctcgcaggtttcttattttggaatgaggttcttttcttgaggtgggtccttctataaccccggttagtttg

SEQ ID NO: 485168 - DNA, 606 bp, Homo sapiens
tcttttttaagctaattaattcattgtgatctgtttgttagatctttttaaaatactcactggataaagcttgaaattttacaacaatgcccctgagacaattttagggaagtcctttgattattctaacttaacttcagtgtcatggaaaacagaattatatatccaagtgttctttcatattcagaacatccagtactcttccaagaagggaatgttcatgattatatacacatatatttattgactgtgttgctcagcttcttatctcaaggagagtcagtaactctttttcttgataaaaactaccatgtcagccaagcacggtggttcacacctgtaatcccagcactttgggaggctgaggtgggctgatttcttgagcccatgagctcaagaccagccaggacaacgtggtgaagccccgtttctacttaaaatacaaaaattagccaggcatggtggcgcgtgcctgtagtctcagctactcggagggctgaggtgggaggatcacttgagcccggctggctgaggctgcagtgagctgagatcgtgccactgtactccagcctgggtgacagagtgagacactgcctaaataaagga

SEQ ID NO: 485169 - DNA, 217 bp, Homo sapiens
gtagatacacactgtaccatgacacacacgcaccccatgacacacaccacacacagccaccctctgctctaccagctttgcctctgttctccgacagcgccagtgttgacacgccagaggttgcctgggccccactccttcccagctgtctccaggattagggaagccccaggcggatccgggccgcaaggagccttcctacccagcccccatgcag

SEQ ID NO: 485170 - DNA, 776 bp, Homo sapiens
ccggggtgtgcagtcatctttgcgtgtgcgccgcctgggtgttcctgggtgtgcctcgcccttggttgctcgtgctcgtcttccccttgggggccctccccatcgtgcgggtcctgggatctctcttgcgggtgtactctccccgcggtgttatgtcgggcgcgacggcgcaattttttgtatcaagcttctcgctgttagcatatcatggtgtgtccccgccccgcttatgttttgcgctcagtggggagtcccacgccggggggcaggctggggcggaggactccccgctcggtggccgctgtggtagcaccctcacgcggggtatgtggtgaactccgcccgcggcttcggtgaggagtcacccccccactgtgggggtttgtgtagatagttcgttatcggcgtgcgtcgccacaagacgacttgtctgggcgctctctcttggccggcatgtgtgttgcccccccctcgtgggcctttcgcatcacacaatggtctcagttttccctgggccctgttttctgctccaacatggctctccttatccctcgcccgttttattcccccccggagtttccgtctgggatcaagcccgtaacgtcctcgcccagatatcgccgggtaaccacggcccgctacccatgtacgactcctcgctcttattccgacctacacgtattatgcccgggataagcctacgtctctcaagacacgggcccgcgccttatcttcacgcgatcacccgcaccgacgacaccgtctgcaaaactacg

SEQ ID NO: 485171 - DNA, 285 bp, Homo sapiens
aataaacagatgtgatactgatgttgcctgattttgatcactgttctgtggttatagaagaaaacatccttgatccttaggaaacacaccctaaagtagtaagggcatcatgcctgaaacctgcttccaaagggctccagaaatagcaaggcagcaatgcataagccaaatgtgtccaagcatgtttacacaacgcaggtcacagtttgcaacatttccaaacacaaaggctcgggtcgtggtcggctccacatttcgtaatcccaagccattttcgggcaggcc

SEQ ID NO: 485172 - DNA, 144 bp, Homo sapiens
acctgttactacgttgcgatgtgcgaatttatgaccattaattcatttcccgaaaagtgcagccacggcgcacgtggctcatgcctgtcactcctagcactttggcaggccaatgcagtcgtcgcaaccggaggggactcctct

SEQ ID NO: 485173 - DNA, 292 bp, Homo sapiens
aagtccgaacatgggagtttgccaattgcattcatcaagtcgttttgcggagtcagatccctgatggaaaagctcacaggctttgccttccaagtcctgggttcctaactggtgaccttagcctggggtttgtggggagaccaaccctggcttccaaaaaaaccccattccatggactatcaaaaataaacccaaatttgggtgacaaaactggctttggatttgccttttaattttgtggttctggcaggttgggaatgattaatatttaacctttattttaggaaccaaa

SEQ ID NO: 485174 - DNA, 389 bp, Homo sapiens
  misc_feature (249)..(249): n is a, c, g, or t
  misc_feature (377)..(377): n is a, c, g, or t
gcagtttgatttaaaaaggatctaaggtcaggcacgatggctcacacctgtaatctcagcctgccttgtagctgggactacaggtgtgcaccactacacctggctaattttttaaaatttttgttgagatgaggtcctactgttttgccctgttggtctcgaactcctgggcctcaagtgatcctcccactttgggcttctcaaggtgctagggattgtagggcatgagccaccatatgtggcccattngctttatgcttgaggattaaaaatgctgtctccatagtatccagatattctaaattttgtggaaaggcatcccacccattttttgaggagggccatcttaaaccattttttaggctaggttgttttanttaaccggtagg

SEQ ID NO: 485175 - DNA, 189 bp, Homo sapiens
gggcttaatcgtgtcactgccaggcttccagacagcgggcacaacttccccatcctcgtctgtgtactggaaggcctggaccagacgcagagcctcatccacggagcgtccacaggcaaatcattacagtgtctgagaaggacaccttccatgatgataaagaggccctgtagcatgcctattgtttca

SEQ ID NO: 485176 - DNA, 147 bp, Homo sapiens
  misc_feature (76)..(76): n is a, c, g, or t
aggtgacttagcagcatcccccaggtggggcatccacggggcatagtggtggccatgtgttggtcatgtcagcatnctttttcacattcatcagggtcaatgtcacactcaggcatcatagttccagggtcacggcagctcgcaatt

SEQ ID NO: 485177 - DNA, 763 bp, Homo sapiens
  misc_feature (59)..(59): n is a, c, g, or t
  misc_feature (80)..(80): n is a, c, g, or t
  misc_feature (133)..(133): n is a, c, g, or t
  misc_feature (249)..(249): n is a, c, g, or t
  misc_feature (278)..(278): n is a, c, g, or t
  misc_feature (305)..(305): n is a, c, g, or t
  misc_feature (308)..(308): n is a, c, g, or t
  misc_feature (511)..(511): n is a, c, g, or t
  misc_feature (534)..(534): n is a, c, g, or t
  misc_feature (543)..(543): n is a, c, g, or t
  misc_feature (546)..(546): n is a, c, g, or t
  misc_feature (555)..(555): n is a, c, g, or t
  misc_feature (559)..(559): n is a, c, g, or t
  misc_feature (564)..(564): n is a, c, g, or t
ggccccaaggaggggcgcccttgttaggaaaacatcggggtgtgcgctttaacgtcacnacgtccccctgccacgcgacnccatccccccggaggggggccagatcatccccccagcccggcgttgcctttangcaagtgttttgaccgccacaccccgcctcatggagcccatttaccttgtggagatccagtgtccaaaacaggtggtcggtggcatttaccgggtttttaacaggaaacggggccncgtgttttaggagtcccaggtggccggcncccccatgtttgtggtcaaggcctatntgnccgtcaacgagtcctttgggttccccccttaccttaggtccaacacgggcggccaggggtttccccaatgtgtgttttccccccggccgaatcctgcccggagacccctttgacaacaacaacccccccaaccaggtggtgggggagaccccccagcgcaagggccttaaaaaaggcatccctgccctgggcaactttctggncaaattgtaggcggcccttcctncagggcctnccnccccggggncttncagcncccccagccccacgtccttgaattttcagacgacacctggagactgtcccgacccagtggcttttgccccaaaaaggggaaaggaacacccgggtagatgatttttagcaggcaggaagtcctgtgcggggtccccatgagcatctccacctgtactagtgcccttggaataataaattttataaggtggtggctttta

SEQ ID NO: 485178 - DNA, 196 bp, Homo sapiens
  misc_feature (161)..(161): n is a, c, g, or t
  misc_feature (171)..(172): n is a, c, g, or t
  misc_feature (177)..(177): n is a, c, g, or t
gtgtcatagtcttgggggttgttaatgaagaattaagactgtgtcatctgtatgtgaaattgatacaacttacctttgcagcattctcccagcaatccttatgagccccattgtccccatgtgagcactttcccagacaggcctgattctccctatgagtntcacagcctnnccttncccacatccacatccttcc

SEQ ID NO: 485179 - DNA, 227 bp, Homo sapiens
  misc_feature (62)..(62): n is a, c, g, or t
  misc_feature (132)..(132): n is a, c, g, or t
  misc_feature (140)..(141): n is a, c, g, or t
  misc_feature (158)..(158): n is a, c, g, or t
  misc_feature (162)..(162): n is a, c, g, or t
  misc_feature (167)..(167): n is a, c, g, or t
tgcggagctgccctccactccctaccaagtctgtgtactgggtacttcttcacattgcctcntgtgctctggtccagccatggtgcaaggacccacctgcttgtctgtgtccaaacagcgtttcctgaaggnagaactgnntttctatttccaacagncagnactancagccctttggtatgctgtcgtgaacttttcagatgtgccaagctgaaagctggcccctg

SEQ ID NO: 485180 - DNA, 588 bp, Homo sapiens
ttagagctaggagtttgagaccagcctgggctatagcaagacccctcactacaaaaataaaacatcaaaaacaaaaacaattagctgggcatgatggcacacacctgtagtccgagccacttgggaggctgaggtgggaggatcggttgagcccaggagttcgaagctgcagggacctctggattgcaccactgcactccaggctgggtaacagaatgagaccttatctcaaaaataaacaaactaataaaaagcaaaaaaaaaaaaaaaaagaaaagaaaaaacacggtgctttggggcaccatctcagctcccttgcttccaggttgcagcatgtggacgtgagtttctggacaacagaatgtggtggtcagaagttgacatttttgccaacacggggttcgttgggttgggggctctcccccacatcctttcctggcctatgagcgggaacataacacatgcctatgatccagcttgggtcatacccagggggagggtggcgcaacgaactgaaagggaacctgaatccctgaatgactgcttggaatagaacccactcagaaaaataaccttttatatttttat

SEQ ID NO: 485181 - DNA, 898 bp, Homo sapiens
caggaagctgggcagccggaatcggcaatgacccccacccaggggccagcgggagcagggcctgcatgagaccccgacagaaggtgggggggggggggctctgggaagcacaggccagcacctccccaggtggcaggactctggcttggggtgcccggccctcattcccttgcccagcgcagtgagtgctcattgtgtcttggcccctttgttcgcaaacgtggataaggggtgcccaagcctctcctgatgctttggtaaacaagaaggtttcagcagtattacaccaccttccctcattgcctccgagggggtggaagggggtgggcacacttccaggggccccccagtgccccttggcccccagggactggaaaaggcttcccaacccagagttgtccctgttgggaaggcaggcagaaggtgacaatttgacacggattttccttgcacgcgtccttcctttatacctttggaagcagttaagaatcttaccaggcacaagattagaggccgccctttgccgtgacggagcttgatagacgcagcccttggtcctccggtcccaggactgaagagcccagttgccttcttgcccaccctttcccccagggccctcttgccagccttctggttgcacggtcgagggccctgccccaatgggagggcctgccaagagcttggctgggggaccccctcccgggctcttgggctccctgaatgggtgtgaagtgtacctgtggtggtccttcttaagccccattaaggaagccccagggtttataagcgactgacattcgccacgtgcatctggatataggaaaaaggcgccggagaaaaggcaaaattacactttgggcgtgcataaaagaagcctcttttttttacctaaggtagt

SEQ ID NO: 485182 - DNA, 1048 bp, Homo sapiens
ggccaccactggcccacccgggactctacgcggttctgcctgcggacgacagcgagaccgggcgctcgcgtgtccaggtgactgtatggtgggctcccagtcagcggagtcgttcttctggctgctgcatccttgcttcacagggtagatgcctgagtcgggagctcctcttttgcacctgtaacttcgtcagagagtgtgcagctgagtacccagggtgccagcgatgccggagccaaggtgactaacagaatcactttgaagcatactttcaatccacatgcatcagaacttcttagcgacaggaaagggccagtgagcatagcccggacacctgcgtttcacctggccatatcagcggaactcccacattatccgttgggcctgttcaatctacttccattccaggatgcctagctagctgaggggcggaccctacgttagaaacccaagcggctcttggtgaaccggaacttgacgaccagagagaccagaagaaccatgtttagcgcatgaactgcgaggagactacaacgtcagccgaaggtacgatctggccttccaaaacccgttgaaggaacacttatcttcgaaactgggctccaggaacgaatgatatgcccagaaaggcttagtattatgggcacccagaccaccaacgtgggaacagccccaccattccgcaaaaagggttggtacttccctgaggtggattgcccatgcaaggtggttgggaggcaaaaaacggcgagaagggggacacaaattacgtttggaaacacttgggagaacccccagacaccatgggggtattcccacgaagagcaagttcaggaatttggccctcacagttggaaacttaaactgggtatagtttatacaacggaagcgaccacttggaacttgggggaaggcgcattcattgaaatggtagcagaagcccaagggaaccttccaaagttgggggataggcttgcgatggcacttcccaacacatgggcttttccggaaggacagccctgaaaatagaaaggggggtcaaaaccac

SEQ ID NO: 485183 - DNA, 481 bp, Homo sapiens
tcaaaggctgcagcagcatccacacatcactttcattttttgtttaaaaaaaaggtaagaaaggtctacaggagatggtgagtttattatgtctatgtttggatagaggttttgatttgctctcgaatgttccaggctggagagaaactaggagaaaagcacaggatgtagaggtctattcggcataatcttctccctcattttcatcttcaccatcaacagagagagcagcatacttgctgcagaactgaacttagaagctggattttcctcaggttactttggctcaggtgcagatctggagtcttgatcctttttgccatctttcctatctgactccttccagtggtctctgttccctccgtctcctggaccacggatagagttcccagtttggcctttaggggcattcatcccatctactttattttcatctttccttcctggtccttcctcagatggttgagctggagctactttt

SEQ ID NO: 485184 - DNA, 158 bp, Homo sapiens
  misc_feature (14)..(14): n is a, c, g, or t
ggggggttcccggnaaaacccccccccccctttttgttcccttggggggccccctttcctttgcccaggggggggggggggggcaggatttggaagttttggggttcgggggggttttcccataataacaaaaattcccaactttggagaaacttgga

SEQ ID NO: 485185 - DNA, 232 bp, Homo sapiens
  misc_feature (18)..(18): n is a, c, g, or t
acttccacccttgccccnctcatctgccgcctttgcttttggtgggctagttgggttggatgctttccttctccaggtgctttcatgcagcctaaagtacagcctggaccacccctgtgtgtagcttagtatagattccctgagctgcagctgagcctgagccatatggtgatagttacactttgacatgagataagatggtggagattggcatgccattgaaactaagagc

SEQ ID NO: 485186 - DNA, 207 bp, Homo sapiens
catccagcaaagttgcacgcgcagggtaatcatatgcatggtaggttgcatgtcagcattgggctgttcaattgtccagttccagtgttttcaatctgcacgccaggcttcatgcggacaggcagcacatgtattccatgttcacttcatcactcacagattcagttctatctcatcagggatggaggtcactgcagctacgcaatt

SEQ ID NO: 485187 - DNA, 148 bp, Homo sapiens
  misc_feature (72)..(72): n is a, c, g, or t
tcgacagcacacacgccaacagcacacacacgagcacacagacaaaacgcacggcgacacacgcacacacancacacacagcacacacactagcacacagcacacacactaagacacagcacacacatgcacacacagcacacacacg

SEQ ID NO: 485188 - DNA, 383 bp, Homo sapiens
cacccagcccgggtcgcaggacagggccgcagcagcaagctctctgagtagacgccttactgctccaccgagctgatccctgatccaggcgcctggcgctgcccgaatcctatagagaggaggatctcagctggcttggagatggttccctcccatagtctcatcatgtatactgccagctatcgtttcagactatacacctgcctatctactcccagacgtgctagaactattcacacattcctcattctttacaggatacagtaaaaacttctgtgcaaggcaatatttccactcgcatatcctgccctgctttagcccaaagactgcacttcctggcccatcatatctccttgctttagcatcctcagatcagaattccc

SEQ ID NO: 485189 - DNA, 830 bp, Homo sapiens
  misc_feature (62)..(62): n is a, c, g, or t
  misc_feature (104)..(104): n is a, c, g, or t
  misc_feature (221)..(221): n is a, c, g, or t
  misc_feature (324)..(324): n is a, c, g, or t
atagaaaggatggttaccccaaataccctgacttgatcattacacattctataaatgcaacnaagtgtcacatgtgccccataaatatttatattatatatcantgaaaaacaaaaatgtgatgtaattaatatcactgaaatgcacactttacatggtttaaaaggcagatttgttatagattttttatcacaattttaaaatgtatttaaaaataatanatccatgaaatgttaatgtttttataaaaaatattttcatatgcaagtgagattgacagtaaaaaaaaattttttttttttggagatggagtctcactctgtngcccaggctggagtgcagtggcgtgatctcggttcactgcacctggcctaatttttttaaattactgtgtgggagatgagatctgtgctgtgttgcccaggtgttttcaaactcctgggctcaggggatcccccctcctgagattcccaaagtgctgggatggcagacaccagccacatgattatcatatgtcatgaaaaatacaaaagcccaaaaagtggtatattcatccaatgggatattattccaccataaaaaggaatgacatccttatcatgctatgtaaatgaacatgggaaaacctttatgataagtgaagtaggccaaactgaaaggccgatttggttgaatatacttttgggagtatatagattggcaaatcctaggccgcaagtgcccagaggttgcgtgaccgaaatgggtatgcaccagcggggaacaggggaaccccggtaagggaaaggattgcccttataaaaaaaatgccggtgcggactgacacgagg

SEQ ID NO: 485190 - DNA, 93 bp, Homo sapiens
cggtccctgcccctgctcgcggcccgccctcggcgcccgcggcccctccctcaccctccgcgctcagcctttctctgctgcgagtagtgacta

SEQ ID NO: 485191 - DNA, 885 bp, Homo sapiens
gccctggtgtgattccgtcctgcgcgttgtctctggagcagcgtctttaatctccgtccgccttctctcctacctaagtgcgtgccgccacccgatgaagattcgatggacatggacatgagccccctgaggcccagaactatcttttcggtgtgtgaactaaaggccgacaaagattatcactttaaggtgatacatgatgaacaggcagtccaattaaagtaccactgcactttgaaaatgtctgtacagccaacgtttccccttggggggctttgaaataacaccaccagtgcttctcaaggttgccgtgtgttcagggccagtgcatattagtgacagcacttagtagctgtggaggaagatgcagagtcagaagatcgaagaggacggcggatgtgaacactctttaagtatatctggaaggcggtctgcccctggaggtgttagcaaggttccacagaaaaaagtaaaacttgcgctgatgaagatgatgacgatgatgatgaagaggatgatgatgacagatgatgcatgatgatgatttgatgatgaggaagctgaaggaaaaagcgcagtgaagaattctatacgagatactccaggcaaaaatgcccaaacgttaaattcgaatggaaagactccagaacatcatcaaaccaagattaaaagggccagaatccttcaggaacggaaaattctaaaaaccaaagggccagttttgtgagcactttacccacaatgcgccgttttaaacggggtttctccagggacccttccattgggaagtgcgcgaggcaacggtacacactccgggggcgttcaagaaaagtaacgccttttgggcggtaggaagaccccgtttgttcggacacgcactacttg

SEQ ID NO: 485192 - DNA, 277 bp, Homo sapiens
ctcgattggaactgaatgggatgatttactttcgaagctcatgtaaggcgccgtatattgcatgttgcagcggcgcttcattggctttactggaaaggcgtcgaaggtgggatccactcctgagtcttctttctagtggaagaataaggcacatattgttctggggtgccagtcacgttgaatttatggatcggccaaatgaatttacgagcaggaagcggttttggcgttggaggatcatcagccatactgtgaagccgacgatgccattcagttg

SEQ ID NO: 485193 - DNA, 809 bp, Homo sapiens
cgtggatcctgcccgggagctgaaggttctcatcaatagcctcctggagctactgaccgaggtgggggtctctggccaaggccgcgacaatgccctgaccctcctcattaaaatggtaccccggaaatcaccaaaggaccccaacaatagcctcacactctgggtcattgatcaaggtctgaagaagattctggaggtgggcggctccctgcaggatgctgctggtgagctcacggtgacggcaaacagccgcatgagtgcctccatcctcctgagcaagctgtttgatgatctgaagtgtgatgccgagcgagaaaacttccaccgactctgtgagaactacatcaggaactggtttgagggccatgggctggccgggaagctacgagccatccagacagtgtcctgccttctgcagggcccatgcgacgctggcaaccgggccttagagctgagcggtgtcatggagagcgtgatagctctgtgcgcctccgagcgggaggaagagcagctggtagccgtggaggcactgatccacgctgccggaaagccaagcgggctcgttcatcactgccaacggtgtctctctgctcaaggacctgtacaagggcagcgagagggacagcatccgcatcagagcactagtgggactctgtaagctcggatcgcgtggagggactgacttcagacatgaagcagtttgcttgaaaggtccaccctcaaatggcaagcaatgccgaaagtgggtatgcaatgaccccgatgttgccggtactcccggccgggcaagggaggggctgggttacccc

SEQ ID NO: 485194 - DNA, 357 bp, Homo sapiens
cggaccccttagtctacactcatttcttccctcccactaggatttcttcccaatctgacgctctcaattccattccagtctacaccccatattcctgtttcctgacttcctatctctgtgaacttcttctcatcagtcctatcaattaagtcaggtctctcatatattaaaatacactactcccttgacaacacaccccgtctattaacaccctgtcaatatccaccccttttatagccgagctttcacaacgcatcacttccccagcaataaccacttcttccattcccatatactgcactgcctatgagaatctagtcttctgcctccagcactatatagtagggaaatattcct

SEQ ID NO: 485195 - DNA, 375 bp, Homo sapiens
  misc_feature (39)..(39): n is a, c, g, or t
  misc_feature (74)..(74): n is a, c, g, or t
  misc_feature (77)..(77): n is a, c, g, or t
  misc_feature (89)..(89): n is a, c, g, or t
  misc_feature (102)..(102): n is a, c, g, or t
  misc_feature (110)..(110): n is a, c, g, or t
  misc_feature (115)..(115): n is a, c, g, or t
  misc_feature (122)..(122): n is a, c, g, or t
  misc_feature (132)..(132): n is a, c, g, or t
  misc_feature (134)..(134): n is a, c, g, or t
  misc_feature (136)..(136): n is a, c, g, or t
  misc_feature (142)..(142): n is a, c, g, or t
  misc_feature (144)..(144): n is a, c, g, or t
  misc_feature (149)..(149): n is a, c, g, or t
  misc_feature (156)..(156): n is a, c, g, or t
  misc_feature (169)..(169): n is a, c, g, or t
  misc_feature (233)..(234): n is a, c, g, or t
  misc_feature (269)..(269): n is a, c, g, or t
  misc_feature (281)..(281): n is a, c, g, or t
  misc_feature (293)..(293): n is a, c, g, or t
  misc_feature (301)..(301): n is a, c, g, or t
  misc_feature (310)..(310): n is a, c, g, or t
  misc_feature (349)..(349): n is a, c, g, or t
tcgtttctgcgttcgtcgtgttctcttggtagtgtttantgtttgggtttttcctgctgaggaatgtgcttttnctntgtgtttccagnttcattttcggcnagtgtttnttgcntcttacnaggcaccgcntntnttgtcntntccanctgtttngtcattttttggnagatgggtttggctgcttttcgtcctgcatctcgctgtgctttaggcattatcattctggattnnttgggttgtgattaagatctagtgtggacttgggntcttctttcatnatttatttttcnttattatntattttgtntttctgttttcttaaataggaaatgtttctataaacctntaatgaacaatttaagttgggatttt

SEQ ID NO: 485196 - DNA, 481 bp, Homo sapiens
ggccgtccaaaagtaaaagttgagtatcctatcatgtcaagcacggaccctgaaaatgggctcatcctcgactgcattcagcgaagccaccagaacacgtggaaagtgtaacatgccatcttgatttttcgagctgatggaggtgtataacacccgcgtatagcttatggcctgggcttggcttggactgttggacgagttctttatgcttatggctattacacgggagaactcagcaagcgtagtcgaggagccttggggtccatcgccctcctgggcttggtgggcacaactgtgtgctttgctttccagcatcttggttgggttaaaagtggcttgggcagtggacccaaatgctgccattaaagaattataggggtttaaaaactctcattcattttaaaagactgacctttatttccatctgcattttttttttgaaaacaataaaaacttgcctggcatcagcctaatgcctaaa

SEQ ID NO: 485197 - DNA, 141 bp, Homo sapiens
gctcagtgatctctgggctcagtgatctccatctggctccatgtgctgaatacaggcatgagcaccgactggctctccttagaatgtgtaagtgtctattggataaaagtacctttgaaatggtctagagatatccacatc

SEQ ID NO: 485198 - DNA, 478 bp, Homo sapiens
cacaccacctgagtcctgtttaatattagtgcttctgaatcaaaggatttatgtttcctccttcaccttggatctaagtcccagtttaatgacccatcagaggaaacctgtctgtaactgagaggcagtaacccttcactgtttcccagatccctcctactttccttctcatctttttcttatgtctaccctgtctgtacttgcttcctatgcaatgttcatcactttgtaacctcactgttatcacttcaaaagagtgtagttttgtttgttttgaatcagggaaagtaaacttatacctcaagtcagtcaaaagatgagaaaaaagaacaatgaagcaaaacttttttttgttttctgaagcaaaacactttaaaatcttgtttgactcaattctgtatgtttaaattacgacttctatggataaaacaaatacttctgaagtagaaataccatccttactgtttcctttcatcct

SEQ ID NO: 485199 - DNA, 220 bp, Homo sapiens
aaaaaaaggggccctttttttggaaaaaatgggggaaaaaagcccggggttttttcccccaaggttagggggttttttgtaagggcaaaaaattttaaaaaaataacccgccccccccccccctttttttggggggggatgccccctttttggggttttttgtttccaggggggccggccctgttttaacccggaaaaaagggggttttttgttttgcca

SEQ ID NO: 485200 - DNA, 286 bp, Homo sapiens
tttatagctacccgctgtatgggctctccttcctgcaccacgcctgggaggtttcgggctcctctgtgggcattccatgcctgcaagctagacggtcataggccagtttcctttggcacatagagtttgagacgagaaccactgaagacgtattccaccactagcttcagaatcgatcctgcccgctggtagaacaggctgtgaactgctttgctttctggggtatccccagatatctcctgcaacacggtggacttgcgcacttcctgtcttgctcatgctatcc

SEQ ID NO: 485201 - DNA, 309 bp, Homo sapiens
  misc_feature (83)..(83): n is a, c, g, or t
aaaaaaagggggggtttttttaattgatgttttttatgaaagcctgaaaagccaaggttaaagtttccccttttttcaaaaanggccctgattcaaaagcctcctccctctttccatggggaaaattggaaatgatgccccccctttccccccaaattttaaggggtcccgggcaaagcttttttgttgggaatcagctgacccctgcaaatgtgttttttctcccaccccttttagttttaaaaaaaaaaattcctaaaatcccgtttgcctttcctttccccccgggaaataaaactttgtttttga

SEQ ID NO: 485202 - DNA, 387 bp, Homo sapiens
  misc_feature (43)..(43): n is a, c, g, or t
  misc_feature (338)..(338): n is a, c, g, or t
  misc_feature (344)..(344): n is a, c, g, or t
  misc_feature (350)..(350): n is a, c, g, or t
  misc_feature (359)..(359): n is a, c, g, or t
  misc_feature (373)..(374): n is a, c, g, or t
atagaatcacagatctgagagttgaaagaccagcactggtcantcgggcccaccctctccagtgccctaggggaacatgccagtgcagttccagtttgcctttgttaatagggccaaaaaaagtctgaggcttggcttccaaggagtattagagttcaacaaattctcattctcaataggcaggcgtgaaacactcttaacccttggctcactccaccagcacatgtgtttgaagccccttagtcttcactaacacactttctaaagaagtagaaggaagttgtgatatcagcactgaagggtggtgaggaaaaaaatgggtgggacccaaacaccantggganggaagntcatggganagtatttgactccnngaacattaacaag

SEQ ID NO: 485203 - DNA, 123 bp, Homo sapiens
caatcgctctagctcagaagtggagtgagcctgggcaacatggtgaaacccgtctctaccagacaaaaagcagccaggcgtggtggcacatctgggtcccagctacttgagaggctgagccag

SEQ ID NO: 485204 - DNA, 954 bp, Homo sapiens
gatccctcaaaacaataataatttagaaaacctaataaaccctggagctgtaattcgagcgtagggccaccagatggcagcggagcataagtcacaggctccgcgctgcaccggaaagaagcgccttgctagatcctgccgtggggaagaagggcccggagtctatacacgcgggtatagactgcacaacagattgaggaggaggctcagctcagacggctaagccgtttattctcaatcacgtgagtcgtcagtagcaggaggcggacctgactcaggcctgctgagcgctcaggctacctccagggatgtggaaccagacagctccttgttcctgacccaaagacggctcatctggatgtttaaatgtcaacaatattggcctctacccaaagctttaagtggaaaatctcgaatatttctaactgattcctctttcttctgccgccgggccctaagcccgcagggcccgtccgctgtccttggaaatgcctctacaaaaatccccgccgcctttctgttcaataacgtgacgttagccacatgctcgctagtctcagggattcagaaatgtcaactattctctcctcctttaaagattttttaaagggtaaccaagtccaggtaaattttatctgaaggaattcttaacttacaggaacttctaaagctggtttatacccaagttagagtagaaaggtccctggatggctcctgttggactggcagggaaagttctagcacgcgtgtcttcttgctctagcctaggtgggtatttaactcagatggcccgagcccagtcgtggagtgtcaagccacaagtgtgaggctgggcttgaaggtcggagtggcccagactggctgggcaccagcggggtttaaatgccggtccaatgtccgcagggggaggagtgaacccccctggacgaggtaactcaaaggcgggcacaagtg

SEQ ID NO: 485205 - DNA, 1664 bp, Homo sapiens
  misc_feature (365)..(365): n is a, c, g, or t
  misc_feature (473)..(474): n is a, c, g, or t
tcctggttttcaagccaatattactggcttacttttcatggtttcaaataacccaaatactataatttaagcactgggtaaattatctgggaatttccccaatgtgctttagttctccgtggacctctcttcttctccccttttcttcttctttataattgagggcctatagggtggctcctcattcttcattcttcgtgtggactttttaggtgccatctcacatactgtggagtgtagtggggtgtttctcttgctcctttgaggatctcccatctcgtatctctataaacttctacagtgtgtcttatgtgttatttctcacactatatccctatatgtgtcatctctatctctctccccancttgtgtgagatatattttataactataggaggaaaactctccaagaacttttataacacgcccctgtgtcaaactgtgagggctctcccacaaaacagtgtgtgtcnncccacaaaacgccacacaaaatctctgtgggtcgtcccccacaaatttcatcagcggtataatttctccttctcccttctcccacatgtgtggctctcaagatctcaaagggttattttgtgagaggttatacccccctgtgtgaaatatttctctctctataattcctataaaaatctcccccacatttcgtgggtctcctctctcgaaactgtgtgagtggtgcgttatgtgttaaaaaaggtgtgggccctcccaaaagagatgattgtgtgcccctgtgttttagggaaaatctcccgcgtgggaaaacccttatgtgaaatttattgggtcctctctgggcgctagtggcccacaaaagagggggggaatctctctcacacgaggtagtgtttgctcttcacatctttcatataaaacctctgtgagagatattggggggaaccgagaatattaatccccgtgggggaaacgaatcccccttggggtgtggaaggccccccaatattccttaaaattctcactcgtgggaaggttctttcaaacccaatattccccaggtaggggaacccccttctctatagggccccaacagtgtgtcccaggaggcggcaactacattttcctgcggcattctacttggggcacaagcgggggcaacacggccggaaaagggggaaaagaaaagggtgttccccctccctcaaggggagaggcccagtggaaaagaagtggttcccccccccctgtattttcttggttcgctttctctcataacccacaacgcacactgttgcttgttgctgggtcgccccgaaagagggccctacagggcccaaggagccccacaaggccaatttggggaaaagaagccaccgggccccaaggagagacatgtgttgcgcccatttttgtcgcgagaagaaaagggcctcgcttgggggggggcccagcgatgaggtgagggaatgtggcgcccgcgggaaagaaaaacaatccctgtggtccgttaccaaacccagggcggggccgctctaagcccactgattgtagttggtgttgtgtcgccacaccagacacaggaccactgactcagaggtggccgatcagcaagacagttgtagcccccctcattaatagagacccaacctagcgcgtgaacaacagttgcatagtagacactcact

SEQ ID NO: 485206 - DNA, 183 bp, Homo sapiens
  misc_feature (65)..(65): n is a, c, g, or t
  misc_feature (69)..(69): n is a, c, g, or t
  misc_feature (122)..(122): n is a, c, g, or t
  misc_feature (157)..(157): n is a, c, g, or t
ttttctaatccttgttagactactgatttaaagaaggaaaaaaaaagccgaactgctgtagagcncacntcagagtttagttttataataaaaactggtttgaataattagacctttacatncctgaagataaacatgtaatcttttatcttatttngcgtcaagtaaaaattgttcagaaga

SEQ ID NO: 485207 - DNA, 119 bp, Homo sapiens
gattggtggggaacatcccatgagcctttgtaggatcttatcctcttaggtactaatactgcgagctgtggcccctctctaccataaatcctgtttaatactagctggattcctctaag

SEQ ID NO: 485208 - DNA, 565 bp, Homo sapiens
  misc_feature (261)..(261): n is a, c, g, or t
ggtgaacaacgcgtatggagtaacatgtacggaactagctccaagactcacacaactgccgttcacacacatcactattcctaaggcggtatccgttcccctccactttaaaaaccttgtgatcatgatctcatgtgggatgctggagcatctgcagctcattccactttatcaatcctcttgatgttatgttgtgggtattaagctaagcatgtgacccgataattacttaacccaaatctctagctatgtacgtgatgngtaacatggtgaattctaccttaaagaaactggggcttagagcagtgcagtgactttccctaggttattcatagagtaggaatagaattagaacagagactgagatctgcccagcaccaggctctgtgcttcccagcttctgcttttgcctggctccttctgcttgcctgtgggtgagcgctcacaaaagcagaagggaaaaaatcacacgctacagcataactgagccaatgctgagaattacaaaatttaaagggaaatttaaaagacatttaagccaacccctctcacaacaagagaatca

SEQ ID NO: 485209 - DNA, 847 bp, Homo sapiens
cagtatgcatcacagaataaggagttggccgtgtaaggacaatatccccattcgtcatgctcttattttcccgtgggatattgcatacaaatgcatgtctgttaccaaaatatgtgtaacacagacagaaaccacctgtattgtctttccttgtttcccttaatatgtcatgaatgtctagcaaaaatggtaggatgcttctgtagttcacaagtgtgacatttcagagactttagaggaaaaatgatttgaaataagctgtcaactgtttcattgcttttgtacatttttgccacgtgcataaccccctttagaagtaaatttttacactattgggtgtttacaaggaggcatttctacttccttgagttagctgtgccaaactaaaacatttcccttggaacatgagttataagtgattacttttcctttagatgtatacacttttataaaaatcagatttttcagtggtctctccagatataagcaagaattgtgtgtaatcaaagatgcttttatagacttgatgtcacaatgcttaagttcacgcctttcctatcaatcacaaatcatgtatgggaactcaataaatggaaccaaaaactgggtttcacaaaactattgttggatatccatcgatgtgcttgcacactatatatcgagtgactttctggacaagtttatccacggacacatccattggccaaaaaaagattgttcaagtggccacctagctcctcacaaaggggggggaaacgcacatcaacgggcttagacatgtaagggacggcctggacactgtggtccgttacttattaactctgacgcaagactcggaaaatccagg

SEQ ID NO: 485210 - DNA, 166 bp, Homo sapiens
tgatcacaggtattattattggctcagaagtttcatttgtggaaaaaactaaagattcttggttatatactggagatgatgattcactatcgttctcctgtgtttgaaatttgagatctgaggccgggcgcggtggctcccgcctgtaatcccagcactttgggag

SEQ ID NO: 485211 - DNA, 146 bp, Homo sapiens
cagtgaaaccttgtcagcagcagtgtggtcccttagccccacaggtcttgtctgcctgcatttggacatcagccaaatttgggcccgatcaactataacgtgtatgacactgaaattgttttgactcaataaatgtataggcttca

SEQ ID NO: 485212 - DNA, 95 bp, Homo sapiens
  misc_feature (3)..(3): n is a, c, g, or t
  misc_feature (5)..(5): n is a, c, g, or t
  misc_feature (21)..(21): n is a, c, g, or t
  misc_feature (23)..(23): n is a, c, g, or t
  misc_feature (41)..(41): n is a, c, g, or t
tgnancctcccgctttgccanangcccctccggtccagcgnactggatgctccgcctatctaaggtcccagtggaagttcttccaagaggatata

SEQ ID NO: 485213 - DNA, 135 bp, Homo sapiens
ccatcgagatgtactcagagaaaatctctgtatgagagctttgtgtcttctagtgatcgattcgagaactaggaccatgatggagaatgaggcagagggcccaggtgtgtggtgatggtccccctcgaagctttg

SEQ ID NO: 485214 - DNA, 174 bp, Homo sapiens
gggtgatctagcggatcccttgtactatgtacaactatagctacttgtataaaatgtactctcacctacatgctagcatgattcattttttttttccaggaaacagaaaatgtcttggtcgggtattaatattcaaaagaatttaacttttaaaaactgatccccaataaagca

SEQ ID NO: 485215 - DNA, 712 bp, Homo sapiens
gtgcagtcacgggggagcgagggctgctgtgttggcaacgagggactcggctcgtgagggcgacccagaccacacagacactgggtcaagggagtaagcagagtgaataaacaactggaaaggagagccaagccacaaaagtcatcatggctttcagacgtctgacttcgttggaaaacccaagattaaagattgcccatttttcccaacccaccaaagccaaagcaagaagccctgttgtgttttgggtccaaaaaaatcaaaagaatgcaccatttccacaatgatgccaggaggattcttccaaagaaggattttattgcccgaagaacttggttcagggacagaacagggttttcctggaagcagaaggctctgtgccttttatcctcttgtggtaaagcagttgcctttgtggtcaaccccccaaggggaacctaggttcattacccaaagggtttacttttgtgggcgaggctaaatttctaagaattgttgggattcatttgcccaaaaagttttgccactttggctggggtctcctgtgggagaattgtgggcccttgggaaacgggtattcattacataaggcgcacgttattgcccaagagtaaaattcccaatttttttttcgaaggattccaagacttcccggtgggggcgctggggtttgtggggtcccaaccaatgccattaaacacagggcacaact

SEQ ID NO: 485216 - DNA, 934 bp, Homo sapiens
  misc_feature (452)..(452): n is a, c, g, or t
  misc_feature (455)..(455): n is a, c, g, or t
  misc_feature (613)..(613): n is a, c, g, or t
  misc_feature (712)..(712): n is a, c, g, or t
cccggagcgagcggatgggagccgccacctgtaggggctccaggatccccagcggccccccagtccagggggaacgcagtgcgccccgcttcggtgttacttccctcagcctgtggccagcggacttcaaggataactggaggattgccggctccagacaggaagtggccctggcaggtgagcctgcagaccagcaacagacacatctgcggaggctcccttatcgccagacactgggtactcactgccgctcactgcatctctgggtgagggtttggggctcagagcttgggccctgatcaggctgtgggacctggagccagtctgtccccctccctgaacttcctcttcctcatctgtaaaagggggtgacagccccatagtttttatccagtctgggtgagacctgaggatttgtatttctaacaagtttctgggtgttgcctccgccnctntctggggactactggctaaagtggtcagggtcctggagggatgtggcttggagagagggaggtagctgctggctggcataggaagatggtaccaggcgggaagcacctcgaaggtgtggaagcagagtgtagaccctggaggatcttcctgcagccanctggaatacacagtgaagctgggagacacaaatgtgcatcatcgctccaaaacagcacttgtggtcccagttcgtgacgtcgttatccaccgatatttnacgtctcctggaataattgaaaatgacattgcccttgccctgcttgacttccctgtgaattactccacgcacatccagcctgtgtgcctccctgaacaggctttcatggtgcaagctggtacgaactgctgggtgaccggatggggcaaagtaaatgaaacagattctcaaaccaagagtaattgtgaaactctccagtgcgctgggaccagggaaccaagg

SEQ ID NO: 485217 - DNA, 323 bp, Homo sapiens
gctacgacagccactgtgcccagcccctaccagatgtattctaagtggccgagtgcagtggctcacgactgtagacccagcactttgaggggctgagatgggaggattgcttgaatccaggagttggagaccagcctgggcaacatggcaagacttcatctctactagaaatcacaaaaattagctgggcatgtgtcagaagtcccagccacttgggaggctgaggtgggagagtcgcttgagcctgggaggtccaggctgcagtgagccattatctcaccactgcactgtagactgggtgacagagcaagaacctgtctcag

SEQ ID NO: 485218 - DNA, 584 bp, Homo sapiens
agcaaatggaaagatatcctatgctcatggcctggaagaattaatatagttaaaatgaccatactgtcaaaggtaatctgcagattcaatgcaatccttatcaaagtaccaatgacattttttgcagaaatagaaaaaacaatcctaaaattgatatgcaaccacaaaggaacccggataaccaaaccaatccagaccaaaaagaacaaagctggaggcatcacactacttgacttcaaaatatattacaaggctatggtaatcaaaacagcatggtattggtatgaaaacagacacaaagaccaatggaacagaatagagaacgcagaaataaatccacatgtttacagacaaaactgattttcaacaaaggcaccaagaacgtacgttggagaaaggacatcctcctcaataaatggtattgggaaaattggatatgcatatgcagaagaatgaaactgcatctctgtctctcatcatatacagacatcaactcaagatcaattaaagacttaaatgtaagatctgaaactataaaagtactagacaaaaacctgggggaaacactttagtacattggtcta

SEQ ID NO: 485219 - DNA, 261 bp, Homo sapiens
aatgcagtggaggtgaccgggaccgagctctcatatcctgctcggaacctggtgaccacaccatgttggctgcaagagtggtgtgtctccggatcactatcttctagggttggcacgccagatttcatccgaaggatctccgcatgttgtgaagaattccatcacgaagaatcaattggctgttaacaagctagcaggtccctcccccctacatccctccttctcgttttcggtttttttctcttattatatactaatttt

SEQ ID NO: 485220 - DNA, 279 bp, Homo sapiens
aacgggtgatgcggttggcttcatagcaaaagctaactgatatacaacttttctttttctgggttttttttatttcctgaaaagggcctggtgttcaccttgccctcaaggggggaatgccgtagcacaataataactagctgaccttggaaactcgggggtaaaagaaatcttttggcttaagctttcaaggaacttgggcccacgggggggggcccccttccctccaaatggttaaaaacaaattttttaaatcttttttaagcttttgggtaaaaa

SEQ ID NO: 485221 - DNA, 157 bp, Homo sapiens
aaccccccgggggccctttgggggggcccgtttaattttttttttacccctttaggggcccagggggggattttgggttgggtttttttcgggtttcccccaaccgggggtttttttaagttttttttaaaaaaggggggattttttccccccccca

SEQ ID NO: 485222 - DNA, 778 bp, Homo sapiens
cagcatgcccttgcccgcgccagatgaagcctaagacatgagaggagagaagaaataaaagcggcatgtagtttgcaaatcaggtcatttaagaaccggacagatgagctcccaggaggcaggactcctcagccagaagattagcttcagacccctgacacatttcccaaaggaagaaaggagaaaaaagggcatcatcccccttccgaagggtccgggaggaggaaattgaggtgggattcacgagttgcggaccactccctttgatcccagcgaggtgccaacccggagactggggagagcgagcccatcaggttttgaagttcacccaaggccagtcctttcggcatgagaaacccagaagaagcggggccagctacccgggaggctccatctctgtcccaggtccaattcttattaaggttgacagcgagtgacctgagacccatcttcggtgaagccagggtgatgatcggagactacttactttctcccgtggacctgggaaccctcaggtctctaggtgagggtcttgatgaggaccagaagttttagagtaggtcctaagactcttaccagtgtaaccatacctctctggtccctttctgtgttcctagattttgtacagacttgtttttgagtgttgagtagcacgggaccaaataaggggatgttattttttaagaaacattcattttcattgttgtctccttccttttctgtgaaagtcctcatactgagaaatttgtatattttatattaaatcacttactattga

SEQ ID NO: 485223 - DNA, 596 bp, Homo sapiens
ctgaggaagacccggaaacttaggggccacgtgagaccccggccccggccgcatatggccagcacccggaagcacccccggcggcacccggtataatgtctggtgtgtctgcagtcacccacccggattccacgttcgacccaatatccacccccggctaactcttgggaaaatgtggtatgaagcacttagccaccttataagaggaaccacgagctttctgcccacaactgtcacacccttgacccaattttggaatcttggtcacgtgaaccacgaacaccgggtgaatgctgctaaaaacccagacttggggctgctgcccactcattgatgtggtgcgatcgggctactatgaaagtttctgggaaagggaaagcttccccaagcagcctgtgcattcgtgaaggcccaatttctttcagcagaagagactgaggagaagattaagaattttgggggggcctgtgtcctggtggcttgaagccccctggagggagtttccttaaatgctaactaccttatgaaagaaaaataaaaaaagactcgagcataaatctcggtccgagaagagatgatacctcccttttctgtta

SEQ ID NO: 485224 - DNA, 243 bp, Homo sapiens
ggacccggaagggtagctgttactgacttcatcctcctatttagaagttgaaagagatgcatttactgttgtggaacaagatgtgtccttccaccggctgtttaattgtcatgataacagtaatttggttagaagaaggtgctctgttaaccatttgccaaagagattgtcataattgtacaacttttcccaagtgcaagggctcagcatgattataataaaaaatatgacaaatgtttcaca

SEQ ID NO: 485225 - DNA, 1009 bp, Homo sapiens
  misc_feature (38)..(38): n is a, c, g, or t
  misc_feature (70)..(70): n is a, c, g, or t
  misc_feature (78)..(78): n is a, c, g, or t
  misc_feature (95)..(95): n is a, c, g, or t
  misc_feature (116)..(116): n is a, c, g, or t
  misc_feature (157)..(157): n is a, c, g, or t
  misc_feature (186)..(187): n is a, c, g, or t
  misc_feature (203)..(203): n is a, c, g, or t
  misc_feature (220)..(220): n is a, c, g, or t
  misc_feature (224)..(224): n is a, c, g, or t
  misc_feature (231)..(231): n is a, c, g, or t
  misc_feature (233)..(233): n is a, c, g, or t
  misc_feature (235)..(235): n is a, c, g, or t
  misc_feature (248)..(248): n is a, c, g, or t
  misc_feature (252)..(252): n is a, c, g, or t
  misc_feature (254)..(254): n is a, c, g, or t
  misc_feature (261)..(261): n is a, c, g, or t
  misc_feature (266)..(266): n is a, c, g, or t
  misc_feature (268)..(268): n is a, c, g, or t
  misc_feature (278)..(278): n is a, c, g, or t
  misc_feature (280)..(280): n is a, c, g, or t
  misc_feature (285)..(285): n is a, c, g, or t
  misc_feature (295)..(295): n is a, c, g, or t
  misc_feature (303)..(303): n is a, c, g, or t
  misc_feature (356)..(357): n is a, c, g, or t
  misc_feature (359)..(359): n is a, c, g, or t
  misc_feature (368)..(368): n is a, c, g, or t
  misc_feature (370)..(370): n is a, c, g, or t
  misc_feature (374)..(374): n is a, c, g, or t
  misc_feature (376)..(377): n is a, c, g, or t
  misc_feature (391)..(391): n is a, c, g, or t
  misc_feature (395)..(395): n is a, c, g, or t
  misc_feature (411)..(411): n is a, c, g, or t
  misc_feature (413)..(413): n is a, c, g, or t
  misc_feature (418)..(418): n is a, c, g, or t
  misc_feature (429)..(429): n is a, c, g, or t
  misc_feature (433)..(433): n is a, c, g, or t
  misc_feature (439)..(439): n is a, c, g, or t
  misc_feature (441)..(441): n is a, c, g, or t
  misc_feature (443)..(443): n is a, c, g, or t
  misc_feature (447)..(449): n is a, c, g, or t
  misc_feature (452)..(452): n is a, c, g, or t
  misc_feature (456)..(457): n is a, c, g, or t
  misc_feature (459)..(459): n is a, c, g, or t
  misc_feature (462)..(462): n is a, c, g, or t
  misc_feature (464)..(465): n is a, c, g, or t
  misc_feature (469)..(469): n is a, c, g, or t
  misc_feature (477)..(477): n is a, c, g, or t
  misc_feature (479)..(479): n is a, c, g, or t
  misc_feature (483)..(483): n is a, c, g, or t
  misc_feature (493)..(493): n is a, c, g, or t
  misc_feature (498)..(499): n is a, c, g, or t
  misc_feature (502)..(502): n is a, c, g, or t
  misc_feature (505)..(505): n is a, c, g, or t
  misc_feature (508)..(508): n is a, c, g, or t
  misc_feature (513)..(513): n is a, c, g, or t
  misc_feature (519)..(519): n is a, c, g, or t
  misc_feature (521)..(521): n is a, c, g, or t
  misc_feature (523)..(523): n is a, c, g, or t
  misc_feature (525)..(525): n is a, c, g, or t
  misc_feature (534)..(535): n is a, c, g, or t
  misc_feature (543)..(544): n is a, c, g, or t
  misc_feature (547)..(547): n is a, c, g, or t
  misc_feature (561)..(561): n is a, c, g, or t
  misc_feature (566)..(566): n is a, c, g, or t
  misc_feature (571)..(571): n is a, c, g, or t
  misc_feature (573)..(575): n is a, c, g, or t
  misc_feature (578)..(578): n is a, c, g, or t
  misc_feature (587)..(587): n is a, c, g, or t
  misc_feature (594)..(594): n is a, c, g, or t
  misc_feature (598)..(599): n is a, c, g, or t
  misc_feature (607)..(607): n is a, c, g, or t
  misc_feature (673)..(673): n is a, c, g, or t
  misc_feature (694)..(694): n is a, c, g, or t
  misc_feature (720)..(720): n is a, c, g, or t
taaaaattattaaacaaaacaagcaaaaaataaaagcnaaaaataaatgaattagagtgaaaaaaaattnaagaaaanaatcactaggtaagtangcaaattcttattctaaaaanacttctttaatgtgcttgaagcttcatgtatttagcaatantcttggcctcaatatctaccacctatttnnaaaccagacaaatttnaatgtatcaagaaaatnaggngcaaganantnacacccatatgantttnanccaagcnttgangnacattaagantnaaggnttataaaacncggctganttccatgcaaccagtaaaaggctttgcacatcatttgacagtagaaataaaanngnactaaattngnaaangnngcattgggtttgangtcnatgcgggtatatgggngngtgcnggggggggganaggnctgcgntngntctnnnggntaanngnggngnntgtntacaaaananttcnctcagatttngaaannganggnagngatanacagtnananangaggggtannatgggagnnggnacacagagaagganaaccntaaangnnngtnccagggtanagatatnaatnnagagtganttcgttagcaacacgtagacattcatacatatccggtggaagagtggtttctgagatgcgattgcnatccaaacgcaaatgcttgancttggagtaggataatggccccaggntcttgcagaagctctttatgtcaaacttctcaagttgattgacctccaggtaatagttttcaaggttttcattgacagttggtatgtttttaagcttgttataggacagatccagctcaaccagggatgacacattgaaagaatttccaggtattccactatcagccagttcgttgtgagataaacgcgatactgcaatgcattaaaacgcttgaaatactcatcagggatgttgctgatcttattgttgtctaagtagagagttagaagagagacagggagaccagaa

SEQ ID NO: 485226 - DNA, 763 bp, Homo sapiens
gggattggggctttctgaaagacagtcaagcgcggataatgcttactttctgtgttgaagcactgtggttgtggttagtgactgatgtaaaacggtttctgtggggaggttacagaggctgacttcagagtggacttgtgttttttctttttaaagaggtaaggttgggctggtgctcacagctgtaatcccagcactttgagatggctgggagttcaagaccagcctggccaacatgtcaaaactactaaaaataaagaaatcagccatgcttggtgctgcaaaaaaaaaaaaaaaaaaaaaaaaaaaaaacaaaagaaaaaaaataacaaaaaaaaacaaaaaacaaacaaaaaaaaaaaaaaaaaaaagagagagggggcggcgcggacgacgaaataaaatctctcctcagcagggggcgcgccacagtagcacagcgccccccggagtttttgttcgaaaacagaggggcgcctacaataagaaggacgagcgagtatatatacaaaagcgcgaacgcgcgcggcggcggccgcgtgtataacacaacacacaccagtcagcgaggcggggaggacaagacagcgagggagagtcggcgagagggccaccctacctgtgatcgaaggagagagaccgacccacacaccacctcgggcggggcgcggagggagagaaagaaaaacaaggggggggacagacgaccatactccacacaccgacggaagaacaaaacgacccctcgggggggacaaatacc

SEQ ID NO: 485227 - DNA, 125 bp, Homo sapiens
cagcattcagacaacaactggtacttataatcctgcaacacatacctaactttgaagatccatatacagccgctattgcttgggcgtactgaatacacaagcgcaaacggcattgccacaagcaa

SEQ ID NO: 485228 - DNA, 1316 bp, Homo sapiens
  misc_feature (372)..(372): n is a, c, g, or t
  misc_feature (628)..(628): n is a, c, g, or t
  misc_feature (829)..(829): n is a, c, g, or t
tccgctaaataggcgcggaccgctgagctagtccggcgtcatgaacgtggtctccggaacagacttctacccactctgagaaactgacttggttacaccgtctccacatctactgcaacggaatatagcctcgtacacaagctatccaaggatcccatacaaaccaataccacctctaaaagatctccgccaagatcagcgagatctaacctatgcaatactggagaaaacgagaaggacacgttgtagtcgcctctaaaccatgcggaaccaagggttgtcgaatacgagacaccttgcacgcaaccagacgtagcctaatgtagaatctgtgtgttctcctatcaccgatgactgtactgtagacgatangcccggctatcggcatcagtcttgtatatcctatatagtgtgaacctgtgcgttcaggactcacttctatgcgttctgcgactactgaagggattaactagctaggcaagcttactatccattctgaacaaacgatagttgactcgaatacaagcaagcaatccaggaaggtaactatctgaaaacgtgccttatatatgtggaacgtcacttccagctatgccgacgatggacgaaccttttcggaatttcaaanaagcgcctatgcttcccaaacgagaacaaaattgcggcagcaactaagagtggtggggtgagcccactttatactgggtgtaacccttgtcaggcccatggtcaccctcgcagttcgaacagaacatggagcgcggtttcactccggaagagaatactcgttgacatgcttgccgtgtaggcgcggaggtaatcatgtttncaacgctgcgtcacaagtaaaatggggtcacacgcaccttacgcacttgtatttgttcgtgtgcccaccctgagtgtcatccccgggttacatacacgtgggggtccgggaaccgccgtgggaacataggacactgtaccattaggcttaccgcagggaaatggaacatgctactggaacacacttttaggacaatgttgagttcaatttcaggggacccccgagactgtgaaactctgtgaggaggatagccccacatattgctagggttggaaagtaccttgcggattaacaccgtagtaacgggggcaacaggagaaatatcaccttccccccttggagacgaaaaatctgatatttggaaatggtgacctacatgaaaaacggtttgtttttacaattccatggagcttttaccgactccctgttgaacgaagtaagtcacgaaaaggggaaaccgggtttcacaggcttggggaaaaacttg

SEQ ID NO: 485229 - DNA, 276 bp, Homo sapiens
  misc_feature (125)..(125): n is a, c, g, or t
ctaggagtaaaacgagaatatgagaaaagagtttcggaccattgtagaacaaacgctggaatgattcataataggcaactggtctgttaatctttttcatcatgtgtgtgtataatttacctctncattagaaaggctaacataattttaagtgccacaggttttaagagattctgcaggacaaaaaaagaaaaaagtccttcagtttcagaacctacaaagagcttgtgtattcttgattaatggtatctattttattggcatgggtgtcgaact

SEQ ID NO: 485230 - DNA, 220 bp, Homo sapiens
tgtatggatgttcatgtggtgtatgcatcggggtagtccgacgtaccgtcggggcattccggatatggccgacgacacgtgtatgtgggacagacacacgttacgatttaccgccgactgaatatgatagtgacaatggactttggcgtaggtttggtctagggtgtagcctgagaataggggaaatcagtgaatgaagcctcctatgcggtaaaagctt

SEQ ID NO: 485231 - DNA, 193 bp, Homo sapiens
cagtaaaaggatcagtgggtgccaggggttgtggggagggaggaataaacaggtggagctccaaggattttttagggcaatgaaactcttttgcaggatcctgggatggtagatataggacattacacatttgtccaaacccccagaagggacaagactgatgaaccctaaaataaactgcagactttcctta

SEQ ID NO: 485232 - DNA, 1498 bp, Homo sapiens
  misc_feature (301)..(301): n is a, c, g, or t
  misc_feature (324)..(324): n is a, c, g, or t
  misc_feature (422)..(422): n is a, c, g, or t
  misc_feature (929)..(929): n is a, c, g, or t
gtcagcatacccagcatccacattaggagacttggacgcagattgacagggcctggaaaaagaactgagtaatgccagatacgaggcaccttggaacctcatgtgctcaatagatacgaaaggaagaaagtcagataggaagcgtatgtgcgtgcttctacacgttccactgactggcctgtgcatggtaagaacgaggctgcaaggtgcgagggcatggcgtgcagtatgtgcatgctctacgtagcatcaccaagagaaatcactaaacaaagaagtatgatacacgacaacgatgccntccacttagagatgcgtatcgcntggccatagactggacgagatcgtgggattttgaatttcgcatggacacatgtacctacttacccccgagccatgacttgtggacacccgacgcattnaatcaacccaaagggtagacggtacctataagcatatgctttcctgggcgcaaccacagagttgtcgtctttgccatgcgagccatatccccccacgggggtttccgactggaatacactttttcgaggggaccaaacgccagaagagaaagctagatccgagtttctgcctgggctaggaattagcttaaggcagatggggcacctcaggataagaatcggataccgggatgatcggggtcgtgctatacgtggtatgcggctctgttaacgaagagggcaaggcacgtacgcatcgagccctacgtgactcacgccgcaggtcctcgcgttgggaaaggctcttcccaaattgacaccacgattgctccacgcatgtaagcccttcttgaacgtaggaaggaacccaggaaaacttcctggcaaggggctggcgacaccgctggcgcacaacggggggctctcaccgcgatggatataaccgagcgacgcctcagggccttacgnaacacggaaaacggtctctttgtggcggaacaccgaaaggggcccttctgggaaaggcggggcgctcttacacatacaacgggtctttgggacacgaaccccctttgtgtaccccggcccctaattgtgggaaacggggttgggggggaacacctcgggcacaaagcgtcggttggcggaacacttttcgacttccaaccaagactggccgatttggccctttagccgttggagaggcccaacctgttgggcacgggggggtgcaacgaaccttggcaaggaccccgaggggagtggggcaacaacacccctttgggtgttagggcaacccttaaacccctaagaaaagaaggaattccctatagatcttcgaatctcgggcgcccaggaacatctcaaaccatcggggtggaacatttaactttaacttggcagcttccggcaaccctgggcttaaccgaagggttaaggcgatccaaacgtttgacccaagaaaggtggggacacatgttccactttttagagcgccttaacagtggggatctctccaccttggttcctttcctcta

SEQ ID NO: 485233 - DNA, 135 bp, Homo sapiens
tgctgtgtgtcctgtttctgtgtattgtgtgttttatgtgtgtgtgtgtatatctgtgtgtatatctatattagaatcccagtttttctgaggcatgggaaagttgagagtcactgatagggacatatggcgaaa

SEQ ID NO: 485234 - DNA, 333 bp, Homo sapiens
gagactgaatctcactccatcgtccaggctggagtgcagtggcgcgatctcggctcactgcaacctctgcctcccgggttcaagcaattctcctgcctcagcctcccgagtagctggaactacaggcacacactgccgcgcccagctaattttttgtattttttagtagagacagggtttcactgtgttgcccaggctggtctcaaactcctgagctcaggcaatctgcccgccttggcctcccaaagtgctaggattacaggtatgagccaccatgcccggctggcagttgtattttttaaagcccttctgtcgtattctcgccgccgtata

SEQ ID NO: 485235 - DNA, 328 bp, Homo sapiens
  misc_feature (253)..(253): n is a, c, g, or t
gggaaggtaggtcatgggcgggaccggacgctgcggctattcttgagatttaccacgtgcgttgcccacgagatgtgcaatttgccaatgtggacgatgtataaccgggtgcccaatggcgccttagcagaggcttgagccgtgtgatgggaaactcgcatgcacggctcttagggggttggacgcgggcaaccgcgtcagactacccgacaaccagatccggccatgggctcttgggcgcaagaactggctnttcgccgggtcgctacgcagcggaaaacggggtgcggcgatcatgagcttgatccagtcagcgcggctgaatggc

SEQ ID NO: 485236 - DNA, 344 bp, Homo sapiens
  misc_feature (215)..(215): n is a, c, g, or t
  misc_feature (252)..(252): n is a, c, g, or t
  misc_feature (261)..(261): n is a, c, g, or t
  misc_feature (264)..(268): n is a, c, g, or t
  misc_feature (272)..(272): n is a, c, g, or t
  misc_feature (274)..(274): n is a, c, g, or t
  misc_feature (278)..(278): n is a, c, g, or t
  misc_feature (296)..(296): n is a, c, g, or t
  misc_feature (301)..(301): n is a, c, g, or t
  misc_feature (310)..(310): n is a, c, g, or t
  misc_feature (329)..(329): n is a, c, g, or t
aagatgccctaaggctttttcagactggtcaagaaagagctagacctggtgcttggagaaaagacatctttggaagaatcctctggcccaagttcaagcagtgggttataccttggcccctaaattaaagatacaataggaaacgattttttgccttgccttatgtggacccttttttcagactggaacgtgagaaacgagcccgcatcaaagcncggaaggaaaatttagagagaaagaaagcaaaaattnttttaaaanagnnnnncatntngctnaagcccaaaagtcaagtnttgtntaagatgtntgaactattaaatttaccnttttgttttttttta

SEQ ID NO: 485237 - DNA, 688 bp, Homo sapiens
cgttttcgttcttcaatcaggtatgtgccatagaggaaaataaagtagagccaccccctgtaagtccttggaacccagatgaaatgtttaaaagaacctggcaatatatgtaatccaggttcctggcccttgcatattacggtgggatatacaagagctgataaatagtgcatctgttttaagcgaaatggaaaggtgtttgttaattaacgcacatgcacaccaaggtgcgttctttgagtgtacatgaatctgcgatcgcaaaaacattttcttaagtagctaagggtgaacggtttgggctaatcatctacctaagatggtgcacgaagggcagcttatacacgaatgaaagcggtctacctgatcactatgggtggtacacaggacttttcacgatcaaatattggagcagaggtaagccaaaaatgcatgccctgtgcgccccccgggtttaggattaaggaagcaattcctagctgcccaaacggagatcgttaggtaacgtcattaacccgctgccaagcatataaaatgggaaggataaaagggagcgctggagggtgcaagttttatcagctacccgaaagaatgagggaggtgaaacgctaaaacccaggagtttaaggttacagcgggtcaagaaggcgccacagcagtccagctagggtgactaaggcaaaactcc

SEQ ID NO: 485238 - DNA, 211 bp, Homo sapiens
gtcacgaggatctccgtatctctaacattatgtcggggctagttcaaaaccacgtaatgaaaaagtcagttttacaagcctcattctagtgtatctttctatttgatcatcacattaacgttaaacattggcttcaattatttaattcatgaggatctttcatattaaaatttcaccttccgattcacccgccaggtgctttaataaagga

SEQ ID NO: 485239 - DNA, 291 bp, Homo sapiens
actaaagcagcagcctaaaatcgctcattgcatactcttcaatcaggcgataggcctcgtagctccagtcattctcatcagataccgccgttggctgaccggcgtctgtcattctcataatcgcccacggacttacatcctcattactattctgcctaggcaaactcaaactacgaacgcactcacagtcgcatcataatcctctctcaaggacttcaaactctactaccactaatagctttttgatgacttctagcagtccttctaacctgcctgggacacgaatgttca

SEQ ID NO: 485240 - DNA, 334 bp, Homo sapiens
cacctcccatagttctgccgggtgacccattcctttgggtgaagccccacccccgctcaacgcaacttgtgaacaaccacatggcaaatatggctctaaagcccggctgagctgacacacatctggttgttgttggtttgaaatcctctcacagttagatgatctcaggtcactccaggccaaagcttgatcatgatcacacccggcgaaaaaacagtctgaatcctcgaaaaacctggcccgcacaccaggtctccagcagtaaccagtttcctctggaagtaagggggagccagcttcagccccagtgttctccccatagtctaaacaccga

SEQ ID NO: 485241 - DNA, 127 bp, Homo sapiens
gctgtgctacctaattgcttttttcttttttcctttccaactttctgtttcatagaagggagtggggctggggaaagggctggctgcaattgcagctcactgctgctgcctctgaaacagaaagttg

SEQ ID NO: 485242 - DNA, 1384 bp, Homo sapiens
tggggggggcgcacgaggagacaccacccccggcgaaaaaaaacaccacccccggcgggattagccaaaaaaaaaaaaaaaaaaaaaaaaaaaaaaaaaaaaaggggggggcgcacaaaaaacaccccaggaggggcacaaagtctacagcgggcgcccaccactagttaggagagaagagggggcgcgcccccacacaagagagggagagcgctaaacaaacaaaaagaagagagagaggagggcgaggagcagagcaccacacacaacacgaggggagagaagaggagagaacaacgcgcgcgcagcacagcgagcggagaaaaaaagcgggagagagagagaacacacaacaaacacgcggaggggggggggagcacaccaaagaggaggggacaaaacaaaaaacacaacacacacagagacaaacaaagacacacaaccaccgagagagaggaagaaacaaaacaaaacaaaaacaacacgcagagcgcaggagacacgaatagcgcggcgtgtggcacaaccacaaccgaccaccgacgacagacacaaaaaaagaacgaagagaagacagcggaagaaagagaaagaaaaagagcagcagcgaagcacaagagcgaagagcacacaaatcaacacagagacagcagcaaacaacacccaacaccacaacccagcagacacaaagaagaaaacggaagagtgaaagaagaaagaacagaaccagcagagagagacgagaagcgaccagagagcagccgaccgcacacaaagagcgcaccgaacacaacaacacagacccgaccagccacgcgcaggcgagcacacgacagcagaaccagagcaacactgacgaacgacagacagacgacagacaggaaaaacagagaagacacgagcaaagacacgagagccgaaaacgacgatgcagagaagcagagcacagcggagcgatagaaagcaaccacgcacacagaagggaagagagaaaagagacagcaaaaggagagaaacaggaagagagaaaagaaaacgagaacgaggaacagaagagagaacaagaagaaagagcaagacgacagaacaagaagacaaaagacagaagacagaacaagagacggtagaaaagccaccgcacaacccacacgaacgcgcacgaaggaggagaggcagcgaagacagaagcacgcgaaaagagagcaacaaccaaagcagaaaagaaaacagaaaagaacagacgaccaacaagcgataaaggacaaggaacggaagaggaagaacgacacaactcaacagaagggaagaaaagacgacaagagaaggaaaaaagaaaagcggcagacaagaaagacgaagaggagagacaagggcaagcgacaag

SEQ ID NO: 485243 - DNA, 707 bp, Homo sapiens
gtaccaatcagtttacacaaggtctctgcagtctcgaaaactagtgggcacctctggctttagcaaaggcacttacagccaggtcacatgcctcagtacgctctgcagcaggtgcacttacagagcactaatgacacacagggaagccaaggtttcctctaagaaacagaacatggccgggcgcaggggctcacacctgtaatcccagcactgtgggaggccaaggcgggcggatcacctgaggtcaggagtttaagaccagcctggtcaacatgatgaaaccccatctctactaaaatgcaaaaaattagccgggcacggtggtgcacccctgtaatcccagctactggggaggctgaggcaggataatcactcaaacctggaaggtggaggttctgctgtgagccaagatcatgccactgcactccagcctggcgacagagtgagactccatcgcaaagacaaaaaacaaacaaaaaaaacgacagcctacagtaagtcttacctcggctctcctgccctgggagcaggaaggcatctttccgtggcaaatagcacccgtcaagaccccaaaccttcctctactgcagcaccccagggaatttcacagctgaaaatgctttgtgccgggcgcggtagctcatacctgtaatcccagcactttgggaggcaaagcaggtgatcacctgaggtcaggtgtgtaactg

SEQ ID NO: 485244 - DNA, 299 bp, Homo sapiens
cgccgtacttgatgatcagataaacgcgtccaccagttcgccgtagatatccagctggacctggtcgaacgcttcgttgcccacccgcaccggttgggcgccgccgtggccgctcaagtggtcgagggtggtttccggcagttcctggcgaccgtcgatgccgtacaggatgttgatcttggtcggctggccgcagcagtcgctgacccggcccctgagccagcgcatataggcgttggcttcctcgacgaaacccaggcgcatgaacgcatagacggtggacgaggcgtccgtagcgg

SEQ ID NO: 485245 - DNA, 250 bp, Homo sapiens
gggggaaaatttttttaaaaattgggggcccccaattgtttggcgggggccctttttttcaaaacccggtgccccaaaaaaaggggttttaagggccggcccccttgggttttaacttttttttttaaacctcctcccccccctggtcccttttttgacccgggttggttaccccttaattaaccaaccccggggcctcccccccttttggctttttttaaggggccccttccgtttttttggggaaaga

SEQ ID NO: 485246 - DNA, 772 bp, Homo sapiens
tgtggagtagggagctgtctcccctgagagtcgcatgcaggcgtctgcagcccaggcctctggcaacagctctttgcccatctctgtggacagtggccatcgctgcacaatgggggcgacgaggtctagggccctcctacctgcttacaatttggaaaagtgtggccgggtgcggtggctcacgcctgtaatcccagcactttgcggaggcccaaggccagcgtatcgatcgctcggcagcccgagttaagtgtctagagagcagcccagggcaaactattgattgacgacccctgtcatctgcgcaaaaacattgtctgaaacttatatagcctggcgtggtagcggcacggccttgtggctcccagcatgcatggggaggctcgaagtagtggagtgatctagttatgctctgggatgccgtcgcagtggcttgaagccgtaagctcagtagaatgttgttagtcgcatcatgctagcgtgcgcagccctggggttcgacagagtcgaggcatgcctgggtttcccaagagacatgatagaacagcctaggcgcataagagaagtggaaaagataatgggacttgtagagctctccatggattccagtcctagcaaggaaagacgacgaactcctgaagattctccagaaagtcgcaacaggaaccagctcacaaactcgtggaccaagttttctctagaggggttctactaggaggaccctgcgaccttggtctaatgttggtggccctgcctgggccaatggcccttc

SEQ ID NO: 485247 - DNA, 267 bp, Homo sapiens
aactactactgtatcggtcaagttccacgggagggtctgatgtgaatcttacgtattgatagtactgggactgacacaacctactcggactccgagaaggaccgaatcaccatatacagagacaacaacacgatcactctgtatatgaacatgatcagagtgagagaccccgacacggatgtgtattactgtggaaaaggggatggaacgggagctatcgactactggggccaggtagtcctagtcaccgtatgctgagggagtgca

SEQ ID NO: 485248 - DNA, 743 bp, Homo sapiens
agcggggagtggcagttgtagtggccaaggtgcggttgtaggacccggagcagccggacatggaacaaccgtggccgcctccgggaccctggagcctccctcgtggccgagggtgaggctgaggaagagagtgacttcgacgtgttccccagttctccccgctgccctgtcagctgccaggcggcggcgcccagatgtatagccatggaattgaattggcttgccaaaagcagaaagagttcgtgaagagctctgtggcgtgcaaatggaatcttgctgaagctcaacagaaacttggtagcttagcactgcataattctgagtccttggatcacggagcatgccaaagcacaaacagcagtatcagaactgaggcaacgggaagacgagtggcgacagacaaaggacgcaagctctagtacaaagacgagacagatgtgtctgtggagcacggatgccattacgcacggcatgctttctaactaccggtatgagctttaactgggcccatacctgacacacgaggcaacacagactgacgtgtctgtacaaaaccagttgtgcgtattcggtagcaaagcagcagaatcccataacacacgtgttccaactcttggaccagtttactgacaggtggcttgacaacagttactgaacagtcaacaaagtctcaaaaggcctcgtggctggtagaactgccagaactccagggcagctaaagtgaccagactgaaattacattt

SEQ ID NO: 485249 - DNA, 308 bp, Homo sapiens
ggaccgcactggcgcactctgaagtggcctcatgtggcagagagaaagctagggagctctctgggttctcgtctcataaagacactaattctattagatcagtgcccacctttatgacctcatttgaccttaattacttcccataaatccttttttttttttttttttggaaaaaaagtctaactctgtaacccgggcgggagggcaggggattgctctcgactcagtgcacccttcggccttcccgggttcacgcaattctcctctcctcagggtccggagttgctgggactacgggtgcgcaccac

SEQ ID NO: 485250 - DNA, 169 bp, Homo sapiens
ccttgtgctggaactggcacaggccgcctctggctctcagcatgggaacctcatatgcaattgggatctactagtagcccaaaggaatgaaagagagctctaaccagatatgacactggaacctttccagtggaccccggacccttcccagggaaactggggacatagg

SEQ ID NO: 485251 - DNA, 390 bp, Homo sapiens
  misc_feature (127)..(127): n is a, c, g, or t
atatatattgagttatctatttggtaaggaatgttgacactttcaagtcttaatgagagggtagaatgtgcagtggctcatgcctgtaatcccagcactttgggaggctgaggcagtcggatcaccnggtcaggagatcaagaccatcctggccaacatggtgaaaccctatctctactaaaaatacaaaaattatctgggcattgtggtttgtgcctgtagtcccagctacttgggaggctgaggcagaagaattgctcgaacccaggaggtgaaggttgcagtgagccgagatcatgccacctgcactccagcctggtgacagagtgagactccatctcaaaaaaaaaagtcgacgcggccgcgaatttagtagtagtaggcggccgc

SEQ ID NO: 485252 - DNA, 302 bp, Homo sapiens
atgaagaaataagggtcaacctctacagtcatacttcttcagttccgtagcttagcatctgaatgggttgacttccacctctgccttcagccaggtgtctcttcggtctgggagaggtggttataaaatcattgtggttgcgggcaagcccttcaacccgaggcttcctggttccggttttccttttcctgtggccgcaaatggcccggggaaaaaacccccctttcaaggtcttggcttattgtgttcccttggggttttttgcggggggcgccgtccaaatcccgcgagttttctccccc

SEQ ID NO: 485253 - DNA, 223 bp, Homo sapiens
aaacgagaaaaacaaatcccacgtacggtgggctactcagagacaaggactgagtctcacttatcttagatttatttctctccccagccactgggcaaagaacaagaaggaaagggcacgagatgtgaatattcaccctcttgcttccctgtcattattattattattattttgagacagagtctcactcttgtagcccaggctgaagtgcaggaaacaacga

SEQ ID NO: 485254 - DNA, 470 bp, Homo sapiens
  misc_feature (203)..(203): n is a, c, g, or t
  misc_feature (211)..(211): n is a, c, g, or t
  misc_feature (215)..(215): n is a, c, g, or t
  misc_feature (221)..(221): n is a, c, g, or t
  misc_feature (224)..(225): n is a, c, g, or t
  misc_feature (230)..(230): n is a, c, g, or t
  misc_feature (242)..(242): n is a, c, g, or t
cgttcgtcagacaggaatatacttggggatctgccattgggtcagtcctctaggagtgggcagatcttgatcagtacagtattggagtgaggttacataattaatagtttttacatatagccgatttttttttttttggaaagcggagtctggctcggtcccccaagctgaagtgcaggggcgacgatctgggctcactgcancctccatntccnggggtncanntgatnctcctgccgcancctcccaagtagctggaactacaggtgtccaccaccaaacccagctaatttgggtatattcatgaccagatggggttcggccatgtgggccaggctgggtctaaaactccagacctcaggtgatcctctcgcctggcccaaagtcttggaattacatggcatgagccaccggactgggctatttataccaaatactagagcaaataataaaccctcctcaacgataac

SEQ ID NO: 485255 - DNA, 615 bp, Homo sapiens
caaaatccggtgggtgtttgtgtttctacatgaatttttggttcggcacttcgtaattcgtaatcaacaagtgctcaacgtctttatcgttacgatttttgaagttaacgagatatgacttgtcgaacgcattgagataaatcttttgaccatttgctgtctcttgatcagctggatagagtgatgaaatcaactcagtattcttgattaccaacatccagttggccactgattcattaatcaagtattgtgctagacgttcctgttctgactgaccaaactcgttgttcgcatacgttgagaaatccgtatcatacggagggtccaaaaagatgaaatcaccggcttcgggttggtgctcatgcatgaactgttcaaagtcttcgtttcccattgtggtattagtcagcaactggtgtagtttctcatcgttgaaatactcgaaacgcgactcaagcgtgttgttgttatatgacattccgccatatggaacattaaacttgccagttttgctgtaacggaacattgagctataagcatattgacgaatgaataagtatagtgctgccttgcgaccgtcactgaaattcaagtcatacatgcggttgaacaagt

SEQ ID NO: 485256 - DNA, 412 bp, Homo sapiens
tgaattcagtaaagtttcaagaaataaaaacatgtaggaaaataagtagcatttttatgaaccaaaatcatgcagctaataaccaaaccaagaacacaatccaatttacagtacccacaaagaaaatgaaatacctaggaattcatccaaccaaggcaggtcaaagaccactgcaaggagaagtacaagacactgttgaaagaaatcagagatgacacataaatggaaaaatatccatgctcatggattgggaagaatcaatatggttaaaaatggatatactgcctaaagcaatttacagcacttcaatgctattcctatcaacaatacccaattgccatttatttaaaagtcaacttagcacattacaacctcaattatcaaacattcaatctgggcaaccgacgaaaca

SEQ ID NO: 485257 - DNA, 320 bp, Homo sapiens
caggggacaatgccgttccttttttgcaaaattcccttaaatttttggtgaaaaacttgcccctcttgggaaccctttaggttttcccaataaactccccactgtacattttttaaacatttttttttttgcccccatgggttaatttgaaaaaccccctccgataaatggccccgtcctttgggtaaatttgtttaaccccattccttaactttggactggaaatggtgcttttttttttttaaatgggtttttttcccggggaaccttttttttttaaaaatgtttggctaaaataaaaacccccttttggaattgga

SEQ ID NO: 485258 - DNA, 136 bp, Homo sapiens
agtcacagcccctatactccctctacacattaaccacaacataagcggggctcactcacccaccacattaacaccacgaaacgggtaatctaacacgagaaaacaccctaacgttcatacaccccatacaccatta

SEQ ID NO: 485259 - DNA, 339 bp, Homo sapiens
gcggccgcctactactactaaattcgcggccgcgtcgacggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacgagacaatccagcagcccaggaggtcgacgcggccgcgaatttagtagtagtaggcggccgc

SEQ ID NO: 485260 - DNA, 134 bp, Homo sapiens
agtagagtagtacgatagtctacgtgatagagtttgataaatacaatgccagtcaggccacctacggtacaaaagaaagatgaatcctacgggctcagcagcactagcagcagcatcatttcatatatagctat

SEQ ID NO: 485261 - DNA, 361 bp, Homo sapiens
gtcagactgtcctagtgcaagctgtcatccctatagctcctggagcttatcctccacatgccccctggggtgactccttctctgatctcctcggcttggcggctgaggaatgacactgcccgaacacctcggaagccccatgaaccatcatggacctcgagtaactcttaaggtggactggtacgtccatcccctttaaagatctgatatagggggccactcactccatcctgccctcctttcagggacctggctccctagcctccattactgtcgtgggaattgacggcctatgcctccagatctctccagactccagttgtgtgtcaactagatcaggactccttatggcactcctttt

SEQ ID NO: 485262 - DNA, 655 bp, Homo sapiens
  misc_feature (456)..(456): n is a, c, g, or t
  misc_feature (459)..(459): n is a, c, g, or t
  misc_feature (471)..(471): n is a, c, g, or t
  misc_feature (475)..(475): n is a, c, g, or t
  misc_feature (530)..(530): n is a, c, g, or t
  misc_feature (577)..(578): n is a, c, g, or t
  misc_feature (587)..(587): n is a, c, g, or t
  misc_feature (609)..(610): n is a, c, g, or t
  misc_feature (623)..(623): n is a, c, g, or t
  misc_feature (653)..(653): n is a, c, g, or t
ctgcttcacgcaggatctgagtttatgggaatgctcaacctggaagccggaggttttctgcagattcgcctgccatgatgaagttattcaagcaagccaggagatctgcatgatgtctgcacccaaaattacatttatcggcgctggttcgacgattttcgttaaaaatattcttgggatgtgttccatcgcgaggcgctgaaaacggcgcatattgccctgatggacattgaccccacccgcctggaagagtcgcatattgtggtgcgtaagctgatggattcagcaggggccagcggcaaaatcacctgccacacccaacagaaagaagccttagaggatgccgattttgtcgtggtggcatttcagattggcggttatgaaccttgcacggtgactgatttcgaggtctgtaagcggcatggtctggaacaaaccattgccgatacgttgggnccnggcggtatgctnccangcaatgcgccatctgggtgccttcgatacccgcgatggagaaaataccggcctgntgacttcacacaggaacgcggttcttcgccaaagaggccgttacggnnacacgcagnaccacttcgtatacgtcatctnncagttgggaagangccgtattcagatcaaagttaacttctggntt

SEQ ID NO: 485263 - DNA, 964 bp, Homo sapiens
cggaggctctgctcggatcagaggtctgcagcggcagcttctgggagcatgagtgctgcagtgactgcatgggaagctggcacgggcaccggccgacctgggaaagccggggtccccggaggttgcagctccgcggagctccggggaggtccaccggcgaaatgagatcccggaggtcctagtggagccacgcaggcgggggctatgtgcggggcccggttattgggctcagggcggctttggcaagatgcttcgagatctcggacgcggacgaccaaggaggtgtgcgcgggcaagattgtgcctaagtctctgctgctcaagccgcaccagagggagaagatgtccatggaaagtatcctattcaccgcagccctcgtcccaccagcgacgtcgtaggattccgcggcttttttcgaggacgacgacttcggtgtcgtggtgtgggagctctgccgaccggaggtctctcctggagctgtgcaacgatggacggacagtcccgtgactgagcctgaggcccgatactaccgtacgggaaatgtgcttggctgcatgtaccgtgcaccgaacccgagttattcatcgagacctcaagctgggcagcttttcctgaatgaagagctggaggtgaacataggggatttgactgtggacaaagttgaattgacgggaagagagccggggggggacccctaatacctaggcaccgagggctgagcagaagggccggttcagggggaggtggggccagggggatacaaggatccgtagggggcaccgcattggggattggcaaaggacacgcggcacagagaagaagatcaggcaacgggaggcccaacagagagaagacgggcccaaagcgaggagacacgcagacgcggctacagaacacaataaaacgaccgacacgcatgggagagcgaaaaaagagagcgaccgtgctgctggcacaactgcg

SEQ ID NO: 485264 - DNA, 164 bp, Homo sapiens
attcgcggccgcgtccactttttttttttggagaaagggtctcactctgttgccctggctgggctccagcaatcctctcatcccagcctccgcttggactacaggcacatgccaccatgcccggccattatttcatgggttttttttttttctttttatgagac

SEQ ID NO: 485265 - DNA, 1291 bp, Homo sapiens
  misc_feature (756)..(757): n is a, c, g, or t
  misc_feature (1005)..(1005): n is a, c, g, or t
  misc_feature (1114)..(1114): n is a, c, g, or t
  misc_feature (1125)..(1125): n is a, c, g, or t
  misc_feature (1133)..(1133): n is a, c, g, or t
  misc_feature (1146)..(1146): n is a, c, g, or t
  misc_feature (1152)..(1152): n is a, c, g, or t
  misc_feature (1158)..(1158): n is a, c, g, or t
atatgttctcactattctggtggctggacctccaagatcaaggcattggcagatttggttcctcctaagacttctagagagaaggtaaccacctgcaagctaaggaaagaagtctgtgtcctcacatggccctttctctacacatgcacccctggtattccttccgcttcttataaggacgccagtctattgaattaagttcctgttcttatgactttatttacctttaattacctttttaaagatcctagctccaaatatagccacattggggttagggcttcaatatatgaatttagggggacagaatttcagcccaccacagttactatagtataatgtatgtataaaatgtaataattaaataaaattcctaaagtggaggagagacagttcagaatataaacattaaaatgtgctacgatttttccttttcaattttccagcagcattctgaggtaaaatcaatagttttcctcccaaataataatttttgagagatatataacttaattgatcatttgccaagtgagaaaggtgtgttgataatcaagctctagccccacacccaaagcacccttttaaaattcaaacaaatcatttcttaatttccttgctactgcccttgctgaaatgtttatctgtccattcccgcttagtcaattctgcttgacttcaatacttaaatttaacctaaactactctctctaggatcctctctcattcataattctatcaatgtattaccacactgtnnagtaattttttgcttgctatctcttcatttctgaggcaattattgtgtaactttcattgtttttaggggctttatgctatcccttattcatggaagggctctgtaatgatatcaaacagacagctgtaatgagttggaggtctctttaatggacaccaagtagcttgccttttcagagaagtttcctgtagggttttcctgatggtataattttatggaaggcagtacagaaagagaacctttattgngatcaggcaaatgaagggtaatgagaacttaacccagcacagtgaaagcaattcaaagggaaggtgctagcctgtgacatcatgagtatgtgcagagtatcacatcagngacataccatncatggacngaggacacagaancaaggngctgtnaattcataagactgagatagaagtagaaagtaatctcttaatatcctgaagctggggcattgacactaaagattaaatgagtgcaatatgatcgtttgaatacactgtaaataatacaaaattatgtaacaac

SEQ ID NO: 485266 - DNA, 192 bp, Homo sapiens
tttatgaataggagactcatacaaatatctgtatcttcaaaacctcacacattccatgtgagtccgctgaaaatactcacaggcttttacctggaacctgatggttgaataaacaatttatatgcgaagagtaaacggaacaacgaaaagttaaacgtgatttttgcatggataacgcagagcaggaacgaa

SEQ ID NO: 485267 - DNA, 1287 bp, Homo sapiens
ctgaaccacgacgtactgcagcgcagctgcagccccgggggcccggtgcggcggtgcctcgttactctggtgatggcccatgtgtgcctgctacccctgtggcggagacgctgccccagaggccctggtgaaggcccggcgtctgctggagctgggtggacggggcttgggggcgggcgctggtggggctgcagggcgggccgttcggcctctacgcgcccggccgaccatcctcgaggtcgtccaggcctcttccatccctgtacgagcccaaggaggtgcgcttcggtggtgcgcagcgttgagcggcgcgcaagtcgtttcccccatcgacacgatacagccgaatgaccacaatcgcaaccgacagatccgggaacaccgggacacccagagaagcacccaaggggacaaaaagacgagaacaacattccaaggcagaaagccagaatgcgaggatctgggaacaaaggtaccgaacaggttgggggcgaacagtaggcatgggcaggaaggcaatccaaacctaagagccgaagacaagccggggaagccgagattacaaagggaacacatagaagaatacgacaaggcagccagccaacaaataaaccacagaggcaaaaaacccaaagacgaaccgacaaatcacagatggcaagacatcggaggggaacaaacgacaggctagttgaggacaacaaccggacaatggaaaaccaattcagaaagaaccagcgacgacattcaaggggacaagcctggagaacgatgaacgagaatagcaggagtcccagaacagtcgaaaaagaagacacaagagaaaaaaaagagaaaaaaagaacaaaaaagagaacacaaaaagaaagaggaaacaaaagagaagaacagaaaaacaaaaagagaagagaaaacaagaaagtaaaaaaaaaaacaaagaaagagaaagaaaagaaaaaaaaaaaaagaacagacaaaaaaaccacgagaaagagaagaaaaaacagacaagaaaagagaagaagaaaggaggaagaaagcgaggggagaaggaaacgagaagaaacaggaaaaggaacgaggagaaaaagggagagaagaagacagaagaaaacacggagcaaaaagaaacgaaaggaaggcggaaggagggaaatgacgagagggagagggcgaggaagagagctacaggaaggtagaggagagaaagagcactagagaggagaataagaggaagagagaagagagagagagaaagaaaagaagatagagagaagaaaaagagag

SEQ ID NO: 485268 - DNA, 218 bp, Homo sapiens
ctgtacttcctggcaacatggtgacaccccggttctactaaaaatacaaaaattagctgggcgtaagtggtgcgtgcctgaaatcccagctactcgggatgctgaagcaggagaatcacctgaacccgggaggcggaggttgcagggagccgagaccgtgccactgggttgaccgtggcttgtgggttgaccgtgaccgtggcttggttgaccgtggc

SEQ ID NO: 485269 - DNA, 435 bp, Homo sapiens
gctcgatattatctcacatttggtcagctgggagcttcttcatgatggctctgatgatccactccattaatctctattattctttgagcgcttccttgcttttaggtacacaaaatattccaagctcaccttatactctttccgtcccagccctggcatcagccatttctctatgcacttctgactcctttagtgaagagtatttagaaaacaagctctaggcattagttgtgctcattggtactgggtttcgttacttctaagccctgtcagtggagttgaccaaaacttaaaacttctactcttcaaaagatattgttcagaaagtatcaagatggccgggcacggtggctcaagcctgtaatccccactctttgggaggctgagacaggagaatcgcctgaacccgggaagcggaggttgccgtgagccgag

SEQ ID NO: 485270 - DNA, 759 bp, Homo sapiens
  misc_feature (401)..(401): n is a, c, g, or t
ggagaagattctgagagagaccgccgtaacaagaccgggtctctcaggagagcaggcgcctgtgcttctgtcggggcgccgatcaggcgggcctctccggccctcagaatctcgctcggttgcccaggcctggagtgcagctggcgtgatctcggcctcacgggccatgcgtctgccctgccatgacgtgagctctccctaacgttacttctctgtcataatttcctaatataatatcttgcacagcaggacgtatgcaagacgattgatgattggatactatctctacatagtattatgaagtgtacatgaagagctattgggacacgggggctgtgcacacatgcggcaaaacgtggtcgctgcacattatgctcgttagctgtgatgagactggtagncgtatagaaacatcagtggagtagaaagacacgatctaggcgaggtgactttgccgccggatcaataagcggacgacttgaggcgcgttgaatggacacctgaggacatgagcatctactgtcaactctaccatgtgtgtatagcaccaggtcaacaccaatattcatggttcttgagtactagccgcaggagagctgtaggactagataatatcccaggaatcgtcgtcatgaagaggagatgccggtggtcgtgccgtcagatagtattgtgtgtatgttatgtgtcccgggcagggctattgctcacgagggagctcccgccagaaaatgtgctgtcagatgaatttcataaatg

SEQ ID NO: 485271 - DNA, 637 bp, Homo sapiens
  misc_feature (180)..(180): n is a, c, g, or t
  misc_feature (191)..(191): n is a, c, g, or t
ggtaatgccaacatttatggggaaacagaaggaaatggagcagggaagggagcttagaaactgcagccacagatcggggagcagtaggacagagcggttctgagcaacccaggcaagagtttcaagcgcgcgctggtcaccagcgtcacatgcctcagagaagtcaagagacctgagaangtccatggatngatccggcaattatggaatcttttattaataggaactaggatggaacctacatatgacacttatttgaaaagaaacccatcttcaaactatagatttactgagaaaaggctagtactctgtggacttggaagacatgactttgtgcactaatgatttccacattgaaagtaatttctggatgaagaaaaagagctttcccagtatgaaaaaatccaaaataattaggatggaaacacaaggaagaggatcggtaagccagactataagaagaggagaaatggcaaagagacgaagaagaggcatgcaatatggtgtaatcatataatagaatttggacggagtcttgctctgttgccaggctggagtgcagtggcacaatattggtcactgcagcctccgctcccggattcaagcaattctcctacctcagctcctgagtagctgg

SEQ ID NO: 485272 - DNA, 417 bp, Homo sapiens
ggcttcacaggatgtcaggaacctatgtccaagatttttcactcacaatgttggcaaagtggcgttggctgccagcaggggtctcagttccttaccacacggacccctccttggggctgcttgtgtgttctcacgacatggcagtgggctctcctacagtgagtgatccaagagagaagggaaaaaccacaacatctctcatggcctatcctcagaagccacacaccatcttcttaattactcacaggtcagtctcacccaaggtggaaggggcgtgaattccaggaggtgagaaacactgtgttcattttggaggcaggtcagtgctacgcatgacaaatcttcaaggctgatttgacaacatgattattgggtagcggagcattccaagacactaagattccatggcacacatgt

SEQ ID NO: 485273 - DNA, 273 bp, Homo sapiens
cccagttttaggtttttcacccatgaaccgcacacttgtgttgttgcacgcccccaatgaacggctgcatgaggttgtgttcctccgtgggggggacatatatacacgcctgctgcctgcccttgccagtgggcctgccctgcccagtgacagttgagccctggaactcttaaacctttgcccctggggtttccatcccaaccagggccaaggccctccttttcccccttccaaataataaagtttatggacagggctgtttttaaagtccta

SEQ ID NO: 485274 - DNA, 1650 bp, Homo sapiens
ccttggcgagtgatgcagcacagccacgagggtggggtgggaagatcaagccaccgggtgcgcaaacaaggggttgataggcgacatggaaggaaaaaactatgtttgggtggtaattgtgcgatgtagaagggaatgtggttaagtgggggctcacacaagtgtagcatgtgtgactgagggtaggtgggctacgcgacgcccgccacacgagagatgagcatggggtggtggagtgggcccccccccccctcgcgcgggggaatgatacggctggtggtgggcagcggtgggtgaagtggtgtgtccacacgactcgcggggatgttcgtgttcagcacacacgaaacagaacgttatgatagtgaggcccctctgggccgcacgcactgggataagaatgttggggccgcaggcaggtcgcagccacagaacgaggcagcgtttgtggggggagcaacaaatagcgggtgtctattgtggcccaccgtcggtagtagcgtggtgtaaccacgccgcgggtatgaagctgtctgactcagtataggggtcatcaatgagggcaccgtctggtcgcccggttggtcgagcagccacccacacaacgagggggctcagaaccagcaacagagtgtggtagtccagcagcgtgtgagttggggggaaagcacacacctatggatgacgccggctgcccgccggcggtgtggggtggtgagagtaaatacggctgtgcctccgccagcataatagtagtagtagtagtggagccacagcgttgcacaacgtagtataggcgtggggtgggtggatgagaataaacatcgtcaggtagcgattgacgcagtagaggggggtgccccccccctcgcgaacagaggggggcaatagtaacaacactgggggtgggagtagaacacaactggggaggggacacctcaccacacgtggtgggggtgctgcactccagcgactgctgagagtggtgtgatcgacaacacagggggagacaacacacccaacacgctgagtgctgctcgacacaacaacgagctgtagtgattaacacaacgtttgcgtgtgggcaacgtgtcgtccacagatggtgtcgcccccgtacttcatgacgcagccatctacaacactgtgtgggtcatagaagcgctcaaaagggtgtctcctgtggggagagtggtgtacacacaccgcagaaagtgtgtgtgggcgaaacgacagaccacacacacaagcagcgggtgtgtgggtgagacaccctcgactgttgtggcgcccaccctacggtggtgacgtcgcgctcacaacaaggagagtgtagtagaagacaccccccgtgggagcgcaccacacgaccccacctcacaagagtcactcacaataggatataatagagataaagaacctcgcttctaacatgttgtgtggggagatgtgtcctcgccatccacacgtcacacgtgtctcacactaccaccaccggaaagtgtgtctccacgcctcgtgcacacacacgtgtgtccacacggagttaacacccacgtaataaaagagaggaacgccgccatatggaacccccacccggtgtgctaagtgcccctcccagtgtataggtgaccacgggggtacacccca

SEQ ID NO: 485275 - DNA, 1151 bp, Homo sapiens
gcaattgcaggggaggtggcctccattactctcaagtactgaaattcggagacatagccagaggtgggacacaagtgcgtgaagagtgaagagccaccgcactgctcaacacatagtcctggaaaactgcgtgcaagccaagcgaaatccgtttaccacagtctctcacattcacgatgccacaaaacggcacgcctgggataatgcaccgcaccgttgttacacattgtactccccaagtccggtagaaacaatcgtgggcaacctcaagagttgttcacggcctccattacgagcatactggcttatccagtgtcgcatcgggcacaaaactcccccctccgactcccacactgcgggtagtcactcatcaaacaaaagagcgcggaaattgtggcggcaaacccacaagccaccagcgacaaacttcaccatgcgtgtctaccaagatgccgcggcccaacagggcaccgcactgcgccttgacattcacagctctcctcccttcaaccgcacccccaaaaaacccccgaggaacgcgacacacgttgcacaccacagtcccacaacacgctgggccagccgaacgagggtcaactccaacttccttccacctgggaacacgcgcatacggcatctacgttggtggcatctcatttaccagtggggccatccgacgactcacgaaaacgacacggcactcggcaaactgcaagggaacagaaacgggacattccaacctacacgcgaacacccgtacggattcctccaggaaactttccacgtcacgcaacacccatccccacctttggcacacgacatctggcggacccgacgaacgcacgcggcaaacgcaatcccaaccacacacacgggaccgcccaaggcggccacgggaacacagccaaagagctaacccactaagcaaggcgccataaccccggcctcagccacacgcaacggctaggaccacctcacaccaacgcaacacagcgagcaaacccgggagcagcgacaccacgagaagcggacaacgacataggccagcagcgcagctcaccagcgacaccaagaagacatcatccaagggccagtgacacgaacagccactgaccacgaggtcccgactcccccggagcataccgacacag

SEQ ID NO: 485276 - DNA, 948 bp, Homo sapiens
  misc_feature (948)..(948): n is a, c, g, or t
acctctcgccaggccgtcctcgtgaccgtgacatcgtctttaaaccctgcgtggtactccctgacgcaccgccgtgagatgcccagggaaggacaggccgatctgaaaattccaagctacttccttaagatcatccaaagctattggatgattatccgaagatgttgcattggtgggagcaggaccaatgtgggctccaagcaaggatgcagcaagatccgcatgtcccttcgcggtacagggctgtgcgtggtggattgggcaagaaacgagcatgatgcgcgaagggcattccgaggatcgacctgtgacataactcaacgcacagctctgtgaggcacacactagctgtcctcactagtccggggggcaatgtggcgctcttcgcttgtacaccccataggggaagggagcctcatcctgcacgtactgagagggaccattgtttttgcgcccggccactacacgtggtagtcacagcgtaggattgcctggtccacttatgttgccattttgcccccagttggtcaacaaagtccgcttgggtagcaagggcaccacgaaagccaaccgggcttctcccgggcaccccggagaagaagaaacacttccttttagtgccaagagacctttgccagagtagttgaacccatctaaaagaattgcttctagtggggcaccaccccaagctggcacatttcatggcagatgactgctgcgcaagctgtgcatcaacgcaacgtgtgcatcacaccctgtcgtgtgtgttaggcccgacgtaatattccacgatcgggctggaagacactgtgttccgagaaagtgttccgcccttattatccatttatggtggagggtcaatcccacaaagcgtgtacagcaacaagtggacagcccttctctaccatgcgcttaacgcggtatagatatatcaccagaggcaaactn

SEQ ID NO: 485277 - DNA, 1107 bp, Homo sapiens
ccttctagtgtcttcactgtattttctttaaaaaaaaaaaaaaaaaaaggggaaaaataaaccactcaaaagaacaacaaaaaaacccagcacaaaaccgacgatgggagtttggtttctttggatttctttggccaatgggcaagaagatgagatggccctcagcactggaggattctggccccctggtgggtggcccggctgcccccaaccttcaggctggccagatgctccccggggacaaacaccaggctaacaggagccagacggccagggcctggcccgggcctccggttcctggcccccaacccaaccaacctggcctgggagaggaacggggtcgggtccgtgtcggagaaagtggacaggtcccaaagccaaagccgggccctcaaagcatcatcagggaggggggtagtcagttgaaggcagttcccaccggagtttccggagcctcagaaatccaggagatacgcacaggcccacccatctggagatgacaggggctggacttcccggtggctggggcttttccattggtccccctgggcctccagggtcctcctatgggctctccatgggacgtgggtgggcgaaggtgcgtggggggccggaggtccccgtgccgtgtagtgtgtgaagaagatatgaacgagagcgcaatcgaataagacagggtgtatccacagaccagacgggtgcacaggcccgaccagacatgcaagccagaaattcccggtacagcagggtgtacaacaaaacaagcgcaatggggggataggagatgagagaacctcccgaattccctcagaagccacagaggaggcacacagtagacagagggtcccaccaaaacggataaaagacgggagagaacaatataaaaacagggtaaagggaaaaccacaggaaactggttcacaaaaggactggggcgcagagataaaagaaacccgcgcgcgagagaaaaggtggaccccaccacgggagcaccatatagaggacagcaaacagagggaagaggaaacccataaaaaaacacagtaaacaaaacaggggcaacgtcatcaaaaaacgtgccccactataaaaaaaggcatgacaaaa

SEQ ID NO: 485278 - DNA, 907 bp, Homo sapiens
  misc_feature (624)..(624): n is a, c, g, or t
  misc_feature (809)..(809): n is a, c, g, or t
tgtcttcaagacatccaagatgaagaacctcgtgtggaccagcggtatctcagtccctggcagtggtgaatttcacgctcagcctcagaggttgacttctacattcgataaggacatgatccacatcgcggacacctaagggtcgtccaggcgttatggggatttcttcatgcccgtcagatcccagcaacatttgaggtagcttatactcgaaccctgaagaagatgggacacgagcaccttggatggatattccacacacagttgcaggtaacctgtagtgtgactgtattgataggtcgaggaagtgttattggctaccgtgaaacctttatcctagcatcatggcccatctagcctgtcagactcacgtttaaccagacgttagaggaccgaagctgtttcaatgtggatctcagctagaggatctttggagtccacgaaataacaaataataggacatagagaaataaaaagccccggggtgtctctgactctgcagggagggggacaaaaggcggtagagtcaagtggcgcttggggccaatgacgtagcttgccgggcacgccagtgtttgcttggtcgcaagggggtgctacatctgggcgggctcccctgtattngggatggcgggatcatcatttgccgcatgacgctcgggggttttccgcggcgggttactggagttgtggcgcggggagggcgaccccggggacatttgtgcatacccggcaacctttgaggccgtccaggaagggtttaccggaccggactcccaggagacacctgtatgctgggacccttgtangccgggaccgggacattggcgtctgtggtggggaccacgggaattggaccgggggtttcggcgggagaggttttacgcgcgttcacaggggccttggc

SEQ ID NO: 485279 - DNA, 180 bp, Homo sapiens
atgatgatggtgtatggagaagtgaccgagccaataggctgctacgtatccgtttgtcggaatcagatcgaatgtatttcgaaggtttgagatacatctcgaagatttatgataggagggttatggttttactttggtcaaaccgggttgactttcgacgccgcataacaccacacaatt

SEQ ID NO: 485280 - DNA, 503 bp, Homo sapiens
tgatctagaggatctccagaggacaaggagggtggagagggtgcttggggactgtagggcaagagagctctggttaggtaggcctgggagaaggagccacagctagaggttgcagggtggccaccatcaaaaagttaggaaaagaagaagcttaagtttgtacgatgctttaaaaaaaataaaataaatcaaatcttctgaattatctgtgaggcaggtgctcttttccatccccatttggcagataagagaactgaggtcagagaggtaaagtgacttgcctgaagtcacacagctaggaggtggaagagctgggaatcaaaccagctatgaacaaatgccttccctcccctcatccctagtctgttcccagtgcccccagctcaggcctccttcccaggaactctctagggatgtcgctcaaagcctctctgcccaaggtctcttcccacctgctgcctcatttctccctcactccttccaagttcccattgctgatcatg

SEQ ID NO: 485281 - DNA, 313 bp, Homo sapiens
ggcaagtttgaatcgcggtgagacgaagggcgtaggtggtgggatctcaccgtggtccgaataagccttttctctgccttgtttgtaggacgcttcagcgggaatccgaaagtgggctgcgggcaacgtgctgagacaagggacttccggaaatgggccacgacaaagggcggttcccggctcgcagaagaggccggtcctttgcatgttcccccagttggggccggattccattcggccaccttaaaaaatcttagggaaggaccagctcaatggactgttgttggcccaacttggccgctgtgtaccaggc

SEQ ID NO: 485282 - DNA, 180 bp, Homo sapiens
tcacctgggcccgtttttggcgtccgcgtatggttgtcgtagcccgtaggccctacacgttgggcgctttgcgtagtttatatgcctagaatgttacgttcggtacgcattaggaatgccattgcgattagaatgggtacaatgaggagtaggaggttggccatgcgtggattgccagga

SEQ ID NO: 485283 - DNA, 162 bp, Homo sapiens
tggaaagaaccaccttgcactcctatcatgcccggggcgacgagcgcagcaccaaccccatctcaaaaaaccaccggggtggggttaaaaaggagcttaatagttgatgaaccgagggcagcatgctaccattaaccaagttgatcaaagagataattcaat

SEQ ID NO: 485284 - DNA, 1271 bp, Homo sapiens
gtgttagacttactcaatgcagaagatgaaataagggaagaggagagagaaagagcaactgaggaaaaagaatcaaatgcatttcattcattcaatcctggcaagcaatcagcacatggcacatttttccaaccatttgcacttgtgtcaattcccaatcctggcatcagtctcactcaactgccggcacattcattcaatgcaacaagcaacatgcatgttattcaaacagcacagcaccaccagcacgtctttcaccaagcgacagcagcacactgcattgcatcacgcattttcagtcacaacaggcacaatcattgccagcccacgtggtcattccagcaacactcttctgcaagcaagctgcaagcttgtgttcatatgcagccatttcatattagtagcacaccaggcacataacacatcatcattccccaccagcacagcatagtttccagcatctaaccgaagatggaaagcaacaaatttgcggcagcatcacgaagcaagcaaaaagcaaccatggtcaaaagtgtagtaatggacaacagaagtgtccatagatgtattatatcctaggtggtcatctagtagatatgcgaaaagatatgtggctccattcttataaagaaaggtgtacctactatgtagggagtacaatacaaggggtacaagtatccgaacaatttactatgtcagtgagagacaagaaccccaaagacattcactcctaccacctattagcaagttacatttcatttaccacatggtcttcataaccttataacctttacatcctaaattgggcagttaccttcaacaatttcaaacttccatgtacgcacctcaacaagcacacattgggacggcaggtacccactatcgacatactaatggcactccaccgaacaaaaggcacaataataattaaaacacacaactcacaccagacacgccaacgaaaacagagaaaatgaaaagcaaacaagacaggaagcccagccacaaaaacaaagcgtacaggccaaataaacagaatatggacatggaacacgaaaaaaacaagaaaagtgaaaaagaaaaaataacaaataggaaaagagaaaaaggaaaataaaaaatgagataaaagaaaaacagaaaataaacatatagaagtaaaaaagaaaaagacaaaatatataataaaaaggaaaagtaaagaaaaaaaaatcagaaaggaacgatagaaaaagaaaaaaatatgttgtgattgttagttaataataaat

SEQ ID NO: 485285 - DNA, 347 bp, Homo sapiens
gtatatttgctagaaatcaatagaacgcctcacagcgcatataacctctctcaggagttcaactctatccactaatagcttttgatgattctagcaagctcgtaacctcgccttacccccactattaaactactgtgagaactctctgtgctagtaaccacgttctcctgatccaatatcactctcctacttacaggactcaacatactagtcacagacctataatccctctacatatttaccacaacacactgaggctcactcaaccaccacattaacaacataaaaacctcattcacacgagaaaacaccctcatgttcatacagctataccccgaagaaggcca

SEQ ID NO: 485286 - DNA, 171 bp, Homo sapiens
atcctccttcacagtgtgagaccttccagaccaggtctgaacttgtggacttcttgatggagaccttgatcatgttcaaggacctcattggaaagaacgtgtaccctggaggctggatggccatgagcatggttcaaaacagggtcttcctgagagctatgaacaagtttg

SEQ ID NO: 485287 - DNA, 127 bp, Homo sapiens
tcaatctttgggagagtttcagtactggatagaatttaaatgtcttctttctgaaaccctttctcctagaaactaggtaataggtgtagaagactctccctaagggtagccaggaaggtctcctgtt

SEQ ID NO: 485288 - DNA, 822 bp, Homo sapiens
  misc_feature (49)..(49): n is a, c, g, or t
  misc_feature (63)..(63): n is a, c, g, or t
  misc_feature (76)..(76): n is a, c, g, or t
  misc_feature (87)..(87): n is a, c, g, or t
  misc_feature (100)..(100): n is a, c, g, or t
  misc_feature (105)..(105): n is a, c, g, or t
  misc_feature (118)..(118): n is a, c, g, or t
  misc_feature (126)..(126): n is a, c, g, or t
  misc_feature (134)..(134): n is a, c, g, or t
  misc_feature (194)..(195): n is a, c, g, or t
  misc_feature (300)..(300): n is a, c, g, or t
  misc_feature (302)..(302): n is a, c, g, or t
  misc_feature (310)..(310): n is a, c, g, or t
  misc_feature (314)..(314): n is a, c, g, or t
  misc_feature (338)..(339): n is a, c, g, or t
  misc_feature (396)..(397): n is a, c, g, or t
  misc_feature (401)..(401): n is a, c, g, or t
  misc_feature (430)..(430): n is a, c, g, or t
  misc_feature (440)..(440): n is a, c, g, or t
  misc_feature (452)..(452): n is a, c, g, or t
  misc_feature (479)..(479): n is a, c, g, or t
  misc_feature (483)..(483): n is a, c, g, or t
  misc_feature (543)..(543): n is a, c, g, or t
  misc_feature (556)..(556): n is a, c, g, or t
  misc_feature (558)..(560): n is a, c, g, or t
  misc_feature (618)..(618): n is a, c, g, or t
  misc_feature (622)..(622): n is a, c, g, or t
  misc_feature (628)..(628): n is a, c, g, or t
  misc_feature (646)..(646): n is a, c, g, or t
  misc_feature (648)..(648): n is a, c, g, or t
  misc_feature (650)..(650): n is a, c, g, or t
  misc_feature (658)..(658): n is a, c, g, or t
  misc_feature (668)..(668): n is a, c, g, or t
  misc_feature (671)..(671): n is a, c, g, or t
  misc_feature (675)..(675): n is a, c, g, or t
  misc_feature (679)..(679): n is a, c, g, or t
  misc_feature (683)..(684): n is a, c, g, or t
  misc_feature (711)..(711): n is a, c, g, or t
  misc_feature (812)..(812): n is a, c, g, or t
cccacctccccaccccccaaacacacacacacacacacgtacacactgnctaagcgcacagcnagggtgggcaggnatgctttggcnatggggccccttngcgcngctgtggcatggncggctgcnaggtggtntggatgtgagctcagcacctttggaggtgggtggaggcaaggagagaaagaagtctcagnnctcccaaggacacaggagaaggtgcttgcaaaacaggcagataagaaagccgacaggaacccagaaaagagatgagaaaaaagaagagtggaaaaagagaaacangntgggtgcngcantcacacctgtcctcccagctactnnggaggctggggcaggagaatcgcttgaccccaggaggcgggggttgcagtgagctgnnatcncaccactgcactccagcctgggtcctccncgtgagaatncgtcttatattntaaaaaaaaataaagttttgttttttngttncagctccggggtgaaaacaggatgtgggcaacaaaacaacacaggaaggaaacagcgagnggaaagggaaggnannngatgcatccaagaactggttagagtgcaaggaattgggaaggaaagaaaaaggtgggngggngggganacaagaagaggaaaacanangnaaagcggnggaaagaaanacnccanaaanaaanncgggcaagaagaacaaagaggttgganagggaacgggagcctcttgggagagtcttagaccttgacaaaaaccaggtgggcagagtgcaccaggtcagccacatacgccagtgggtttgatggccgtnagactggcca

SEQ ID NO: 485289 - DNA, 368 bp, Homo sapiens
gtgtgaaaacgttccctaggtgtaacttgattctcgagtatcacggaacacagggcaacccagcagcatctcaagcagcaatcagtgtcaaactggcacctagttcattccacagtgtggatgagatcaggctgacagcttcacaggagaactaggcctgctcaggcaggcgagagctgaggcccggaaggagatggtggcagaaggtgtcacaccacaggtatccaaccctcctccaggaggccggatgtcagaggggtgccttgggtaacctctgaaactcagaagtgaaagggggctattcctagttttattgctataggccattatgattattactgactagtattgattggtcgtattggtta

SEQ ID NO: 485290 - DNA, 263 bp, Homo sapiens
ctgcatgccacatgttttgcagccctggtaaaaggtgcagcacaacccgagaaggagagaagccgggagacgtgtcgcatgtgttttatctgtggctatagttctcctttctgacaaggaggcccccagcactccttgtgacctagagctggaagtggaagggcttggggtgctgcttcctgagccctctgctctaagtccatcttctccctttgattccctgcagattggtacacagaacagcttggagcttcttgaggatc

SEQ ID NO: 485291 - DNA, 117 bp, Homo sapiens
cgcaatcccactactgaacatatcgggagaactgacctgctcggttgccgacctagcaccggggacacatccttagacggcctggagctgccatcgctcaacgctggggcaccatat

SEQ ID NO: 485292 - DNA, 839 bp, Homo sapiens
ggagaactagtctcgagtttttttgatttttttgtgggcttaataacaaaattcctgggtataaggcaaaatactctgtgcaaccgcagtaccgagggggagccctgcccccccatccaccctcccctttccttatgccatccagataggggaaaggagcaagggggaactctcgtgggccaggggctgcactgttgggacaaaacctgattatagggccacgcgcagtggcgagcaacgatgccagcacggtggcacatcctcccgcgaatcccaatcgacagagctagacatcggcccaacagaagaggcgctggcagcaagaggagccaggacacgccacgaaccaaaactagggcccggaaccctcgaacagcacaccgagaatacactagagaaaagccttagaacaaatagctaacacaactacaaaaaggagaaaacatacaacggaagaagacaaaacgaccttcacacgaacaccgtgccccaatgagaagacggtgcccacagaaatactccaagcatttataaaaactacaaaacctcccctgatatataaccaagacaaacacccataccaaccaacgttttgcgcaccacccactatccaaatttatccccaaatctatgtaccacctcaaaacaactaaccactctagtaggaaacaccaaaacattatcacaagactgtaccaataaaaaaccacaaaacataaaactgcaaaacccatcaccctcaaaaatgtcaaaaaacacttacaccaccaatcacccacaagacatagtataacacaaacactctcacaacacaacccatgataagaaaataatatatc

SEQ ID NO: 485293 - DNA, 115 bp, Homo sapiens
gcacgagaaggttaaatacctgtgttcagattgtaagatccagtccggacctgctgtgtatattgtaacgttaaatgaaaaaagaaccccccgttgttttatagtcatgcggtct

SEQ ID NO: 485294 - DNA, 889 bp, Homo sapiens
  misc_feature (378)..(378): n is a, c, g, or t
  misc_feature (422)..(422): n is a, c, g, or t
gttgagtttaagcgcggtagcccttcccccagaaacatgcctctggagttggtttgctgcgtcaggcggatgcgacagaggtccgtgaggtgagatcctgaaccattaggatttgcagtgggagaccccccctcgaggatgtttgcacaatgctccatcatgagtcactgtgcgtgacaggagccgttataccgctaggtccacctgaacaccaagaggatggaccaaacaatgtcgccaagtccattgcactcgcgatgctctgacggtgatccagtcgatggatcatggacctgtggatctctctgcatggctctggcgcacatgaatcatccctagcatccacgagactgtcctgggtgtaaatcacatgtctgnagtgatcctgacgaattgatgagaccgaggtaggactgatggcnttgccatcgaatggttgccggttcatggacacgggccccaaacacgtggtgttcccgcgaggtctctttataaatgtgcacaggagaagggtatcttgacagaatcttcttcctgttgtgcggcgagaactaagcccaccaaagtctcaggtgagctaggatgggggtcttctcgttgctcttgtggggtctattattaaagaaccacactgggagacggcactttcacgcttgtagcggagttgcgcacaactccatgtgactcgcaatcgggaattcccaaacctaaggggtcgcgggtctatgagtccacaggccacatgagtggaattgagtcgaggatgaggtcaattggagccaccgatcacgtgttgcttttaggcagattcgaggtctcgtccaggtcaagcagcgggcacctgatgtataatgtgatggaaccccatctgagggggcgacatatacca

SEQ ID NO: 485295 - DNA, 372 bp, Homo sapiens
cacgaggcgggacgccctggtgctggacgtgcgcgacgaaggcgagtaccgagcggcccacattccccactcgcgacacgtgcccctgtccgccatcgacagccgcatcagggagctggagaaatatcggaagcggcccatcctgatcatttgccgcagcgggaaccgctccggcgccgccgccaaccttttgcgcaagcgggggttcgaagaggtatgggtgctgaagggcgggctggtggcgtgggaacaggccaacctgcccatcgaaaagggttagctcggtggcccgggtgaacatgtactgcaccgccatctgcccttattgccagatggcggaagccctgcttagacagaagggcgtgctggaga

SEQ ID NO: 485296 - DNA, 304 bp, Homo sapiens
  misc_feature (258)..(258): n is a, c, g, or t
tttttatcaccaaaaattttaatcacttatttgtatgttacgtttcacaaactaccttgagagacttaattttatataatgcagatgttagtagttcaatctctagaagcagaaagactggagtttgaaatttggttctgtcacttttccccagtgtgatcttgcaccagtgattctagtccttaatttcttcatataatccagtggtttccaatgtcttctataacaaggcagctagtgtgagactaaccctccccnaaaatccgcgccgttcccctcgaccgcgctttcgatggcgccggca

SEQ ID NO: 485297 - DNA, 649 bp, Homo sapiens
ggggaaatggaggtgcgcaaccctctgttcgaccacgccgcactgtccgcgcccctgcctgtgcccccatgctcacctgcctgcactgccatgacctggagtgcagacagacgcccacctgctcccctgacctctgatgtgccccctgtgggatggtggcatgggcctggatgcttcccactaaaaacatgttttgatgcatgtgtgctttttggcttgggccttgtggctccagtgccctgtggaccctcttgccaggtgagaccccctgaaccatttgtgccatggacacctcctgtgtccccttgcacctctccctgttgtggtttagaccacccaagactggatgggggcatggagaaccgtagagcgcaggaacgggttgggtaattctagagacaaaagccaattaaagtccatttcagacctgctggacaaaaaaaaaacaaaaaacaaaaaacaaaaaaaaaaagggggggccggacaaaaaaaaccccgagagggaccaaaacacggggaaccacaaacgggcccagaggggcacactatcgggagcaacaaaaaaaaggaagggaatgtacgtcattaaacagagagagatagggaacaatgcgcagggtgagaaatagtgaaagaccctaataggaac

SEQ ID NO: 485298 - DNA, 257 bp, Homo sapiens
acacgaacaacaacttatagccaaatatctatagtaaaccacggacacatactgatatggaatggttagactaaaagcaaagaataaggccacctgctatgaatttagcacaacactataaaagagcattagttaaccaagacacttgtttcaaaaagggaaacaagtacagagactgattaactgagtgagaaaggcaagtcacaatttagttaaaaacctgctggcccaaggtcagtagattcattccttatacc

SEQ ID NO: 485299 - DNA, 163 bp, Homo sapiens
  misc_feature (1)..(1): n is a, c, g, or t
  misc_feature (150)..(150): n is a, c, g, or t
ngattatattctgccacacagtgttacttgctggaggacaaaaaagaacggtagtcagtaagcaggaaaaaattcagatcctgctaagtgttattacacgaaaaattttgatgagagaatgggttagtctgctcagtctgccataacaanaataccaactcag

SEQ ID NO: 485300 - DNA, 181 bp, Homo sapiens
ccgtttatccttttaactttttgccccctttactttggtaaaattgtttcaactagaccccccctctcccctgtttaaaccaaagaataaaaaaaaatttagcccctttttgggggccaaaaaaattttgagggctagctgtttttcggctgccggctaaaaaaggactcctgattttgta

SEQ ID NO: 485301 - DNA, 608 bp, Homo sapiens
tcattgaaaatttttctccaaaatggctgcttgcaaatttaatatcatcgcaagggcattcagctcttctgcaccgcagaatcagctagtaaaaacacctattcaagtattcggaataagcggccgatacgcaactgccctatattcagccggggtaaaaagcaaggaattagacggtattgaaggagaattggtgaaaatacaagatgccattaaaacagataagaaattcaggcagtttattaaagatccaactatcaaaagatccattaaaactgaagcattgaaacaagtatcttcaaagctatcattatcaaattcatcgaagaacgttttatctttgatcgctgaaaatggtcgattaaaggaatttgatggcatagttaatgcttttaaaattcttatggctgcccatagaggtgaaattacatgtgaagtcacatctgccaagccgctggatgatgctactaagaaggaagttgaagcatcattgaatttgctaaagcaaatcagaagattttaatgacaacaaaggtcgatcctagcattattggagggcttattgttaccatcggtgattatgtagatatgagcattgcagggtagtt

SEQ ID NO: 485302 - DNA, 554 bp, Homo sapiens
  misc_feature (28)..(28): n is a, c, g, or t
  misc_feature (39)..(39): n is a, c, g, or t
  misc_feature (211)..(211): n is a, c, g, or t
cggggcccgcccgtgtctccagccagtnctacaggacanttgaggagctgcgtaacatgatcctcacaggccccgtggtcaatgcctacatgctggtgcagattgacaatgcccgtttggctgctgttgacttccgcaccaagtttgtgacagagcaggccctgcgcctgtgtgtgggggccgtcatcaatggcctgcgcagggtgctggntgagctgcccctggccagaggcgtcctggagatgcagattgtgaacctcaaggaggagctggcctgcctggagaagaaccacggggaggaaatgaacgccctgcgaggccaggtgggtggtgagatcaatgtggagatggtcgctgcgccgggcgtggtcctgtgccgggtgctcaacgggatgcgtggcctgattgtgaagatggctgagatagaccacacggattgcctggattggttcttcagcatgacaatgggactgaaccgtgaggtggttcccaacagttaacctggtgcctagtgacaaggttgtgatcgttagtgctccggcaccccatgcagg

SEQ ID NO: 485303 - DNA, 461 bp, Homo sapiens
actaacagaaatttctttttccttcttacattttcaccgctagaggatttgttcttaccatcgatcctagcaacctgagcacatgacttctttttctttctatttttttttctttctttctttcttggttgcttgcttgcttgcttgcttgcttcctttctctgtctcaaaaaaaaaaaaaaaaaagaagaagaagaaaagaaaagaaaaagaaaatagtgagagcaccatataaggaaagtggttcaggcactgtggtaaggggtgagtgtcagccaagtcatcagctatcagaacacgaagccatcaggtaatatatcaagttgatacattaagaaggaggggccgggcacggtggctcatgtctgtaatcccagcactttgggaggccaaggcaggcggatcacgaggtcaggagatcgggaccatcctggctaacacggtgaaaccccatctctact

SEQ ID NO: 485304 - DNA, 159 bp, Homo sapiens
gcagacggttctcactaggagggcaggggcacgatctgggctcaccgcaacctcggcctccgggactcaagtgatcctcccacctcggcctcccgagtatagctggggaccacagatgtgcaccaccaggcccgactaacttttggtataaggggtagg

SEQ ID NO: 485305 - DNA, 392 bp, Homo sapiens
  misc_feature (19)..(19): n is a, c, g, or t
aaagtggaggagcactaanagagagatccccctgatgggcatctatagccacagccccaccagaagtattcaaaatagccaatcctaaatgtttactctgctctaccttgcgattctcacagaaatcccaataaaggctttggcctaggatttccccttgctcctgtgttctgacaccaaaccaaaacctggtgtttcccctgtgacccttcatggcataaacttctttccaagccttgttctcatttactcctgtggccacacccacttaatcataccatatccaacatttatattcttaggacatacttgttattctgctctttaataaacaggctattgttgtttactctttccatgtaaaattttaaatcagcttgcctaattgcaaa

SEQ ID NO: 485306 - DNA, 212 bp, Homo sapiens
aagcagcaaacttactttgtttgtaagtattcattaggttgaaatactatttataagggcagagggctatatatgatttggctattatttctaggcactccatcccaatgattccactaacaaggattacatggataaaggtaggtatgaaaaatgtattaagctacccattaattctcgaactacccaccagaggacttgaaaatcttaaa

SEQ ID NO: 485307 - DNA, 184 bp, Homo sapiens
gaggatcccggagcggcggatcttgaatgcatgagctaaggttatttgcggcaagtaaataatctggcggtggtgtacttggattgggcggtaagctgcacagcacctaaaactggtcgtataataatttgggccaggtgcagtggcaaatgattttaatgccagtgcttggggaggcccaggc

SEQ ID NO: 485308 - DNA, 132 bp, Homo sapiens
agtcggcacccagttcctttaatggcaggagaatcgcttgagcctgggagcggaggttgcagtgagccatgttcatgccactgccattaaaggagctggagccatgttcatgccactgccattaaaggagct

SEQ ID NO: 485309 - DNA, 241 bp, Homo sapiens
agtcttagagctgtagaggagagtcctatctgtctgatgatgaacagaggttccctaaagggcccaaaagggggactccgtggagcgccatcccgggtggtcaagtagtcagtgtctgtccaaggttgctgtcaggctcctccagtcactgtgagtgggactctgaactccccttggggtttttggtttccaccctcaagatgcccaatgtacaggctagaggtgaggcttgcacaatcta

SEQ ID NO: 485310 - DNA, 794 bp, Homo sapiens
aactcaagtggcgttagccctgattcccggggcctggctgtcagtcgtaggcaattctgccggccgaagattggtgagcgcagaggcctgtgtggcagcggagcgtccattagggacgagtgatgcagcgggaacgaggaatgggcagactggtgaaatcagcaaacttgggcgtcgtgttccggcgccggaccccgtagtttgtgcagtacggtccatggctaatgaaacacagaaggttggtgccatcccgattttccgttttcccttcacacgcctattccatccgaggaagacttcatggctacgagcgtgtaccgggatgggaggctggcaaggatgggatatctgagagtccaacgtggcactgggaagtccttaacgtcttattgtggggccctctcttggactccgtgactttgaacagaagaagcgtgaagaagaggcagcgaatccttgaaactggaactggccccttacatgatgagaaagatgaatccctgtgtctgtcttcttcctgcgaggggctgcaggcaccccgaggcctgctggagaaccggctggggttactcagttgtgtgcagaagaaggagagagagggacctggttggaccgataaaggcgggcagggccaggaggaagcagggagaagaacgcctggagagattgcagacagggtgcccggtcagagtatgcagcaagggcctgaggccggagaagaagacacgagagggttcctccggtcaggaggggatgttagagacaggccggggttgaagtgagagataagatgg

SEQ ID NO: 485311 - DNA, 289 bp, Homo sapiens
actcattgtcagtttcctgaaataccaaaacaaacttcttacttacccctgtgagatatggtgccacaggaatgaagagtaaagcaataaacatgcatatgcagtgcatagtgaagtagaagggtatatatccaatatatatagtaaagtatagcctaaagtctcttaacatatctcaagttcagcttaaaggttactcagtacatagaactgtagcctaactggacgtgtaaccagacggtaccctactcttgtggcaatcactaagtttcagccaaccaaagacagc

SEQ ID NO: 485312 - DNA, 714 bp, Homo sapiens
ccacgcgtccgcagatcgcaggatttccaagaaatcgagcctgtcccttgtgcacttgggaataaattccccaaagacagcattcgggatcggtatctgaggctgccgggatttccagctctcagccaggttcctgacatgtgccaggcctgggggctaagccagacagtgttgctccggtctttccacggggaaggaagccaccccaccgcttgctgcgagtctccctcgctggagaagggaagccggccggtccggaggaatgggctggaattcgaattagagtggatcttgtctcatggatgctcttaggagaccacacacaatcctgtatgcaatggacccctcgactgggtgaatgctctttcagaacatatctccctcctgtgcaggtaggtgaaagcaatcctctgctaactctgcggtgaaatatcaggagatccacccaagcttctctgcgtgtgcatatcacacgggagcatagctaatcctgcagtggcgctcgtctctggatatcggatggaatcctaagaaggaatcatgttatgaagccttgtgtagctgaggagataatgtccaccatgccagagctctgatcacaggaacattcaaatcctcttcgtggtggtcgatctggttccaatcttgtgaatctagccgggtgcatgagatggctcgggtgcaaaatcaggaaagcaaatggtaagctaaatg

SEQ ID NO: 485313 - DNA, 153 bp, Homo sapiens
atggacttctggtatgcagacggtcagttatcagaagctcaggtatccagaaagtcaggtatgccagaaggtccaggtatgccagaaggtccaggtatgccagaaggtccaggtatgccagaaggtccaggtatgccagaaggtccaggtatg

SEQ ID NO: 485314 - DNA, 246 bp, Homo sapiens
taaaaccctttttttgggccgagaacctttaaaattttccccattggaaaacccgttaatcctttttttcccgggggtgggccaaaaaaaaaaatatttttgggttggaaaaaaatttgggcctgtttttgccctgggcccaaataaaccccctgaggggcttttttgggaattccccccaaaaatggcaaaaaactttaactttaaaccttttgcaaccaaggggctttttttttttgaaatttg

SEQ ID NO: 485315 - DNA, 166 bp, Homo sapiens
tcatgctggtagcccctcgtgatgttgaagatccatcgttcgtattacccagttggcacgtgctgccggtatccacttggtgttggctactcagcgtccatcgaccgatgtgtgcaccggcctcatcaaggccaatattccgtctcggttggctttcgcgacctcc

SEQ ID NO: 485316 - DNA, 366 bp, Homo sapiens
gggttttcccccagcacgagtgtttcgggctgcccggagtcgcccgggagcaggtgcttcaaccaaagttacccgggggccacccgggccggcgggggtggggggaacgtgggggaactgtgttttcacgtgactcagcagtgcccccccccgtccccagctatgcattccctccgtttccagtgagcaaatgtcttgcttggaaagtggacctgggtttgggtttgtcctgagaacttaccagcaaaaatcctcatttttgtggtacgggttttccaaaaattgtcaagtttttttcagtttaacagttcctttaaatgtgtagtttttgaggaaaaaaatcaataaacagttgttttcgggcca

SEQ ID NO: 485317 - DNA, 115 bp, Homo sapiens
caagcagttatacagactcaggttggttaagtttggctgaagatgcaacatgaagggtctctgaccagcgtcctctgacttgaaggccagtgctctttctattatactataatgc

SEQ ID NO: 485318 - DNA, 372 bp, Homo sapiens
caaagggccccccttttttttaaaaaaaatttttgccccccctttttggtcccccctttttttcccccccctttggggggccggggggggttttcccccccccccccgggtttggggcccctttttcccccttggggggcccctttttttttttggggcccccaaaaaaaatttttccccccggtttggggggggcccctttttcccccctcccccgggggttttccccgggggtttttttttccccccgggggggggtccctttgttttggatccccccctttccccccccctttgtggcccggcccgggtttttttttggggaatttttttttaaaaattttttttttttttagggggggggtttgggga

SEQ ID NO: 485319 - DNA, 164 bp, Homo sapiens
tctatcctttctaaagtgtttagagtgttgggacatacggtacaccaattatatcagtacgctgccgaagttgacctggtggtgtgatgatgcagcccaggggtaggttaccgaccagatgtcctccgattattagcgcatcgttacgtgcctgactggctaac

SEQ ID NO: 485320 - DNA, 140 bp, Homo sapiens
tgccggttctgtaggaggtgcagcttcggcttgggtgtcaatcgggtgttccttcgtccgttgcctgccccctagaaaggttcccgcagactatcgggggcctatttccaacgagtttttttcgcgacgggttttccttt

SEQ ID NO: 485321 - DNA, 1381 bp, Homo sapiens
  misc_feature (700)..(700): n is a, c, g, or t
  misc_feature (926)..(926): n is a, c, g, or t
catggtgcgagtttattgaatatcatcccctggtccggtcctatgttgttgggagcgctgccgtgtggtcggacggacgcacggccgtccgcagccacatgtggtgtagtaatgggtagggtgtgcagtgaaaccagtccctttgtgtagaacgttcgtgttgtcggggtagtattggaagaaagagagatgatgtggcaccacccgtgtgggtgtgtaagggtgtatcacccccccgagggggggttgcagcccccccccaacccgggggcccgctgttgtaactgtctaccaatgtgttgggggaacaccccccccggccccccgaagaaaattccgtgggactgtgagaaggactgcgccagttataaacaccaaccgccaacgggggcaccacagaaaaaaggtgtgggaagtgaacagtcggagggttaaccgtgacccgagaaatgggcctaaacgtgggccaataggagaatcttggaacggaggggtgtggaaaaccagtccccccgagttgtggttggtgtgggcacacacagaggtgggagtattgaaggcacacggagaaagtgagagcgcgagaatgcccacggtgtgcttgccccccgcaaagaaggaattcttcccggtgagctagcgaccacttgtgctggccccaaaggttagagctaccacagcttgtgagaaagccccttcnctctctgggcttgctaaggagaggctcacttggaggacccctcaaactgtggaaattgtgtgtgccccaagcctgcggcttctcggccccaacccacgaaagttgttccactggagacccacgcgctcttggccacgccaccacgctatgaagcccaccgacctctaagaggtgtgtgtccacgacacacactggtcttctgcccggatgagaggatgatagaccnctcgtgaagaaatgagaagctcggagagcccacgcgctccacagaaagttctaagtgttataataagcgcacgccttgtccctcgtagaaggtccacaccggtggccacgcgctgtgtcgccacccccacttatttaatcctaggctatagcgcgaaacacatgtgcttacaatactgttgggaatgcctgaaaggaagaatgaagtgggctttcgcgaagtgaaatgttggccacagtttataaaaaataaacttcacttggtttggaccccgccactaatttaggctgttttggaaacgccacagttgaatcccttgagttttcaataataataagagctgctccacgtcaccactcaccacatatattcacgtggtgaaatcttgtttgttactgtcattccccttccttttcgtttagaatcagaataaagttctactttcaaaatatcta

SEQ ID NO: 485322 - DNA, 383 bp, Homo sapiens
tccgggcaccctcaacccagcgccctgcggcaaggcctggaacagcctggtggttttggtgcgctccctttgccctccccgcaaccctttgcgagcacttgttccaggaaaaagaccctggttagggtggaggttgcctcccccaaagggcgctgttggtggggcctcccctcccccattttcttgtttttttggttttaagactcgggagggaggcggcaggcgcctccgcaaccgataaagcagctattgttaccttcccttgcaaaacgggaacccaaccaagtgtgtaccgccggcggtggcgggggaggaggcgactgtgtgtgcaaacctcagtcggaaagggggtggggttgggaaataaaggtttacacccccca

SEQ ID NO: 485323 - DNA, 149 bp, Homo sapiens
acattgaggaatcctttcacaggaatcgttttgccagggcctggagttaagaggagccttcagaggaagcctttgagtttaatccatagattgggcccttccctttattgagacctggagattctgattcgaactctggaggaaacccg

SEQ ID NO: 485324 - DNA, 719 bp, Homo sapiens
  misc_feature (143)..(143): n is a, c, g, or t
gctcaagtttagacgacatgaggctccacaaatgatttcaggactggagctggaagggatacttctcgttgttccttatgtcctccttggctggtcgaagggttgcatgcttctgatatgctcattgccccatatgatgggtntcagatttggatgtctcgccatagatgaggatggtgtatacccgtaaggaagcccagctttgagttaggaagattaggatccacgtcctacaccttacggcaagtggcttggcctgtgtaaattgctctggtgtcctcatcttggatggaacataactagtacctgtctgcacaggttattaactgagtaagtgagaataatgataagcatgatcgtgcgcatacgtgcgaaaggcttgaatcagttgagataggcaacacacgagattgattcattagtcattatgtgcccgtggagcttctcgtgccgcccatacagctctcatctgaggacatctccctgcacctacgtattttgtgatgataatgggtgtcatgctgacatgtccctcctggatgggttcttgccagcacagcagcaagcctgtgctaggcttcaccaccgaagctgcctggccttggacaagccatgtaggttctctgggctttagttttctggaacaaataagagtttgcaagctgaaaggactgtacaaacgctaggcatcagtagaatgttgaagaagatgcaggacc

SEQ ID NO: 485325 - DNA, 623 bp, Homo sapiens
atccgcctcgtgtgctggcatggaggttatcatcacttggggacatttgtgaacattgtctggttggcggccccccgcccttgggccgaatcgcgtccctcgcctcccggtccatttggggcttcccccccccattgttgtcagcaggatcttttgtgcgagtcccgcacccctgcgcagggcgcaccgggttccccacagagaggctgccgtgctccctcgcgactttgtttctaccgtccgggtcctgggtgtgacccccaggtcgtcccacctgtggggcgatgtcttggcaccccccgtttctctcgcacaggcttgccgtctctcgctacgcccggtgccgtgtccaccccccatcggggcccacctcctccgtgggattattggcccctgaaggatcttgctgtcccctcgcctccggctggcctcttttttatttcctccagaggatccctccctcctcgcgcccgggaagcgccttatttgtcctattggtgggcagttctcaccaccacccttgcgagtggcttggctctttttttcgcgcgcccgtcatcggagtcaaaaatataaacaccatttggggcgccctaccaagagagaacaactagacagaaaaa

SEQ ID NO: 485326 - DNA, 909 bp, Homo sapiens
gggcagcagccggcctgagaggagcgtgctgtctcctctctccgcaatggcgtgtgctcgccctagtgatatcggtgtcctccgaacaagggggagtcactcttgtgcataggtgtcactttgtgcctgttggtattcccaagggcttcttattcggaccaagtattgtgcgttgaaactgtggttcacatccgaaatttgtgccgcagaaaagacatacagacagatcgctaatgactggttaaggtgtaatgtaggcaagtgctctatcaggatctacgttgcctaggaggtctgggggggtgtaaacttgggcagagactgggttggggtaggaattcccccaaggaggttgcagaggggtggtgggaacttacatcgggttattcatgggaacacagggctgacttatgtgggagaacagatggtcgttctggtggggaagtggccgaaatgttttagcacccaaaacaataaatgattgaaggcggtatgaccattaggcatgaaggtgaacacaacaaagcaaggaaaatcggaataacggaccaatatgggtgtctgtggcctcattggggttgaacctcaacgatggttactcaaggggttttcatggttctaaacggggtgcatacgctatgcgaggcgaaagttccgtggacactttgccttgtggctaggtggaacgattaaggtttgaaagggctcacaaggaggaaccaagggaaagctggtttggtgccttaagaaactttaagaggccctgggaatggttttcaaaaagggttaatggctcttaaagagaattgagaactggaaaaggcagaaggagaaccagggagtatacaagggcagggggccgggctttatcttaaagggctaaggatcgtacaggctgagcaattctgg

SEQ ID NO: 485327 - DNA, 1499 bp, Homo sapiens
tatattttgtttttttttgggatcccaaggtccccaggagggtctttatttttttcttttacaaacatccggtcactgggggtctcccttggctcttttggcccgttattgccgaaaagccgggcgtttggcacgggccattacggaagactagcgaaggctttgtgaaatttctctttctttccctcaggtgatgactcgagcttttctccgttctttatagacgtttccggacgggcattgtaccggctccggactcagatgtgggtgtggccaagtttctacagtttcttctgagccgagaaagtgtgttcttccccttctcttgtgggggcccagaggggctcttcctgtgggggacagaaggattgaagttttggagcagcgcggaaaacctcctatacagggcgcgtgtgaccaccgttttgggacctcttgcgagaggaacatctcccgggtgggaccatgtgtgtgttcaccggacactacatcgtgcggaattccccacgagacaaatgtgccgcgaagtgtgtatcgcgggggccccacatcttcttgggtgacattcgcgcggtgcacaaacacctttggaatgacctcactttcacaggggttatgtgaaacgcccgggagagagccaggggagggcaggacaacctatctcggggtgggtggggctacccgagaacatccggtgggggggcagcaactgcctgcacatagatttggggccccctgggatttggggcaacccccgtagaccagcgggtggagccatcaacagaggcgcgataattcgcagggcaggcacgccctattgggggattttgtggcccggggggcgctccataaaagagtttcttggggggcggacatcattataacaggaggcccgggcaattagggggtttacgaaccccccacggggttggcgccaacgaggcagcacaagattggcccaatgcccatctggtatgaccaagtggtggtgcgctacagaagacacccatgttccattcaccggaggtgtggagcaaccacagaagacttggccatatcggggccccgtagggggcaccccatggcgcagggaaaaacagtggaacccgtgttgaaaacgagcgcaaaaacaggcaacacccattgttggggagcccaattgtggtcccacaatagacccaaggtgcgacccgatatgggagaactttgtgcgggagaaatatccgggcatatcatgagagggcccaccgcagatgggacacaccaagacggggagggcccccttcttgggaaccgttgaaacaagctgtctcccagagaccctaaaacaagcgggaggtctgcaccaaagacttgtggcccgcacacgcaattgtgaggctcaaacgaggggcactaaatgagatcactcctccaaacaggagagacgaagagtctcctctcgtacaacaccacgacagagatagcggatgaaataagctcgggagcgaagacaagaa

SEQ ID NO: 485328 - DNA, 123 bp, Homo sapiens
acccctgccaaacgtagtacccaatcactaaaacagagggtatttctgttttttgtttgtttgtttgtttgagacagagtcttgctctgtcgcccaggctggagtgcagtggtgccatcttgg

SEQ ID NO: 485329 - DNA, 295 bp, Homo sapiens
gaatctttagcttttaatcatttttccaatttgacagtttaataactggttgctctcttctaatctcatgccttggcacctggtagggcaggaggagctcagtgcaaaaatcactttgggcctcattccccttagagacaagtttgcccaggtgcggccagacagatgttaggaaggttgataaccagttcagtctctacggattagcctcttttcctttccctccattatttagtgactctgagtaagttaatacacccttattttagctgttaagtactatatgaataagtgc

SEQ ID NO: 485330 - DNA, 580 bp, Homo sapiens
ttctattaacttggaaaatataaaatgaataaaacattccaattgggaagataaaaatgaataattcttcctgaaagccgatcagaaacatttacgaaaaatcgtaaagattaaaaatattttagcctcaacctgggtgtaggggagggtccaacatttaaataataaggggtcccgaaagaaagaatgttaattatcacaagaaaattttagaaattttccatgaaagcccagcacaaggtttaacacccgggttacaacaccatcatgacagttcagaacacccagaattaagagatctttaatgttttcaagaaggggggcttaaaaaacctaagtcacatattaaggtacgggaattaaaatggcattagaaatctcaaccagcacgctttggaagggctaggggagggtattatttttcaactgtcattctatgcttagccacatttcttgttaaggccgaatacaaacatctttaagtatgccaaaatctcaaaatatttacaaccatatttactttccatgttctctttctccggaaggtatttaaaaaatgtgccacaccaaaaaaaaaaaa

SEQ ID NO: 485331 - DNA, 108 bp, Homo sapiens
aaatggcgtgcggtcacccgagtcctgggtaaggtaagtcggggggctacggtggaagagtgtggagtcgggaagctgagctgtcggatgagtaagattgatgtggct

SEQ ID NO: 485332 - DNA, 156 bp, Homo sapiens
atccccccacctcagccttccaagtagtgacgaccacaggcttatgcaaccacattcaactaatttggtaaattttggtagacacaagggttcacggtgtggtccaggcgggtccgggtctcaaactcccgggctgaagccatccttccaccttgg

SEQ ID NO: 485333 - DNA, 224 bp, Homo sapiens
aggggagagaagaaaaggaggaatgcagagaagccctccaagaatgatgagtgattcgtgcaggtggagggaacgatgtccaatacctgaagcagaatctcaaaaaaaaaaaaaaaaaccggaattcccaattggtggccttttggttttcgtgtaccacttttggaagcccgaaattgggactaaggggtgtataatcaatttttatgcacattgggtggaca

SEQ ID NO: 485334 - DNA, 162 bp, Homo sapiens
cagacatatttgagaccttacaacaccccagacatgtaagttgctatccagagctgtgctatccctgtacgcctctagccgtaccacatggcatcgtgatgagactccggatgacggggtcaaccacactgtgcccatctaagaggggtatgacctcaccca

SEQ ID NO: 485335 - DNA, 1264 bp, Homo sapiens
  misc_feature (312)..(312): n is a, c, g, or t
  misc_feature (1264)..(1264): n is a, c, g, or t
agcgggttgagctctgttgaggaatccaaagtaggcccgtgattgccacacagacaggataggaggagagtatgtgtataacgtcacttgtccgatcaaagtacaaccgagaactcttagaaaaagtcacgacattgcgtcatcgcgaatcattgtgtggctttaataatcaactctttcgaatcctacagtgatgaatagtaagacacggtacagatagagactaagaagactattgactcctcctacttatctgatcatcgaataccccaatgacaatgtagcacagatgtcgaaaacaggagatgaccnacttatctaataacgcgataattctattgcaggcaaagaataagaggattcaaaagtccggatctcatctagtggcatgtccagacagcatcattattgccagtcacgtccatgtcgaaactcatcacttctcctcagtagaattaccttggttaggggtataccaacggcataattcttagcataggggattgtgccccacgaatggccaatggagatacgaagaggttcaatgccaaacgggatggttttactcgagaaggcactcacagggcagggattctccaatggccccaggtcatggcacatgacatgtctatccctctaagtggaggatactttgacacgcgctgttctctgtgacacaagtcatttcccacgatgtgaattatatatgaaaagcggagtaggttcttatgtcaggggaatactcccaaggaggcaaaatggaaccgtcatgctagtggccattaattagcggtttagaaatgaaccctgatttcgccacgatgtacatgacccctagaatttcgaatatccacaacactgaggttagttcaatgcagcggaaagcactttgtgtcacagttgcagccatggatcaaggaatactggcagacctaacaggtttgattgccctggaattttttacttgggcacatctgtaaatacttaggcaaacactagcaagtgctttgaaagggaaggcgtaggtacacacaagctggaacagggttaggttcactttaaatctccgaggaaccttcgggtaataccgcgacttggactcgttaaacccaggaaaaaataaggtcccttttacgcgaaatttcgctcgcgcccttaagcgacacagacacgaattgttggtttccaacactaaacgatgtaacacgtattcagagcacagccccgcctattggcgcttatacttggatccgccgtgaccacn

SEQ ID NO: 485336 - DNA, 221 bp, Homo sapiens
  misc_feature (98)..(98): n is a, c, g, or t
cccatgctgtcttcagatggtatccgtgtatatattgcatcttcctctaggctctacacgatgaacaataacacaataagatgtgcttggtttcctanaagccaacaaaattaagatttgacatgaaaaagatattgcctccaagtgaacgagaatcgcgtaagacgtgatgagcagaggattgtaccttgtacaatagtcgcatcagccactaggttacc

SEQ ID NO: 485337 - DNA, 430 bp, Homo sapiens
  misc_feature (21)..(21): n is a, c, g, or t
  misc_feature (65)..(65): n is a, c, g, or t
  misc_feature (87)..(87): n is a, c, g, or t
  misc_feature (91)..(91): n is a, c, g, or t
  misc_feature (96)..(96): n is a, c, g, or t
  misc_feature (99)..(99): n is a, c, g, or t
  misc_feature (103)..(103): n is a, c, g, or t
  misc_feature (106)..(106): n is a, c, g, or t
  misc_feature (110)..(111): n is a, c, g, or t
  misc_feature (113)..(116): n is a, c, g, or t
  misc_feature (144)..(144): n is a, c, g, or t
  misc_feature (146)..(146): n is a, c, g, or t
  misc_feature (148)..(149): n is a, c, g, or t
  misc_feature (163)..(163): n is a, c, g, or t
  misc_feature (172)..(174): n is a, c, g, or t
  misc_feature (176)..(177): n is a, c, g, or t
  misc_feature (211)..(211): n is a, c, g, or t
  misc_feature (224)..(224): n is a, c, g, or t
  misc_feature (228)..(228): n is a, c, g, or t
  misc_feature (230)..(230): n is a, c, g, or t
  misc_feature (234)..(235): n is a, c, g, or t
  misc_feature (238)..(240): n is a, c, g, or t
  misc_feature (242)..(242): n is a, c, g, or t
  misc_feature (244)..(246): n is a, c, g, or t
  misc_feature (249)..(250): n is a, c, g, or t
  misc_feature (253)..(253): n is a, c, g, or t
  misc_feature (255)..(255): n is a, c, g, or t
  misc_feature (265)..(265): n is a, c, g, or t
  misc_feature (279)..(279): n is a, c, g, or t
  misc_feature (288)..(288): n is a, c, g, or t
  misc_feature (290)..(290): n is a, c, g, or t
  misc_feature (295)..(295): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (305)..(305): n is a, c, g, or t
  misc_feature (307)..(307): n is a, c, g, or t
  misc_feature (311)..(311): n is a, c, g, or t
  misc_feature (318)..(318): n is a, c, g, or t
  misc_feature (322)..(322): n is a, c, g, or t
  misc_feature (324)..(324): n is a, c, g, or t
  misc_feature (331)..(331): n is a, c, g, or t
  misc_feature (361)..(362): n is a, c, g, or t
  misc_feature (381)..(381): n is a, c, g, or t
  misc_feature (390)..(390): n is a, c, g, or t
  misc_feature (406)..(406): n is a, c, g, or t
gcttccagttgtataaaagtntagcacatgcaattatgtatagtacgtaataggggataataagngattacattactagtttaggtnattnatggnacnattnggnttannannnnagactgtactccttctacttattaaaanananngtaacgggaaaacngcctcaggnnngnnggtggggggggagggggagggggggagggggggnagggggggggggngggncngggnnatnnngnannnggnngangncattccagtnggacaagatatggnggtaaaagngngggananggngangngngagncgggggngggncnggggaangggggggggggtttaacaagaaagtttaannagtaacaaacatttttaanacaaaaaantttttaaatagaaaanagcctatagaataaggacagaaat

SEQ ID NO: 485338 - DNA, 1322 bp, Homo sapiens
  misc_feature (1322)..(1322): n is a, c, g, or t
agcgggttgtgcgtcttgcggtcggcgtagccatgccgtctcgtgtcctatcagcctatgtcaccgcatgctttcccagcggtcttttgcggcctgatgcccctgggtcctggatgctaggccggtggcctcctggtctctcatgcagtcgtgctctctgctccgcgggggagcccagagtgaggctctggcgtaatttgcgagcggcctttaggatagctctgcgcaggtagcctggtagcatgttccgcactttgtgccctgacagggtagtagcagcacgatgaccatcgcttgtgcaccgtgcataggcgagcaagtaccaagggaccctgttgttcatttagcgatagtgagcagttcctacttgtacaatgcatttgagcgcccagatgaaaatcgcgttttcacgttacaatttttcctcagttgcttattgaaaatgcgacccttggtgctataagaaccttgtgatgggcgtccacacgttgtcacgaatttagtcactgtttccagtgcgacgagaaccgcaacgatagagcgcgatcatcggagaaattaccccttgacttacttaagaatttgccttgacaaacaggcttaacattgcttgttcccccacaagacaacttttgctaacacttaactactatggcaagaacttataggaaccgtgacttgtctcttatttgtaacataaaccatgttaggtctagtaaccccccatttgtggggcctttaagcccttgaaagcactagcgcgatacttcggtcaactgtcgttgcggatgaaacgacaagtgaacttggtctcgtttgtaccgacccaccatttttcagccccagttacgtcgcatatagatccccgctgcacaggaccgtggcattcctgaaatgggcaccctgggtacaatatcacacactgtggctattgttgattacttacatccgtttccgcagtgaaactggagttcgttaatgcagtactccgtgcgaggtccttaacccctgacatagatgaagccacatgcagcccagtgcaatccgcgcctcaaaatgctgtcctagatcacttatcacaaatgacgagccactcacggaaccaaagtcaaaaattgatgcctcgagtcagatgtgaagagccataatgctgcgagcgtgacgagaacaatattcgggtaggaacatgaaacatcagctcgtttgcagcacgcactctcgctccggcccaccgaactctcgacgcgttaatgacgcaagtacctgtgcacgcatgacagtgaacatgaacctagccaaatcaagacacaaaccacacccan

SEQ ID NO: 485339 - DNA, 163 bp, Homo sapiens
  misc_feature (107)..(107): n is a, c, g, or t
  misc_feature (144)..(144): n is a, c, g, or t
tgacttaaggaccccggaccttacctgatgcttgaggactgaagctagctatctgttagcttgtatgacagtataataagtggatatcatgaagtctgctaatgatngggaaaactaaaaaggagcattaacctatctgtgtgnacacgcccatgtactgtga

SEQ ID NO: 485340 - DNA, 529 bp, Homo sapiens
aactcttaaggcagagtgcgaaggagtgttgttttgtagtaaagggtttggtgctgtttataatacagtacacactgtcatgctgcgtgtttcacagattaccaaaattatttactctacactttttcaaaataacatttgagattgaggttccttcactgagtagtctggaagatatagtctggataatttgctatgaagttatgagggatacaagtgaaatactggggaagaaaatggattggaaagtaaaattggtactaaagcccatactgattatcttgactttgttttttaaggcataggtatatattttggatcaaaatccttccaaatttgaaaactcaataaaaataacacttattaaattctagttagtgtagcactcatgctgaagtaaacatgatcgtaggcagaagcaaaattttattataaaatctaaaacaaaaccttatagagttgaatctattccatctgacttcaatatttgccaaacgtttattttacctcctagattgatgttggtata

SEQ ID NO: 485341 - DNA, 737 bp, Homo sapiens
atacggctgtaatcctgggctacttagaaactactgtggactggtttagaaggtataaggttcctgatggagaaccagaatatgagtgtgcgttgtaatgcacctaattcataacgataaggactttgccatctagatattattagtagcactcatgatcattggaaaagcattaatgactaagaaataagcgaatgactagacatggagtaatctagattgcgtgaattcaacttagtctgagagccccttcaagtgtgaatcctgcatgctgtcagaagtccatttcgtgggatgcttatacccaacaccctgtgaatctgtcctgtcacggtcaccaatcagacgtggataagtggtctccatcaccataaaaagtactgagatttctctggaaatatcacagctcgatattgctacatcagtgttcatctgggatgtgttatgaatgtaagaaggtagatgaggctgtgtcaaagctttaaatttgttagaagtcatcttactaatgtcaattctgctgtgactatattccactattgtcatgaatgtgattccactctataagcatgatgcatgatctcatactaagatagacttatagcacatgcttgaatatcaaagcagttagtcatctggaagtcgctagtcatttagatgtgcatgggagctcgtatgggtgttatgttgccatatgtgaggaaataaatgatttttggtgaagcttgaccctaaag

SEQ ID NO: 485342 - DNA, 415 bp, Homo sapiens
ctcccgggatcacgtgatctccgtacctcagcctcctgagtggctgggattacagacatgctccaccatgcctggctaattttgtatttagttttagtagagatggggtttctccatgttggtcaggctggtcttgaactcctgacctcaggtgatccacttgcctcggcctcccaaagtgctggggatacaggcatgaacccctgtgcccggcctaatttgtgtattttcagtagagatggggtttcaccatgttggccaggatagtcttgatctcttgacctcgtaatctgcccacctcgactcccaaagtgctgggattacaggtgtgagccactggacccagctgccaagaattgttttaagctttggtttgagttaatgtatatctaccgcattgcaacacggtctctca

SEQ ID NO: 485343 - DNA, 109 bp, Homo sapiens
agtttgcatgaggtgcacgcagccacctcctctccagcacagagcctgaaggaggtgcgagcccaccgtgtggtcctggcagcatgaaactcaaggtgccatcttagcc

SEQ ID NO: 485344 - DNA, 963 bp, Homo sapiens
tacgtatgtctttcctgggttgtttaatctgcacgatgtgggacatgcgggcacgattgagactgtgaccagtgtcatctgcctcctactgtgcagctgctggtcacagcacatcctggcagccctgacctgagcatgcattgctgtgtgcctgcctgtgaccacctgcaatgttccatgttggctactacaatgatctgctgctgccactacctgcatgtgcgctgctgtggccatgtgtcttcctgtgcatgtttctgcttcccctgctgtgcctgtgtgttgtgttgtgatgtgattgaccttgtgatgtgttgtgcccctgtgacgttctttctgatgtacttttctgtgtgccatcctatcctgcttgcttgaagtgcctgaccccttcccttgtgtgttgctgtctctgtgccattgtgacattgatcaacttgtgccaatgtgagcatggaattggttgtgagctgccatgcatgtgcctttgatgcttgcttctacctgcacctgacttattatcccgttgtgcctggtggcttgtgcttgctgtttgtgcctgatgtctcttcgtgtgcttggagtcttgtgaagacccaaagttgtggcccaaaaggtggcctattcttggcgaacgtgatctttgtgagttgctgtgcagtggcctggaagtcatggctgttgcaatgttggagctgtgtgcccttgcacttacctgcccccttgagtgacttctcacacggagatctgactgaccctttttttgtggccctgcaaattgggtgttgttgatggcccactgtgtggcatgttttcattttttggaccaggccaaccctcacaaaggcttatcattcataatgcctgtgagacccatgcaacgttatggtggcaaccttttccaccacaagggcctgggaaccctttgtcttttacctttggaatgtgcagtggaagggccca

SEQ ID NO: 485345 - DNA, 162 bp, Homo sapiens
gtgtaaatcggagccggtacccaggtcttttcccctcaaagctacatttccatccagtcttcacatttagctgattatcttgcctgtgtaatcgggatatgtcgaaagagaatccttcagggattaagcctacctacctatccagctgcgtttcacttccga

SEQ ID NO: 485346 - DNA, 138 bp, Homo sapiens
taaagaggctactattttaattgacaatgcttttggagtcggggagaaaaaatttaaaaccccaaaatttctttcgtgttacctcaaaataaaaatacacatgtggatttatgaacaatattaggttaacatatttcc

SEQ ID NO: 485347 - DNA, 281 bp, Homo sapiens
gcacgacgcgtgcgattacacatgtgcatcttcttatattttaacacaagacattattgcccacagaagagggactttagatcatggcttacttttcgacattggaacatttagggcaatggcaaaagtcattattgcctatgctcttttcttaatttgtgtttcattagatagccactcaaggaaacaccatgaaagatactgacatcaagagactgctgcatgcccatcttttatgcatattttcaattatcctaagcatcttcattccatcattcttc

SEQ ID NO: 485348 - DNA, 88 bp, Homo sapiens
gcctgcgccgacgatgcccagaatccagaactttgtctatcactctccccaacaacctagatgtgaaaacaggataaacttcacccag

SEQ ID NO: 485349 - DNA, 723 bp, Homo sapiens
  misc_feature (723)..(723): n is a, c, g, or t
ggagatggggtttcgccatgttgcccgggttggtatcgaactcctgagctcaagtgatccgcccaccgtggcctcccaagatgctgggattgcatgcatgagccatcacacctggcctatttgctggagaattctattgagccctctctactaaaaatacaaaaagagtagctgggtgtggtggcacacacctgtagtcccagctactcgagaggttgaggtgggagaatcgcttgagcccgggaggcggaggttgtggtgagccgagattgcaccattgcactcaagcctgggtgacaagagtgaaactcagtcaaaaacaacacccaaaacaaaaaacaacacaaagacctgtgtcgcgcgccgcccgggcccaccggaaaagaggtggaagaaccattcgcgatggcgggccgcgggcccccagagggttagcgtgacacgtgtgccacaacgggacccccagaggacaacaccggggaccactgacacaaacggcgggaggggagctacactcaccccacaaagtctagaaaaaaaagaggccccagggaggagacaccatacgaccggcgacttccgacgaacccaagaactcccagagggggagcagatcccaaggaaggagaaactgcacggggggacccgaactcaagcaccggcgactaccccaaagggcgaagcgcggagcagcaacgttagcgaccccggagcaggttaggn

SEQ ID NO: 485350 - DNA, 108 bp, Homo sapiens
ccgtggtatgaaattcttctcttcctcagctgatgactcgagctttctcctttatatagatcaaaaggagaaagctcgagtcatcactgaggaatgagaagaatttca

SEQ ID NO: 485351 - DNA, 250 bp, Homo sapiens
gatcaatgcaatggagcctgactcgacttgtcgtgctgtcgctcttcgtcgacgaccggaggaaaatgcgagatcagcgatgcagcgtcactctcggaaaggattggaggtaacgcctcaatcagcggattaccttgaaactccagaacaggagactcatggtacttcgcgaaattctggacactccgattcatttgctacctcccgggcggaaccgactgagcagatcaattacctcagcaccccggtg

SEQ ID NO: 485352 - DNA, 376 bp, Homo sapiens
ccaacagggaagatgagttttgagttttttcctgcttctaggatgatagagagcaatcttcaacctgggccttattcctacataagtagctgaaatggggtttgtcttggaaattctctgaaagttaagattaactaccagctggtcttgattcctccttaccattagagtgctcagtaatcttataaattgtgcaatcatttgttttgctttacttttttgttgttgtttatttgtttggttccgtttttgttgttttagtcttttttccattgggtttgaccactctagttgacttggtcaaacctgaaggaaagttttaaattatggggaacaagacctttgaactggctaaattcctgaagctggaaaaaca

SEQ ID NO: 485353 - DNA, 290 bp, Homo sapiens
ggagctttcagggaagggcggtgcgcgccgcagcgcgagcctcgctcggggtgcagccgaatcggctgcggtaattccggctgaactgcgcctggtcaccgaagccccattgataggcgatttccgagatgctcttgcggcatgcgggatcacgcaacatggcgtcggacatcgaaaggcgttggttccggatataggcgcaaacggtgatgccttccccctcaaaaacctgatgcagatatctgagcgagatgccacagccgtctgcgaccatttgcggcgtaagccgc

SEQ ID NO: 485354 - DNA, 344 bp, Homo sapiens
ccaactagtacggcagtcaataataagctaatctaccagaagaagggctatcctagaagggcactagcataagtcaaggatagagaaaactcgcaaagtcaggcactaggagtgtaggaaacattgagatagctcaggaagcagccaaagcactaggatagacaagaactgctagggaaaagctagggagaagtaggccctgctagcaggggaaccaccagatagtaggaaatagtagctatacagcgtaccaaaaactttgacaaactatatccttcctagtaatacttatacactaggcaacttagaaaaaactatcgtaaggatgatgaagatagctagag

SEQ ID NO: 485355 - DNA, 239 bp, Homo sapiens
gcacgagctgggatttaaggagaattgagagaatgtacccacaaatcccagtgatgcttttatacttgcaacacgtgtatccacctctagcttccctgtgcagaaatgtttggcattggaatgtgaggtatctctcaggaaacagagtggcaatgggtaggatgaaagcatcactgggatttaaggagaattgagagaatgtacccacaaatggcagcaataataaatggatcacactt

SEQ ID NO: 485356 - DNA, 174 bp, Homo sapiens
cacgaggtgtttgcgtgagcatgaggcagaaccgtccgcccgcttcggtgccgcagtccggtgtggggcacagtccgacggtgcgccgctgagtgtcgagccgcccgacgcgcaaccggcggccgacgagttcagctgggtaaggtgctggcaatgaccaatttcccggagccg

SEQ ID NO: 485357 - DNA, 384 bp, Homo sapiens
atgtacaatataatacaataaactccaaaaaggaccccttagatcaagagagagagagagagagagagagagcgcgagcgcgcagcccgtacagccgcagtgtgaatgcccacactgcctggttgggggccactgactcattgcggcatgggagacctaatcagacccaggggacccgtcaggaggtggctgtgcccaggctcaaggccagaagagagacagaggcagtgagggtgacgggagagccagacaaggacagagaggtagagcaggggacagagggcgacggaagaaggaacgggcgcgtgggaatgtcgaaggaccacatcacgctgggagcagtgcataggttggctgcggggacaccagggctctactacctgg

SEQ ID NO: 485358 - DNA, 149 bp, Homo sapiens
tcgactagtctgaagaataccatctgaaagaactagatggtacacaatccccacatttaaaatggacagtcaggtttatttaaacgtaaatacgactattttatctatactgggtcaggcttctctgtgcccttcgcctacgtagtgtc

SEQ ID NO: 485359 - DNA, 123 bp, Homo sapiens
  misc_feature (47)..(47): n is a, c, g, or t
  misc_feature (65)..(65): n is a, c, g, or t
  misc_feature (68)..(68): n is a, c, g, or t
  misc_feature (106)..(106): n is a, c, g, or t
  misc_feature (121)..(121): n is a, c, g, or t
ggcaggggggcgggagcgcggcagaacggctctctggtcttccaggnccttccgcaccttcttgngcntgtagatagatggggcagtcccggctggtgcagatgangtcctcgtgtaggangc

SEQ ID NO: 485360 - DNA, 102 bp, Homo sapiens
  misc_feature (23)..(23): n is a, c, g, or t
atattacgatgaagtcatcacgncagttatgatcatcatagaaattcttcttcagttcaccatgtcctgtctttttgcctttttgcctttttatcaacttgg

SEQ ID NO: 485361 - DNA, 363 bp, Homo sapiens
cggtccgtatctgtctcggcgctggctcgataccttccagttgtctgatgcaagccacgtgtgtgctgctcgcagctgtagtatgaagaattgggcaacaacctaccctggatgccgggtgcccgggcgtctttgagaccctgcccaagatctctgccctgtgtttgctagatgtgccctcattccctaccctggctgacatcgcctggattgctgcgggtgacgaggagacatattgcccggtgtcaggagtgatacgcgcccccatgaggcacacctgataaacccagtcgcgctctgtattgtcattgcagaagctaatgccgtctgattcccaatcctgatgtggagtccagagcgaga

SEQ ID NO: 485362 - DNA, 248 bp, Homo sapiens
cagctgtgatagtgagagtctgtcatcaaaaaaagacaaaaaaattaggctatacatgaaaaaataaggaggtccagttcaggatacaataaattctggctgcatgtcaaatcaccaccaggaaattctccccaatcccgactgacccatactgtttcccacaagggctccacacatagtcagtatcccgtgcttccactgtgtgtccaaattctcctcttactggttttcttaaacctgtattggtt

SEQ ID NO: 485363 - DNA, 557 bp, Homo sapiens
agcgtatggttttgccttataccatacgctggaaactcataaatctaaaaaagagtaggtagctacatgagcctgtagtagctgtttaccagtttttctgaaacattaacgtatttaatagagtcaaagtaaagactattatcacattagaatgaaggtatgcatgtatctaatccgttttttttttttcttcttagacggccaaggaaatctgatgtggaagggaaaatagaaatagtgcagttggctagccggacacgccaactcttcgttcgattataagctttagtgaaaggggctaataaggcgggcaaaggggaaaaaggtgcggggagttaaactttttattttacttggtataaaataactttccgaaggttatgatagacatagttttacatttaagctttaacttatcccggcggattggagtgacaggtgaataatcatatttctgaatgataaggtatatttcggcagaaacttagtattggtttagggacccctgatcagaaagaagaggagatagctggagacatcattacgcgggaatggaa

SEQ ID NO: 485364 - DNA, 108 bp, Homo sapiens
caggcaatgctgtcgaccagggatgtgtaggatgctctttgactacctggcggacaagcatggttttacggccaggagatatttagtatacactctacagagtgcaaa

SEQ ID NO: 485365 - DNA, 134 bp, Homo sapiens
gcggccgcctactactactactactactgctcgaattcaagcttctaacgatgtacggggacatggtgaaaccccgtctctactaaaatacaaaaaaatagctggacaacagagcaagactctgtcacaaaaaa

SEQ ID NO: 485366 - DNA, 106 bp, Homo sapiens
tggtgtaagggaccgtgctgtagtaagggaacgtgcaggtgctaagggaatcgtgctggtgctaagggaattctgtgctggtgctaagggaatacgtgctggtgct

SEQ ID NO: 485367 - DNA, 457 bp, Homo sapiens
gacattcgggcttgttttattggcatttaaaaacaacttttaaaaccccattttttttgcccaaaaaaaaaaaaaaaaacccaaaaaaaacccgccccagggaaaggggatcttttgccaattttgggaaacttgcctttgggaccccctgggctttggggtaaatgggggggccaacctaaaaccaacctaagcctccagggccccccacgggggggtggggcccccctttaaaactcctttttgaaggcttggggcatctgccccatgattaggaagggcccccctgcccccgttataaatgcccatttcacactggcatggggatagggactataaaacggcccttaaaaacaaaccaaaacctgagggggaacccggaagggacccccaccccctggggctttgctctcatcctagcttattgggccaggggcccctttggcatttccctttt

SEQ ID NO: 485368 - DNA, 188 bp, Homo sapiens
aaaaaacctgggggcttaaaaaaattagggctggattaaatccacccattttggttaaccaggcaattcgccttttttggggttggccttaaccttagtaaaaaggccctttaaattttttttaaaagcctttgaaagccttttggttgggtttggtttttttccattaaggtttttatttggggtta

SEQ ID NO: 485369 - DNA, 1406 bp, Homo sapiens
aatgctgctctggtttcttgcgcgcttggcgctacagggagtgcgggcggcgactccttgcgcaagtcagcttgcctgggaaagggctttgtggctgaaagcgactggttccttgccacaaaggctccgctggcgtttgcggttcagcggccgtccctgagtaagatagccacttttctccgacgctgccaatagccttctccaagtgctgcaggctttcatcgctttgcaggagccatgcctcggggacggaagagtcggcgccgccggaacgcaaaggcagctgaagagaatcgcaacaatcgcaagagccaggcctcagaggcttcagagaccccgatggcggcttctgtagccccgagcacacccgaagaatacctgagcggcccggaggaagacacaagcaccctggagaaggcctccagtaccccttcagaagcttcgagcactgccctagtgcaaaagccggttacccggagcaattttcagggcaccaagaaaagtctcctaatgtccatattagccctcatcttcatcatgggcaacagcgcaaaggaggccctggtgtggaaagtgctggggaagttagggatgcagcctgggaggcagcacagcatctttggagatccgaagaaggtcgttacagaagagtttgtgcgcagagggtatctgatttataagccagtgccccgcagcagtccagtggagtatgagttcttctggggccctcgagcacacgtggaatctagcaagctgaaagtcatgcattttgtggcaagagttcggaaccgatgctccaaagactggccatgtaactatgactgggattcagatgatgatgcagaggttgaggctattctcaattcgggtgctaggggttattctgctccatagagagatcctaggcaaacccttaggagtggaaaagagaatccaaagtatctgctccatggagtagataggcagggtcctgaattcaaaaggttgtggagggtggggagggcactgtatttggtatttgtgaccagtgctaattgttaaactgcaaagtagtgtttgctatagatattgttatcttgtattcattttataacactgttgactaagaatcacaatatgtttaaatatatacttgaggaaaagtttatgttatttttttctgtcgttggcatttgatattaacagctgtgctaaccttattaaatgaagtctttgtgtcatgttgtgtgatggatagaaagtaccactgagaggctgttctttgaaagtttggaataaccagtaaagtgtgagtggaagaagattacagatttgttctgtctttcccttgtgtctgatgtcttgtaatggaacacatttgtaaatatgctcactgtgcaaatagtataaataaaagcatagtaaac

SEQ ID NO: 485370 - DNA, 267 bp, Homo sapiens
cgatgatccattcgattccatgtgatgattccattcaaaatctattcaagtgatgtctccatttgattccattcgaccatgattgcctttgattccattcaatgattccattcggttccgtttgatgataattccgttcgattccatttgatgattccatttgattccattggatgagtccattcgattacattcgatgattattccattcgagtgcattagtatgattccattcgagtccattcgatgattccattcgattccatt

SEQ ID NO: 485371 - DNA, 514 bp, Homo sapiens
ttatgggaaaaaaagttccctgggggggggccaacccaaagggtaaagggggtttcgggggtttgggggaggcaaaaggggcttttgaggacaaaggggggggaaaaaaagcccaaaaagattttggggcaaaagcccgggggggtttttaaggggaagagggtttccaggagggaaaaaaggaggggggttcccccaccccccaagaaaaaaaacgaaggtttaaaaagttttggccccctggtttccccttttccatttaaaaaaaaggatttgggggtttttttggttcccggaaaaaaaaaaaacccttttggggcctttccaaaccggaaacaatcccgggggttccctgggaaaccggtttggttaccatttaaggggaaaaccggggtgggttttgcggggaaattaaaaaaacctttttaaaaagttggggaaaaaaccaacccccttctggaaagtttggaattaaaatggtttttcccccgggcaaaaccccttttttttccca

SEQ ID NO: 485372 - DNA, 215 bp, Homo sapiens
tgagtgctatagcgaggagatactcgttctgagaacctctgaggtgatgggatctgtgcctctgggtcagggtattatgtgtagtagatgtagtgccgagacaggagtattcgctcttgtatagccaggctggagtgcaagggaaaaatcgtatggtctagatggacagcatctacctcgcaggtacaggctattctcctgcctcagcctcccga

SEQ ID NO: 485373 - DNA, 845 bp, Homo sapiens
attcctaggctccgacaatcatggtcaacagaagatcaagctgcaaatatgtatgtcgtaaaacttaaatgataaagctagttaagtcttgctaatgactagttcaaaggtcatgggtacattggacctaagttaccgttctagatcgtatagaagaaagatacatcttaagcacagattggtgtatccaggaattgagtggggggaagaggtttgttgtggattctttcatactgcaagagaagaaaccatttgcctcttggggaatgagctaacttctgatctagtcttaagactagaatgctaaaaacaaaaacatgaaggaaattaaaacccttattattgaaattgattgtaaaaacattgttactggaaatttatgggacttgaggccttcctccagaaaataaggacttgattgtcaggcctatatgaggttctgaaccttaatgccatgtattgtacttactaaaaattgtgtcaatgaaaagtacattagcagtatgaacttctggtccagttggaagttttccatgtgaaaaatgtgatgtttgcatggaactgtttgaaacttgtttattttctagtcccccctccgcaaatgtatagaatttaagctagattttcccctttggataaagacaagattgacgtgttatgggaattggtgttagtagtaggattacgtggaatatagattatataagctaagctaggagctttgaaggaattctgactatttggaccggtgcaatggtcacgaatgaggaatggcttcaacggctaagggggaaaagagggaacaagagggcattaaaagggaggggcgggaataagggatagaa

SEQ ID NO: 485374 - DNA, 217 bp, Homo sapiens
gtatcctgtgggcagatagccacatcccctatgcctggtaccctatgcctagtggtacccacatactgggtacacacacacacacgcacacacatttttaacgagagggtctcactctgtcacccaggttggagtgtggtggcatgatcttggctcactgcaacctccgtccggggttcgggcagtcctcccacctcagcctccttggggcctctgg

SEQ ID NO: 485375 - DNA, 304 bp, Homo sapiens
cccttttgggggcccccccccatttttcccctttagaaaggtggcaggaaatttggggaaaatttgaaaatcccctttcaaaaaaaaaccatggggccaaaccccccgggctttatttttgggggtccccttttaaaagggattgtttttggccccgtttgtttaagtccgggctcttattgggtcaaaaaaaaaaaagttaacttcccttttttgtaaattagggaaaaattaaaaaaagaaaaaagggggaaaaacattggaagaaaaaaaccgggttttgggtttttttttaaaacaccca

SEQ ID NO: 485376 - DNA, 496 bp, Homo sapiens
atcctgtgtcatcgttctgcggagagtgtaaaagtatttgtgtgtgatagctaagtctttacataaaataacactgcttattgattttattttaaatatttgtaatgcttaatttatatggttggtttggttgatatgttctttattaaggaagcaaaatacatctctcgtactgtcttgctattttgagatagagcatagcctttaattaatataatctaaaaatatttagcatatacttgattaattcaggttcataaggattagagtaaggacagagacgtaggacgtgaataaaatcattcagttaagacttggtgaacttattaagtgcttttgggcccatttaggcatgggtgacttaacgtactgggcaaaagttgggtaacttagctccattctttgtgttctttgaacgttggtattattcctcatactcttgtgtcattaatgatgaagaccctaattaccaagctgtctatgctaatcgcattac

SEQ ID NO: 485377 - DNA, 199 bp, Homo sapiens
tgtctacatccagtcgtcgtctgcgtgagtatcctaatatttccatgcagggaagggcgcgctccgactggataagcaatttatttcccgcatggcatagtgtttttgcactacaggctctaagtgtgagaacctggtctggatttgtttgaaattatttcaccaagaaagatcataaataaatgtttctttcaagaaa

SEQ ID NO: 485378 - DNA, 457 bp, Homo sapiens
gcaggtgtggatgtaggtgtgggagtaggtacaggtgtagatgcagctgtgggtgtggatgtaggtacaggtgtagatgcagttgtgggtgtgggagtagggtcaggtgtagatgcagatgtgggtgtaggagtaggcacaggtgtagatgcaggtgtgggtgtgggagtaggtacaggtgtagatgcaggtgtgggtgtgcatgtaggtacaggtgtagatgcaggtgtgggtgtggatgtaggtacaggtgtagatgcaggtgtgggtgtggatgtaggtacaggtgtagatgcagatgtgggtgtgggagtaggcacaggtgtagatgcaggtgtgggtgtggatgtaggtacaggtgtagatgcaggtgtgggtgtggatgtaggtacaggtgacgcagaagtgagtgtggatagtcgacgcggccgcgaatttagtagtagtaggcggccgc

SEQ ID NO: 485379 - DNA, 166 bp, Homo sapiens
gagtaagtgactcagactacatccaagggaatgtatattagggcgatcccaatatacaccacaagccaaacgacttccagcgtatcctagtcttcagtacttaacttcattataccaccttatgcccaagtcatactagctattattcataggaccacacagtagt

SEQ ID NO: 485380 - DNA, 924 bp, Homo sapiens
ggagggcacgtgcatgcccctctggcttaagagttgcatgggtagtcggtagcggatggagcacttctggtactcgtagtagtacaagcccgaatagacggaaatagtagccgagaccattccttgagtaggagcagaacgcggagaatctcgacatgtagacatatcattgaaaagatgtcatgctagattaaaggggggaaatgcgcaatgcaatgagctcgacgaaaggtagcattaaagtatgtgtagtgctacttgaagagagaagccgagtacgggttgtagctatactatagtatgaaaaactattactgacgacctttctatgaggatcgagacatcacttggaattcattttcaaacatggaagttcagatttgttctttatatcgatgtttggagttcgccattaataacgaagcgagcaatatgaatcgtgagtaagtaggtacgtcatgtatgatttaggatgtgctggatgattatttgaatttgaggtattgagaagtggggtctctctaaatggacattgatgaacagtgaatgtcctgagggaaaataaaccatgggtgatatttgctggcgaatgatttcgatgtaaccagaagattatagaagactaaaaagtcttcttatgatttcttcagaggcccacagtatcaattatcgcctgggtggatagacgatggtccggagcttcactggacggaaacggcagaatgtctttcgaagctatagtgccggggaaaccatggtgcgaacaacccgatggctggggagatggagccatagactggcgaggggaacagtatgacagccgagtatcgaaagcaagtgcaaaaagatccaacgcaccttgcttcacacacacaaagatccgaacataaatgctcacacatctgtacaccggctaacaaaaaa

SEQ ID NO: 485381 - DNA, 1065 bp, Homo sapiens
  misc_feature (301)..(301): n is a, c, g, or t
  misc_feature (319)..(319): n is a, c, g, or t
  misc_feature (353)..(353): n is a, c, g, or t
  misc_feature (417)..(417): n is a, c, g, or t
  misc_feature (429)..(429): n is a, c, g, or t
  misc_feature (434)..(434): n is a, c, g, or t
  misc_feature (486)..(487): n is a, c, g, or t
  misc_feature (489)..(489): n is a, c, g, or t
  misc_feature (500)..(500): n is a, c, g, or t
  misc_feature (513)..(513): n is a, c, g, or t
  misc_feature (521)..(521): n is a, c, g, or t
  misc_feature (530)..(531): n is a, c, g, or t
gcggacgctgaggcagatctgaatatgccccaggttcagaagatctcggttacaccttttaatctcctctccttccacccctcatttcctttttgcacacattacaggtggtgtgttctgtgataatgaaaagcatcagaaaagctttgtacttgtggtttcctctattttgaattttttgatcaaaaaactgattagcagaatatagttggagttggcttcatcttcctggggttcccctcactcccttttttgtcaaccccatctgtagcctcttcctctactcaggcagtcgacccgncacgatgagaagtgggancagcagagggcgccaacttcaggagtccgctttncccaccaggcttcattcacccagtggacctgaactgtttggtagagccacctcggcccttcctntcctcatatgtntgttntggtatgcgcacagttcctgtgggacttgggcccgtgagagttttccattgnnanagaagttcagntggtcccattgtnaactcagnctcaaatcnncaactgtcaggccctacaaagaaaatggacgagcctcttctggtggatagctattgactccctactgagctgcccatgctggtctggcaaacacaccttatctgactttgcctttcacaaacagtaagtgtgattacccatatatcacagcccctatgactgacccctcagggagatcagcactgattaccatcacatgggtgggcaacgactatcagcagcaaaggacacgaatacatactagatcaggcataatacgaaaccaggctcgactcacagtcgtactcaaaggctacaaggaatacgaaacggggatacacccctatacgaacaagagcacctgcataacgaggaacaacgcacagtagaggaacatccacactataactgcagcggggcaacatacttaggtgcgcatggtggcatctacacattgtccccaaacacaagggaataagcgcgtcgaggagggaacgcacacgaagaccacgaggagcagcagacgcagacacaaaaaacgacgacacagaaaca

SEQ ID NO: 485382 - DNA, 176 bp, Homo sapiens
tgcctgccccagcatttggggggcgaggcggaggcagatactagtcatgagatcgagaccatgctggctaacacagtgaaaccctgtctcttctaaaaatacaacaaattagccaggcgtggtggcgggcacctgtaatcccagctatgcgggaggctgaggcaggagaatcgctt

SEQ ID NO: 485383 - DNA, 156 bp, Homo sapiens
cctttttgcccaaatggcccatgttcgaagactgcacaaaaacaacaatagcctcatcatccccaccatcatagtcgcaccatcaccctccttaaactctactactacctacgcctaatctattccacctcaatcacagctatctcccccagtgat

SEQ ID NO: 485384 - DNA, 393 bp, Homo sapiens
cagccgaaagctgactttctgaggtcacagagtgaagttggcagcagaggcagtctccccacttccaggccctggcatttttcctgcacacacacacctcttggacttctaccatcacagaaacagattttttttcgatcccttttagaaataggcgaacggatcaaattcagtaatctcccttactctgagccttgcctacactggcacattcctgaaaagtgtaaagctgtgtgggactagccacttaatcataaccaaacccctgcccaggtccctcccacagaagttagtcaccatccctgggaggagggctggatcttcccttggggccacaccacgctgatccctggaccacaaggatgcttatgaggtctgctcactggaatccca

SEQ ID NO: 485385 - DNA, 1349 bp, Homo sapiens
cctagactacgagaaggagaacgaaatgatgaagtcccacgtgagtggaccaagccatcaacaacgccatcaactacctgggggagaaaacactaaatccatatacaacgactgactagacggaaccgtgagaagacatagaatcatgacaaagaacgacacatcatagtgcaacataacacagatacacaacgaaagcaagaagatacaaagataaaacaagagaaaccatcagatgttttttaaatcaaacagacggaaaggaaacaaagtagcacaacacacgataacaacacagagagaacgcgagaaaacacacatgacaaatcaaacaaacaacgataaagataacagactacaacctcagacaacaaacacagaagaacaaacaaagccagcacagaacaaacaaaaaagaacaacaacaaagacagacaacgtacacaaaaaaaaaacaaacaacaacacacatataaaaacaaataaaaaaaaaaaactaaaaaaaacaaaaaacaacacacatcaaaaaaaacaataaacaaaaaaaaacacaaaaccataaaaaaacacttactaacaacacaaacaacaaaaaaaaagaaaaaacaagaagaaaacacaaaaaaaaaaataatacaaaaaacacaacatacaaaaaaaaaacaaaaaaaaaatcaacaaaaaaaaaaacaaaacaaaaaataacaaaaacacataacaaacaaaaataataaaaaaaaaaaaacaaaaatacaacctacacaaatacaaaacaactcaaaacaaacacaaaacacacaaaacataaaacaaaacactacccaaaaatcaataataaataataaagataataacaccacagtcaaaaaaacaaaaaaaacacaacaacaaaacaacataaagacaaagaaaagaagaccacgcaacagagggataggacaacaaaaagaggaaagaagagcagagagaataacgagaaagcaccaaccagaagaaaagaacgggagaacgaaagacaagaaaagagagaaaaaaaaaaaggagaaggagccgaaagaagagaaaaaaacaaaagaagagaaaaaaacagaaagagcaagagaagagcgacaacagaaacaagcaaggaaagaaacaggaaaggggagagaaagaagaaggggagggacaagagacaacaggagcggggggaggcgaagagacgacgagagacacagaaggagaggacgaacgaaacagaaggaagagcggacagagaagtgacgataggagaaaagcaagagagacagagaacgatcaggagagagcacgagcagagagagaagaacaaacagagacgaaagacggac

SEQ ID NO: 485386 - DNA, 127 bp, Homo sapiens
tctattaaccacccgtcatacttggaaaggggagatggccaatctgtctagttctgggtcctaccagagagcttgcccacgcgaagtacagcagagtaggccgatgactatgtgacaaatgttctac

SEQ ID NO: 485387 - DNA, 365 bp, Homo sapiens
tcgtctttttgataggattgatttcttacttcatctatgtggtggaaacatacttgtatattcactcctttaaattattgaggctgttatggtgtcatattctatcctggaatgtccatgtgccttgagaagaacgtgtatctgctgttgttgggtggctggtatggtttgaatttgcatttatcttatgagtgaggtagagcaatcttgtccatatgtttgcgagccatttgtttgctttttctgtaaactatattgttgtcatttttcttattttatgggagcttattatatacatgctaagaacaacaaaaaaccaccgctgtaaccgtattcaacaagacgaggggtacccgaggctcgaa

SEQ ID NO: 485388 - DNA, 408 bp, Homo sapiens
cagctcagcctttgctcccctaccaaagtccctccccggagtggagcgcacctagggtccctcttccgtcccctcaggcccagttaaccgtatcagaacagacagcctcggggggaacccaccacgacagcatgcctcccgtccacggtcagacatgccaggataccccagagacatgaatctcttccgaattccgtggagacgacatatcgccaacatccttgttcactcatctagcctacatgctcaaaaaatctggaacgtacccagacatcgatgcgccccgcgaatttcaggggaaagaagccaggtccatgtaaagctgtgagtgattcactgcaccgagtatcatggaaactctttcaccaactaacatctacacctctacaaggacgtgatatgaaggta

SEQ ID NO: 485389 - DNA, 250 bp, Homo sapiens
  misc_feature (5)..(6): n is a, c, g, or t
  misc_feature (18)..(18): n is a, c, g, or t
  misc_feature (35)..(35): n is a, c, g, or t
  misc_feature (45)..(45): n is a, c, g, or t
  misc_feature (56)..(56): n is a, c, g, or t
  misc_feature (68)..(68): n is a, c, g, or t
  misc_feature (76)..(77): n is a, c, g, or t
  misc_feature (102)..(102): n is a, c, g, or t
  misc_feature (104)..(104): n is a, c, g, or t
  misc_feature (110)..(110): n is a, c, g, or t
  misc_feature (123)..(123): n is a, c, g, or t
  misc_feature (147)..(147): n is a, c, g, or t
  misc_feature (172)..(172): n is a, c, g, or t
  misc_feature (175)..(175): n is a, c, g, or t
  misc_feature (200)..(200): n is a, c, g, or t
  misc_feature (207)..(207): n is a, c, g, or t
  misc_feature (238)..(238): n is a, c, g, or t
gcatnncagatgaattcnagattacaccactgagnattttaaagnaacagtatggnttgattgacttnacaaacannatattattgatggatattattgtancncttgtntatgatgtttagntgatctctcatgtgttgattatgnatctgaatatgggatcagcgtatgntantatcatcacagctgtagcatatctnggttttngctagattgggggactaacatctggagacantcattcatcttg

SEQ ID NO: 485390 - DNA, 177 bp, Homo sapiens
gagcgtcacatggagcttatatttagctgattcatgatgtttactaatcgatgcaatactgtagcaggaggcagaagagaagacagtaattactatatagggatatgctgtgcctggccctttcgctaaatgctgttacatataatatctcatttaatctacctagcaaatacattt

SEQ ID NO: 485391 - DNA, 675 bp, Homo sapiens
  misc_feature (429)..(429): n is a, c, g, or t
actagttctagatcactgacggcagccgcagggatctttataaaacgaaaatcagataatgtcacttccctgcttaaagccctttgagtggcttcccatgcacttagaaaaaaaaaaaaaaaaaaaacgggccaggtgcaagggcttatgcctgtaatcccagcacttggggaggccgaggcgggcggatccccttgaggtgggtagttcgagaacctgctgggccaacattggagaaaccctgttgttctctactaaaaacacaaaattagtcaggtgtgatggcgcatgccttgtaatcccagctactgtgggaggctgagtcttcaggagaaacgctcgaacccaggaggcagaggtgtgtgggtgagttggacattcacgccattggcacttccagccggggcaaccaagagttgaaacctccgntctgaaaaaaaacaaaaaaaaaaagccccaaactctcaatataaaaaactctcaagttttccatggggggtaggtggttaaacgcgagaagaagattaccaattgaaaggctcttaaaaaaacttccctgtgcaaatttgggcaacacctttaacaaaaaaaaaaaacagggggggggcggcacccttttgtagtttgttgtttttggtgagaaactttcaggagaaaatcattttgttggaaaag

SEQ ID NO: 485392 - DNA, 513 bp, Homo sapiens
gaccgtggctgaaggtcaagagagaaagaaagagagagagagagataagtagtaaaggaaaaaacagtgtaccctattcctttaaaagccaggtaaatttaaaacctataattgataattgaaggtcttctccgtgacactgtaacactccaataccaccttgtccagtgtaaacaagggcatagcccaaaagcactgaggccactgacaactcgtagccttcctatcaaaaatccttaacccagtaacccgcagatggccctaatacattcaatctgtagcgacaactgttttgctaacacaagaaagtatgaggctattctgttaaaaaaaaaaaaaaaaaaaaaaggagggttattccaattttacccattaaaattccctttaaccaaggggtttccctaccgggttctaattcttatttcctgtacaagggcccgcccagacctaggaggaacccccttcaggaagggccgatagacagtccccccctccccctgggtgttggcggga

SEQ ID NO: 485393 - DNA, 146 bp, Homo sapiens
ctccaagcttgaatatcgggcagggtgattgttattgtatgtatctttacctaaattgctcaggcattattccagcagtagatagtgactcgtggaactgtccacggatccagcgctaaccttcatccacctggacatcgctgttt

SEQ ID NO: 485394 - DNA, 1431 bp, Homo sapiens
  misc_feature (479)..(479): n is a, c, g, or t
  misc_feature (1137)..(1137): n is a, c, g, or t
tgggaagccccgggcacacgggccagatcggcgagggcccggagcagggcggcctttcgtccacgattccctccaggggcacagtttcaccacacgcaccccctttctggcacgtgggcaaagggtgtgtgtcattcagcaagccgtggtcggtggagggcaggagagaggagtgtggtgcacgaggtggagtgaaaatcacgagaaggaggccagaatcctccctccgagggggcagcgtgctgtgaaccaccaagagggaggccgagaaccctcgtggggaaaagtgagtggggctcaataacccataatagtgctctttcatatctccaaagagaggagcgtggcactcgcgggaatagctataacctctctctctctccacagatctctcgtggcaccgaggagccagagaaattctcccgagggggctctttctcacatatctacagacctcttggtttcccacatttagaganctctctatccccgggcgctccccaattatgggccgcgggcgcacttatacactcgagacaacgcccgtgtcgcagccttggtgggagaactcttgtgcgcttggggcgccagggcgacacatgttgatctcaaattcacaaaaaagagctggacaagtatctcgtgggcgggacaacgtgagagggagcgtggtatccccccaatgggggggggggtggttacatataacacccaaaagaaagtgtccccttttcacatggagatgagcgcggacccttcacaagaataatcacaaacatttgtgggtccacaacaccctgtggtgcccaagacccgcgtggtgacccaacacaacactcgggggggaggtatctccttacgagaatgtgggcagctgtgaagtgaaaccacctcacagggggggagtaccaaccatggttggtggtgggccaagagaaggcggacaacaaaactaaaagggggggctttcacaacacagagtccctggcagaaggctccccgggaataatacaaggagtcccctccgtttggggcgcaaaaaggaggaaacacggggggtttatatcacacacaaatagctgtgtggaaagagcccctttcccacatcttctggggcgaaaaggagacatcactccncgggaggaaaaagcaacgagcggcgccaccagggccgttgggccaccgcttgtagtgaggcagcccaattccaccgagaaaagtgtgggggaagaaacgggccagtatgctgtgtggaagtgtagtgacggcctccaggaaaacctatggggccaggtaggagaagatgagaagacagagcccattaatgcgcaaagaacgtctcggggagatgcaccagacgcagtataagcaggggcggacctcaggaagggttatggcacgcccgacaataaggagcatgcgcccatatag

SEQ ID NO: 485395 - DNA, 212 bp, Homo sapiens
taccatcatgggtcagatggacgaagaggatataacacgtaggaggtgaagattattgagccatgagtggagtctgaagccacggatgaagtcatccaggaagcaagtacatagaaaagagggtagtacagatgcaggcatatgggttagagtcagcaagagacggagtcttgctctgtcgcccaggctggagtgcagtggtgcgatcttgg

SEQ ID NO: 485396 - DNA, 776 bp, Homo sapiens
tacccctccttagtctttatgcgctcaaaaaccaaattaaaccccccccccttgtaacgggggggcagggaaaaaaggcaaggaacgcccgaagccccgcctgggagacccccacgtctcactgtgcccccgcgccatttttctcgccctgagaatgtgggatttgtgggttttcacatctcttgctccctgtgtgtggcgtgggcgatgagagttgtgagggggtgagacgccctcgcgtggggggcacctgtgggccacactgtgagacgccccctgtgggagagaaaaagtctcagagagagagggagagtgtgcgaagaagagcgcgccagcgtgcccacgagccgcctgggcttctcagtggaggacaacagaaggcgcggtgtgcgccccctcccagagaagagtctctctgtgagagagcggagagagaaaggggggcgcgagtagtgtgcgcgcaagaagaggtgtctctctcctctctcagaggagtgtgttctcacgagaggagagcgggtcgtcgccacccacggaggaagaggacgccccactacaaagcagcgacggagagggggcgcggccccctcacatcgtgcggactagaaggcgagcaccacagaagagaggcggctgtggcgacccagagaagaggcggctggaaaagagcgggggctgctacataacacaagaagtagtggtgttggtgtgttaacaacaacaagaagcaaaggggggtactccccaaaaacaacagaaaggcggggtgtgggcga

SEQ ID NO: 485397 - DNA, 810 bp, Homo sapiens
  misc_feature (15)..(15): n is a, c, g, or t
  misc_feature (142)..(142): n is a, c, g, or t
  misc_feature (174)..(175): n is a, c, g, or t
  misc_feature (195)..(195): n is a, c, g, or t
  misc_feature (207)..(208): n is a, c, g, or t
  misc_feature (302)..(302): n is a, c, g, or t
  misc_feature (306)..(306): n is a, c, g, or t
  misc_feature (323)..(323): n is a, c, g, or t
  misc_feature (372)..(372): n is a, c, g, or t
  misc_feature (385)..(385): n is a, c, g, or t
  misc_feature (402)..(402): n is a, c, g, or t
  misc_feature (406)..(408): n is a, c, g, or t
  misc_feature (492)..(492): n is a, c, g, or t
  misc_feature (532)..(532): n is a, c, g, or t
  misc_feature (548)..(548): n is a, c, g, or t
  misc_feature (590)..(590): n is a, c, g, or t
  misc_feature (740)..(740): n is a, c, g, or t
  misc_feature (797)..(797): n is a, c, g, or t
aaggtgagagttttnataaagtagtatgtacaatcctgcaatgataaaagacttcctaatttaattctaagtagtgctaatcttcactatgactgctattagtggttcagctgaagacttacaaaatcgatagaagctaaanttctctttgccaccaaagttacaaatgttaannagttcaaatatgcccatcanagctgccgtaannttctcaatttctatttctacatgccatgatccagactgtacctaacaaaaacacggtacatttgtattggaaaacagggtcccatttatttgtnaganaaagctgggtctcagcnttcaccagagccaaattcaatggcaacctgcccataagtctcaatttcncttcttgccaaanacaaaatagagtttacntaannntggatatgacccgggtgaccgtatacatcagtgtatggccggtgctatttacatgtgagatgttgccttgcgtaattccggggntagggtaccatcatgcctttcgtttggcttttggggtggnagctgcggttgcgggnctgagtttgcttaccatgattgtcccaatatttacttaaganacaatacccaaaggtttcttgtttacatatctctttccacatctagctattcatctgtgtacagatttacaccactttagcaacaagaaacttttgaacaatatctattatactgacatattaaactgaagatatgaatacataatcacnctgaaagttttgatgaacatgtatgacagactcccccgacttagtttttcccatgtnaaaccctatttgg

SEQ ID NO: 485398 - DNA, 231 bp, Homo sapiens
  misc_feature (1)..(1): n is a, c, g, or t
ngagcggacaaggccaggcatagtggctcacacctgtaatcccagcactctgggaggctgaggtgggaggattacttgagcctagtaggtggaagttgcggtgagccaagattgcatcactgcattccagcctgggcaacagagcgagaccctgactcaaaaaaaaaaaaggaaaaatggaaattttgaatctgaaatttctatatggcctgaaaaaaagcactttgagaa

SEQ ID NO: 485399 - DNA, 171 bp, Homo sapiens
  misc_feature (29)..(29): n is a, c, g, or t
  misc_feature (63)..(63): n is a, c, g, or t
  misc_feature (116)..(117): n is a, c, g, or t
agacaggaggggaaggacagaatgggccncagcccagatcctctatccctcaccagaggggangagggagagtggcatagctctgtgtccaaatgtccccagatgcctgtgggctnngccttggcgtgggcttgtgccttgcagggcttggccattggccttctggagcag

SEQ ID NO: 485400 - DNA, 919 bp, Homo sapiens
  misc_feature (27)..(27): n is a, c, g, or t
  misc_feature (62)..(62): n is a, c, g, or t
  misc_feature (64)..(64): n is a, c, g, or t
  misc_feature (67)..(67): n is a, c, g, or t
  misc_feature (73)..(74): n is a, c, g, or t
  misc_feature (84)..(85): n is a, c, g, or t
  misc_feature (90)..(90): n is a, c, g, or t
  misc_feature (96)..(96): n is a, c, g, or t
  misc_feature (101)..(101): n is a, c, g, or t
  misc_feature (107)..(107): n is a, c, g, or t
  misc_feature (109)..(109): n is a, c, g, or t
  misc_feature (111)..(111): n is a, c, g, or t
  misc_feature (135)..(136): n is a, c, g, or t
  misc_feature (141)..(141): n is a, c, g, or t
  misc_feature (147)..(147): n is a, c, g, or t
  misc_feature (152)..(152): n is a, c, g, or t
  misc_feature (158)..(159): n is a, c, g, or t
  misc_feature (162)..(162): n is a, c, g, or t
  misc_feature (166)..(167): n is a, c, g, or t
  misc_feature (170)..(170): n is a, c, g, or t
  misc_feature (172)..(172): n is a, c, g, or t
  misc_feature (203)..(203): n is a, c, g, or t
  misc_feature (282)..(282): n is a, c, g, or t
  misc_feature (286)..(286): n is a, c, g, or t
  misc_feature (313)..(313): n is a, c, g, or t
  misc_feature (452)..(452): n is a, c, g, or t
  misc_feature (457)..(457): n is a, c, g, or t
  misc_feature (460)..(461): n is a, c, g, or t
  misc_feature (543)..(543): n is a, c, g, or t
  misc_feature (572)..(572): n is a, c, g, or t
  misc_feature (706)..(706): n is a, c, g, or t
  misc_feature (917)..(917): n is a, c, g, or t
taattctctcacgcccagttctttgantgatgactgtcaccccaacccctttccccacaggncncantcacgnnggggcgcggnncacanttacantacanttcacncncnttataaaaaacacctgacgcagannccctncctttnattancaaatnncgnatgnnccncncccagtcccgcacattcacacagaccctggnccagggacatcctcctcatatgaagcattaaggcacatgctgtactgtgagccagcactccctgacctcagggtgtgtnaggngttggcactgtagagagaaaccaagantcttcctcaatgcctgccttattctgagcacccacccttagctctgataaggatatcctgagaccacattcaagatccaaaacctttcctcatagatgagggccgtcacccctgcaaacatgaccctgttctgtttgcngggtntgnnagattttcacttctgagagaaaaattgaggagacttctgtctgcaccactcctgctgcaggcctggagcagcttctcagggnagccctggcccactaaggcccagttatgngggcagaggggtgcagagccatacctggctacacccacaggtggacacagggagcaagctccttcgctgttctctgggctcattcccccagcacaggagggcctccatgcacactcattccacaggccccactngccctgtcacactcacacggcacgcacttggcgctgcctgctgtctgccttccacctgggggtacaagaggtcacccaagggggcaggcgtgcagggcctcttggatcttctggcggcaataggagtacttctgcaggatctggcggaggtgctcctcctcctcccgctgcaggatacgtaggaagttatgtagttcaggcatgctgaagngt

SEQ ID NO: 485401 - DNA, 899 bp, Homo sapiens
  misc_feature (458)..(458): n is a, c, g, or t
  misc_feature (496)..(496): n is a, c, g, or t
gactcttaaatatatttcttccagctccagtcgcatgcactagacctgctgtgcttaaatgtcctgtgattgggtcatggaattgcagcatgtccagcacttgaagaggtttggatgctttaagtcactgcaagaggccaggagatggggtcacagagacagaagagacagactgtcttgtacagaaacctaagggctctctattatggactgaatgttcatgaatccccccaaaatcatatgttgaaggcttaaccccactgtgacggtatttggagacggagcctttggaaggtgattagggttagataagatcatgagaggtggctgaggccttgttgacaggattagtgctcagtctccttagttagaaaataactctggccagcatcctaactttctgcagcagtaagtaggatccctaataaaggctgaatatcatactcatacccacaatnccttacttggtttaaatacaaaagattatcgctgccanactgtgcataagaattggtagactatgtttgaaaatgttttcctttaataatattgcaaatacctgaagccaggcaataaaagtaagacacaatatcttatttggtagtggtttactttacaatattgttatcagactcccagttggaaggaagaggtatagtatcaccagtttatactacatatttgcataaacagtaaatatttttctcctacttaaaacaaaaatcaaataatgtttagtaataagactaccttcagccactgtgaaaggacttagtttagggtgatggtgtcttttctacacggttctataatcagtagaggttatactaagctcagggtcccagattaacagtctgattcgatactaaaagcaggtactacgatatcaacgggtcatt

SEQ ID NO: 485402 - DNA, 660 bp, Homo sapiens
  misc_feature (219)..(219): n is a, c, g, or t
  misc_feature (257)..(257): n is a, c, g, or t
ataacagagttttgtgtcgttgcccaggatggagtgcaatggtgtgatttcagcttactgcaacctccggctcctgggttcaagcgactctcctgcctcagcctcccgagcatctgggattacaggcataagccaacacgcctggccagcatcctaactttctgcagcagtaagtaggatccctaataaaggctgaatatcatactcatacccacaatnccttacttggtttaaatacaaaagattatcgctgccanactgtgcataagaattggtagactatgtttgaaaatgttttcctttaataatattgcaaatacctgaagccaggcaataaaagtaagacacaatatcttatttggtagtggtttactttacaatattgttatcagactcccagttggaaggaagaggtatagtatcaccagtttatactacatatttgcataaacagtaaatatttttctcctacttaaaacaaaaatcaaataatgtttagtaataagactaccttcagccactgtgaaaggacttagtttagggtgatggtgtcttttctacacggttctataatcagtagaggttatactaagctcagggtcccagattaacagtctgattcgatactaaaagcaggtactacgatatcaacgggtcatt

SEQ ID NO: 485403 - DNA, 431 bp, Homo sapiens
caccgtactcgatcaaacctggctcacgatcggcaaatcctggacacctgaacagtggaaaaaggagcggtggattttgccgctcgcgtcgatcgggaggtggacatgtcgtatgcccgcaaactcttccttgggcgaaaaacggagacagcatcatgagccttgtagccaacgcaaaaaatgtcgaaggacttgagtttgtcctggtcacgtctgatcatggctttcaagactacgacatcaaagggcacagtgtgctgcgcagagcatgcataccgcatgacatcaaaaaaggtgagaacttcaatctgtaccatggcgagagcagcaaatcaggagtgaagtggacaggcgacttggcagattctcttcacaaatggttctcctcagaaaacacacagcagccttgagcgttgtgaacttcgaaaaac

SEQ ID NO: 485404 - DNA, 102 bp, Homo sapiens
tcaagcttctaacgatgtacggggacatgagttaataaatccaatcaagcattagtaacttacccaagtattctgtttgactattaaaaattttccaatgca

SEQ ID NO: 485405 - DNA, 323 bp, Homo sapiens
atggcatgtagtgaggacaatcagtaagaaaagtatagggaagggatggaatctagggtatgatagaaatgctacaaacaccatttagttgccatcaataagaaatgtacttgtataaaaaaaaatcgaagggctggcatggtccagaaaaattgaacaggtttatttataattattataaagtggaaccgctgagaactgtgcacggaaacattttaactggcagttaatgctttacgtctccgcatttatattaaaaatccacacacaaatgagaatggaagaacggccaatacctgagttctgtcctcattacaggccag

SEQ ID NO: 485406 - DNA, 133 bp, Homo sapiens
tgctgcatccgcatgtcgactctaagcgatccccggcttattgactcgggttaatcgtgtgaccgcggtggctggcacgaacattgagccaaccctggggttagtactagcttagttgaactttcgatttatt

SEQ ID NO: 485407 - DNA, 215 bp, Homo sapiens
aacctgggcgacgtagtgaaacctcatctgtacaaaaaaaacaaaaatgagctgaacgtgatggcgggcatgtgttggtctcagctactcaggaggctgagatgggaggatcacctgggcctaggaggtcaaggctgtagtgagtaatgatcatggcagtgcattccagcctgggttaacggagtgagaccctgtctcaaaaaaaaagcaaaaac

SEQ ID NO: 485408 - DNA, 803 bp, Homo sapiens
  misc_feature (15)..(15): n is a, c, g, or t
tagtgcgatccccgngctgcaggaattcggcacgagggtttcaccatgttggccaggctggtcttgaactcctgacctcaggtgatccaccacctcagcctgccaaagtgctgggattagaggcttgaaccactgtacctggccaaaaaccagttatgatcctgtaagaacgtcggttctcatccttttctgactcagaatgagatgaaagctgtggggacccacctggaaaactgtatagttcgatataatttcagggagtacttaccaccctaccgccagcttaaaaattataagttatccagtagcacataccctagatactaaagagtgtgttcaaagctattcattcaggctgcacctaagtcaccaacagagggtccaattcagaacatgatggcacaactgtgtgatggagtacagttcagactacttgcttactggatttacagacagaggtattaggctaaaaagcaaggcagactgcgactactcttatcttatcttatttgagcaagtctactcttgccagctgactgagtgctcactgtcactgaacctgactcccagctagtgatctctactagcttgagagtagctcaatgagcacacactgctatctgattttgttggaatgtaccctgtgcaactgctgactctggtagcattccatgtgctcaagtgtgatcaagtacacagctgctagattatgagcataattttgagctagagtacagtgcttggagactagatacttgcagtgaaagtttacgggaaatatctacgtataaaccgttaaccaa

SEQ ID NO: 485409 - DNA, 194 bp, Homo sapiens
tgggaagagggtcatgtggacactggggtggggtggtctcccccacctcctcacatttatgctacacgaacacagacacatgcaggtgcctttgccgaaaccaagtcagggttctttcaagttcaccaagggaagggcaggaacaacttcttgctctccaagtcccacacaaggcagctgtcttcacactttac

SEQ ID NO: 485410 - DNA, 171 bp, Homo sapiens
ttgacctagaggatccggctatacattatctcaatggtataatttttccatattcctcaaagtatctctaaggtgatgtcctcagtatctactttaattcccgccaacaaacagcttcttcacagttacatggagcccttgttccttccagaattcctcttcttggctaca

SEQ ID NO: 485411 - DNA, 149 bp, Homo sapiens
aatcagctcggcccgtgttatgtatctcggaaataagtgaaatagatcggacttcccaaactagagtatgtgtgagcagtggcctcgatttgtcttatttttgaagaactaggttctaatcctggcaccaccacttgtgtaaactgatt

SEQ ID NO: 485412 - DNA, 822 bp, Homo sapiens
  misc_feature (60)..(60): n is a, c, g, or t
  misc_feature (74)..(74): n is a, c, g, or t
  misc_feature (115)..(115): n is a, c, g, or t
  misc_feature (140)..(140): n is a, c, g, or t
  misc_feature (210)..(210): n is a, c, g, or t
  misc_feature (264)..(264): n is a, c, g, or t
  misc_feature (596)..(596): n is a, c, g, or t
ctgatgagtcatcttcctagactttcattttaaagagatagatagttatcagggttccangagaagacatggtnagaacatttatatctcaaagacacagagctgagacttcagntttagatactataattgcctaaacnaaaaaggaaggtgtaggtaaagttctagtcaagacaggatggccaggaaaaacaccttaaaccaaggganggcttgctttgctgatttaagccaatggcttctttatcataagacttcccagtnatttagtccttcctctcttccagtgcacagagacatacccctccttacaaataaaaattttctttatagatgtaaatttattttacaaaaatgtttcaaaataaccagatgaaaatcatccttatgccagaaagacttgttttttttttcattactagaaatgaaacagtaagtatttgttgtattgacatacttaggcttagacctgtgtttaacaagaaagcctaataatagcactgtggttagactgtagcctatttttccaaaccatcattttattattaaggaaacgaaggaccaaatacctttcattcatctgatatgatcctttnaaacacattccactaacaagtcccatttggaacagctgaaaatcttttaataaaactttttaaagatgagctcatggcttagtgtaaatttcacaagcttaattaggtcaaatggaaggaactcagatgagtagttgcccaatcagagcccattatttgtaagtcatcagacccctccatgaccttaaaactccactctgacctgattattgcaaacctatttcca

SEQ ID NO: 485413 - DNA, 564 bp, Homo sapiens
taggggcatagaattgtaagttggattgggaaagaaaaacaagacctatctctctgctgttttcaggagacccatctcacatgtgattacacaagtaggctcaaagtaaagggttggagaaagatctatcactcaaatggaaaacaaacaagagcaggggtcactatttttatatcagataaaacagactttaagccaacaacaataaaaaaggagaaagaagggcgttacataatgataaagtgttcaattcaacaagaagacttaactatcctaaatatatatgcatgcaacattggaacaaccagattcctgaaacaattacttgtagacctacaaaaggacttagccacacaataatagtgggggcttccacaacgcactgacagcattagacagatcatcaaggcagaagaccaacaaggaaattctggacttaaattctacccctgaccaactagacctaataggcatctacaggatattccactcatcaaccacagaatatacattcttctcatttgcatttaggacagatgaccacatgctcagtcataaagcaag

SEQ ID NO: 485414 - DNA, 237 bp, Homo sapiens
  misc_feature (8)..(8): n is a, c, g, or t
  misc_feature (10)..(10): n is a, c, g, or t
  misc_feature (12)..(12): n is a, c, g, or t
  misc_feature (15)..(15): n is a, c, g, or t
  misc_feature (17)..(17): n is a, c, g, or t
  misc_feature (21)..(21): n is a, c, g, or t
  misc_feature (23)..(23): n is a, c, g, or t
  misc_feature (26)..(26): n is a, c, g, or t
  misc_feature (31)..(31): n is a, c, g, or t
  misc_feature (35)..(35): n is a, c, g, or t
  misc_feature (38)..(38): n is a, c, g, or t
  misc_feature (49)..(49): n is a, c, g, or t
  misc_feature (57)..(58): n is a, c, g, or t
  misc_feature (66)..(66): n is a, c, g, or t
  misc_feature (76)..(77): n is a, c, g, or t
cccccacntntnatncngcancnctncaacnaaancanactggttaagncgctggtnnctatcatnagatatctgnntggaaatggggtacctgagcagctggactcatcaagctggaaatccatgcagtcggcaaaaccatcacagcgctggtgggctgggatacagcctgctggaggaggcacacaccagagctccattagaacagcttttgttggctgcaaaaaaaaaagaatt

SEQ ID NO: 485415 - DNA, 158 bp, Homo sapiens
aagactgcaagaccaacgccttctcttcctccccatctctctccgcctctgcctactcaatgtgaggacaatgagaatgaagacttttatgttgacccacttccatttaatgaatagtaaatatattttctctttcttatgattttctaaataacatt

SEQ ID NO: 485416 - DNA, 276 bp, Homo sapiens
  misc_feature (65)..(65): n is a, c, g, or t
atgcgtgttggaacatttcacagccaggaggatgagggggaatgggggtggatgtcaggtaagcnatttctggtcccactacaaaactttatttttgattagagtaccattctcaatctcttctacaaaaagcaaaaaaaagcaaaaaaaaaaaaaaaaaggcggccatttcactcatttcaggacctatatacttgtaaggtggtttcctggggtgtgttaatttttacctgttttaaatttttattaattattttttacaataaattcaggtgt

SEQ ID NO: 485417 - DNA, 81 bp, Homo sapiens
aaaaaggcccccccccgggggggaaaaaaacccttttttttttgggttttttcccaaaaaaggggggttttttttggggga

SEQ ID NO: 485418 - DNA, 547 bp, Homo sapiens
  misc_feature (437)..(437): n is a, c, g, or t
  misc_feature (502)..(502): n is a, c, g, or t
gaatgctcttttttgtaatagctgattcgcaatacaagttcaaagcagcgctccctattcaatgatgggtataaagctgcattaccacttttctgaatcactgatgcgcggcacgttccttccaacaggcatgtatatcccggcttgatcttttgtaggagtgggcataccagtttatctggaaataacatcataaaccctaaactacgaatccaacctagtgctacggtgaaactctactcatttcataatatggattataaccgcgagcgactcatacgtgcttagatctgctaatccttaaggaccatacgcactaggcggctccaggaggcgctacgcataagagggctgaaagatgcatctcttaccctatccttcaaataggactatgattcctaccggtccaaagacgggtgacgaggctacatggcacncgagagcatggctctgaccattggacatatattgaacattgcgcctactgactgcccgactgtangagacatagcttacaccggagggtcccttcctttggcatagggcg

SEQ ID NO: 485419 - DNA, 447 bp, Homo sapiens
tgcctcatccagtggcatgcctcatccagtggcatgcctctccagtggcatgcgctcatccagtgacatgccctcatccagtggcatgccctcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccctggatgagggcatggggtaccgagct

SEQ ID NO: 485420 - DNA, 2004 bp, Homo sapiens
  misc_feature (128)..(128): n is a, c, g, or t
  misc_feature (186)..(186): n is a, c, g, or t
  misc_feature (424)..(424): n is a, c, g, or t
  misc_feature (458)..(458): n is a, c, g, or t
  misc_feature (1228)..(1228): n is a, c, g, or t
caactaacaaccgtactcaaaaaacttctagatcctaagcttatctccacaaaagagaacacacaaacagcaaaaaccatagggcccctctcaacccctccctgcacacacctcatcacttgaaaaanggtcctgctcacaacatcacttttaaacttctgaaatccgcccacaactgcccaaatnacaattgaaacccagccacccaaaatttctaaaggaaaaaattttcttctacttttccacaatttaccccaaaatctttctggctacatttggtacaaaaggcaaataacatacctctaccattacattacatcatatgtattaaacggtcaaaaaattatatatagacctacatacaataaaaaaaaaaaaatatattccaattcatcccttctaatccaaaatttcacgcaggaanatgcaggatctacacttacacatcgtaaaacgangcgatgggactggaggagtaactggacatttcaccttcaccttatacctggagactcccaagccctccatctccagcagcaacttaaaccccagggaggccatggaggctgtgagcttaacctgtgatcctgagactccggacgcaagctacctgtggtggatgaatggtcagagcctccctatgactcacaggttgcagctgtccaaaaccaacaggaccctctttctatttggtgtcacaaagtatattgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaaaacctctacttgtcctgcttcgcggactctaacccaccggcacaatattcttggacaattaatgggaagtttcagctatcaggacaaaagctctttatcccccaaatnactacaaagcatagcgggctctatgcttgctctgttcgtaactcagccactggcaaggaaagctccaaatccatcacagtcaaagtctctgactggatattaccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgct

SEQ ID NO: 485421 - DNA, 159 bp, Homo sapiens
aatgattctggatatagttctatcacagtcgttgaagacatgtgcgctggtcaggatattcagcttcaggcaagagatgagttgtgcttctaattcttaatcatccttgtccttagtcaggataccgtgacacaatttaggactgtcagctttataggc

SEQ ID NO: 485422 - DNA, 2004 bp, Homo sapiens
  misc_feature (128)..(128): n is a, c, g, or t
  misc_feature (186)..(186): n is a, c, g, or t
  misc_feature (424)..(424): n is a, c, g, or t
  misc_feature (458)..(458): n is a, c, g, or t
  misc_feature (1228)..(1228): n is a, c, g, or t
caactaacaaccgtactcaaaaaacttctagatcctaagcttatctccacaaaagagaacacacaaacagcaaaaaccatagggcccctctcaacccctccctgcacacacctcatcacttgaaaaanggtcctgctcacaacatcacttttaaacttctgaaatccgcccacaactgcccaaatnacaattgaaacccagccacccaaaatttctaaaggaaaaaattttcttctacttttccacaatttaccccaaaatctttctggctacatttggtacaaaaggcaaataacatacctctaccattacattacatcatatgtattaaacggtcaaaaaattatatatagacctacatacaataaaaaaaaaaaaatatattccaattcatcccttctaatccaaaatttcacgcaggaanatgcaggatctacacttacacatcgtaaaacgangcgatgggactggaggagtaactggacatttcaccttcaccttatacctggagactcccaagccctccatctccagcagcaacttaaaccccagggaggccatggaggctgtgagcttaacctgtgatcctgagactccggacgcaagctacctgtggtggatgaatggtcagagcctccctatgactcacaggttgcagctgtccaaaaccaacaggaccctctttctatttggtgtcacaaagtatattgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaaaacctctacttgtcctgcttcgcggactctaacccaccggcacaatattcttggacaattaatgggaagtttcagctatcaggacaaaagctctttatcccccaaatnactacaaagcatagcgggctctatgcttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgct

SEQ ID NO: 485423 - DNA, 201 bp, Homo sapiens
  misc_feature (22)..(22): n is a, c, g, or t
  misc_feature (170)..(170): n is a, c, g, or t
gatgctaacaagaaaatcatcncttttgaagatgtacaaaaagaccgaaaagaaaaagattttctaacagggactatagcatgggggtctgaaccggccctttgttttgcagtttatagaagagtgcttcgcatgtatgatgacagaaaccatgtgggaaaatatacacnctgaagaaattgagaagctcaagggacaact

SEQ ID NO: 485424 - DNA, 2058 bp, Homo sapiens
  misc_feature (1282)..(1282): n is a, c, g, or t
tgaattataaaaagtttgtaaaaaaagaggatggtaaggtaggaattaagggatagagagtgaaagagtgataagagagattatggataataggataatataaaaagaggagaagaagaaggaagaagagaaaatggggaaaataaaagaaacttaatgaaaaaagagaataaaatggaaggggatcatgataaaagaataaattttaaaattttggaatatgcacaaaaatgctgaagttacgattgaagcaagaataaaagtttttgaggggaaggatgttattataattgttaaaaatttgaaaaagaatattaatggataattatggtaaaaaggggaaatgaaggaaatataaaattaaattatatagtatatagttgatggtaaaataattatatatgggaatgaataaagtggaagagaaaaagtatattaaaaagaataaatgatgatatagaatgtaaaaaggaaggatgaaggaaaatacaaattaaagataataaagagaggtgatgagactagagaagaaattcgacatttcaccttcaccttatacttggagactcccaagccctacatctccagcagcaacttaaaccccagggaggccatggaggctgtgagcttaacctgtgatcctgagactccggacgcaagctacctgtggtggatgaatggtcagagcctccctatgactcacaggttgcagctgtccaaaaccaacaggaccctctttctatttggtgtcacaaagtatattgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaaaacctctacttgtcctgcttcgcggactctaacccaccggcacaatattcttggacaattaatgggaagtttcagctatcaggacaaaagctctttatcccccaaatnactacaaagcatagcgggctctatgcttgctctgttcgtaactcagccactggcaaggaaagctccaaatccatcacagtcaaagtctctgactggatattaccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgct

SEQ ID NO: 485425 - DNA, 136 bp, Homo sapiens
ccccactccgaggctgctcatctctggctcgggtccccctccctttgtggctagagtggcgacgccagcacctgggtaatgggacatcatgctccttggcgtgcacactcctgtgtgctgaactggccatgatgcc

SEQ ID NO: 485426 - DNA, 463 bp, Homo sapiens
acacatactttaatggtaacaattccttgaagcccaattaacttcagctattacaagtcttatgcagatgtcactattagacaatatttagggacttgcactgggttcctcataaaagacaaattcacttaaaagggtaatcaacaatcattaacaggtttgttatgccaacacaaaacatggctgagttacccccctccccgcccaaattactaacacaggatgatcagccccttaagtatacttcaactaagccatttcaacaaacaaaaaaaaccaagccttaaaaaaaagggggggtttcactacccctgagaccactagttaactgtgggtcatactttaaaatgtgagtacacccacacaagaaagcaaattaatcaggtttaaaaaatctgaattatacattgcaaactcgcccaggaaaaacaaactgggggattttaaaaagttaaatttacca

SEQ ID NO: 485427 - DNA, 2043 bp, Homo sapiens
  misc_feature (60)..(60): n is a, c, g, or t
  misc_feature (64)..(64): n is a, c, g, or t
  misc_feature (67)..(67): n is a, c, g, or t
  misc_feature (71)..(71): n is a, c, g, or t
  misc_feature (85)..(85): n is a, c, g, or t
  misc_feature (106)..(106): n is a, c, g, or t
  misc_feature (109)..(109): n is a, c, g, or t
  misc_feature (116)..(116): n is a, c, g, or t
  misc_feature (130)..(130): n is a, c, g, or t
  misc_feature (228)..(228): n is a, c, g, or t
  misc_feature (239)..(239): n is a, c, g, or t
  misc_feature (241)..(242): n is a, c, g, or t
  misc_feature (683)..(683): n is a, c, g, or t
  misc_feature (694)..(694): n is a, c, g, or t
  misc_feature (696)..(696): n is a, c, g, or t
  misc_feature (730)..(731): n is a, c, g, or t
  misc_feature (1267)..(1267): n is a, c, g, or t
ctctggatcaagtgtccacatgtatttctggaaagatccagatggtcctcacctgccctntgcngangganaggaaacttaaagnacccaggacagggaacatggntcngctccanagccaccagctctngcctgtccccttcactctttctagatcattccttgcactctgctctatctttagaggtcactggttcaagtaagtcatcatgaaacacctgcaaaaanactgccccacntnntgcctccactgcctgatgactgaactgacctccaggcttgactctggtctcccctgtgttatttctgctgaaacatccagtcccaggccaggctgctcagtatcttcagggtttcaggacaatgggaagtcccattattactcatctctagaatgtccttggaaatggaagctgcagagaaatcacatctaggggggcaaagtaggatggaatttggaaggggcccagcagttgcacattccaggtaaggaacccaaggtgagccagccagtcaactgattatggagggactgggaggggtaccaggggctgtgactcccactgacgtgtctgtccatgacccaacactgctgctcaattgacacttgagaaagtctgtgcttccctaagacagagcagctggcctcacagtctttgagcccttagatcatcatgcatctntcttgtgacanangcaccagctattggctttcaaggactcgggtggnntgagaggtgggagatgccaactctgattgaaggatacctgtggaggaatcaaaggtgccacacaggacaatcttctctctgttatccacacagcgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaaaacctctacttgtcctgcttcgcggactctaacccaccggcacaatattcttggacaattaatgggaagtttcagctatcaggacaaaagctctttatcccccaaatnactacaaagcatagcgggctctatgcttgctctgttcgtaactcagccactggcaaggaaagctccaaatccatcacagtcaaagtctctgactggatattaccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgct

SEQ ID NO: 485428 - DNA, 847 bp, Homo sapiens
gagcgtcatgaagaaagggggcatattctctgcagaatttctgaaagttttccttccatctctgctgctctctcatttgctggccatcggattggggatctatatggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctggaacttaattcagctgaagtactttatatttcaaaagaatgaataaccattgataataaaatcgtactttaaggggtttgtccaaaataaatattggggcttatatatcacactatgtgagaacgtcttatttacattcaatggtgccggttgtctactaaagaaaggtttatattaactatgctcaatgtgcttaatcaacagaaaccaagatagagttcaaaatcagtgtcaggtggacactaaaccctctggttcgctataaggagaaggtcggcttaggggacccgggggaagttgggagggcaaaaaattccctaaccgggggggaaaccccggggacggtggaccctcccgtgtacagggggaaac

SEQ ID NO: 485429 - DNA, 2381 bp, Homo sapiens
  misc_feature (128)..(128): n is a, c, g, or t
  misc_feature (186)..(186): n is a, c, g, or t
  misc_feature (424)..(424): n is a, c, g, or t
  misc_feature (458)..(458): n is a, c, g, or t
  misc_feature (1228)..(1228): n is a, c, g, or t
  misc_feature (2039)..(2039): n is a, c, g, or t
caactaacaaccgtactcaaaaaacttctagatcctaagcttatctccacaaaagagaacacacaaacagcaaaaaccatagggcccctctcaacccctccctgcacacacctcatcacttgaaaaanggtcctgctcacaacatcacttttaaacttctgaaatccgcccacaactgcccaaatnacaattgaaacccagccacccaaaatttctaaaggaaaaaattttcttctacttttccacaatttaccccaaaatctttctggctacatttggtacaaaaggcaaataacatacctctaccattacattacatcatatgtattaaacggtcaaaaaattatatatagacctacatacaataaaaaaaaaaaaatatattccaattcatcccttctaatccaaaatttcacgcaggaanatgcaggatctacacttacacatcgtaaaacgangcgatgggactggaggagtaactggacatttcaccttcaccttatacctggagactcccaagccctccatctccagcagcaacttaaaccccagggaggccatggaggctgtgagcttaacctgtgatcctgagactccggacgcaagctacctgtggtggatgaatggtcagagcctccctatgactcacaggttgcagctgtccaaaaccaacaggaccctctttctatttggtgtcacaaagtatattgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaaaacctctacttgtcctgcttcgcggactctaacccaccggcacaatattcttggacaattaatgggaagtttcagctatcaggacaaaagctctttatcccccaaatnactacaaagcatagcgggctctatgcttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgctaaaaaaaaaaaaaacaaaaaaaacacaacacacancacacagtctgggagccctacaagccccccctataagagaagttctccaaaacaccaactgttaagggagcaaggggcacccagtgatggaagcacagagcaacacccaggcgacatagacgagggatcaccccaaagaggaataactccgggaaaaacaaacaaaggtgatggagagattcccaccagactgtagaaaaaaacaagcccggggaacacaaccgggcgcgtgttgtcgcacaccacaacaaaccgaagagagtacgacactgaagcgcgaacacgagggactcacatcaagacgaacatcccaagagagcaggacgcgcatctcagcttagc

SEQ ID NO: 485430 - DNA, 1413 bp, Homo sapiens
  misc_feature (637)..(637): n is a, c, g, or t
ctctatcctctcttggcagtcccaagctctagtgtcttcaaggcatacacaggtgacatgaatctgtaggctggggaatggactgcagcactgccctcctctcaaaggaccaggcatgatgccgtactagccatctctccatgagcccagtggagactccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaaaacctctacttgtcctgcttcgcggactctaacccaccggcacaatattcttggacaattaatgggaagtttcagctatcaggacaaaagctctttatcccccaaatnactacaaagcatagcgggctctatgcttgctctgttcgtaactcagccactggcaaggaaagctccaaatccatcacagtcaaagtctctgactggatattaccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgct

SEQ ID NO: 485431 - DNA, 412 bp, Homo sapiens
aatatacctagacacaatgaacatctccatatttgatggctgaataaaggtcatggccctcatcctcagacagtagttcacaaacagactacacctcggtactcagttcttatctggttcctggcctggtcaaaccaacagcacagaaccttcagcctggtcagtgcgtggctgtgcctctgtacccatggcaagcacgacacccatcgtgcgaggaaacaagtgatggagcttagcacgggcactgtgtcttctcaggacgcctcagcagctctctcccatgtcagcccttcagcagggaagacccaaacctgtcaggaggagacgtgtcccagacctgggctcccacgcggatgtccacaattactcaaagatgcaggacgcagcctcctagaacctgccatttccacag

SEQ ID NO: 485432 - DNA, 2447 bp, Homo sapiens
  misc_feature (128)..(128): n is a, c, g, or t
  misc_feature (186)..(186): n is a, c, g, or t
  misc_feature (424)..(424): n is a, c, g, or t
  misc_feature (458)..(458): n is a, c, g, or t
  misc_feature (1228)..(1228): n is a, c, g, or t
  misc_feature (2037)..(2037): n is a, c, g, or t
  misc_feature (2039)..(2039): n is a, c, g, or t
  misc_feature (2042)..(2042): n is a, c, g, or t
  misc_feature (2045)..(2046): n is a, c, g, or t
  misc_feature (2049)..(2049): n is a, c, g, or t
caactaacaaccgtactcaaaaaacttctagatcctaagcttatctccacaaaagagaacacacaaacagcaaaaaccatagggcccctctcaacccctccctgcacacacctcatcacttgaaaaanggtcctgctcacaacatcacttttaaacttctgaaatccgcccacaactgcccaaatnacaattgaaacccagccacccaaaatttctaaaggaaaaaattttcttctacttttccacaatttaccccaaaatctttctggctacatttggtacaaaaggcaaataacatacctctaccattacattacatcatatgtattaaacggtcaaaaaattatatatagacctacatacaataaaaaaaaaaaaatatattccaattcatcccttctaatccaaaatttcacgcaggaanatgcaggatctacacttacacatcgtaaaacgangcgatgggactggaggagtaactggacatttcaccttcaccttatacctggagactcccaagccctccatctccagcagcaacttaaaccccagggaggccatggaggctgtgagcttaacctgtgatcctgagactccggacgcaagctacctgtggtggatgaatggtcagagcctccctatgactcacaggttgcagctgtccaaaaccaacaggaccctctttctatttggtgtcacaaagtatattgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaaaacctctacttgtcctgcttcgcggactctaacccaccggcacaatattcttggacaattaatgggaagtttcagctatcaggacaaaagctctttatcccccaaatnactacaaagcatagcgggctctatgcttgctctgttcgtaactcagccactggcaaggaaagctccaaatccatcacagtcaaagtctctgactggatattaccctgaattctactagtacctccaattccattttctcccatggaatcactaagagcaagacccactctgttccagaagccctataagctggaggtggacaactcaatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagagtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaacaaaaaaaaaaaaaaaaaacctttntnggngcnnccngggccccacaaaaacgtttctaaaacacattggcgtggggccgcagggccccaaatagggaaagggaacactggcgcaaacaggtgtccaaagggaaaccgggggcacaaaacaaaggggtggggttcccccccaattaaaaacccgccggggggaacacacggagcgtctcgtgacaaaaccccgaaaagggcgagctccgagagagggcacatcacgaggggtctctacacaacgcaggggggctcaccaaagagaggtcccagaacatcaaattaacccccgcccagcgcggcgtgcgcaaaacgaagaagaagagacgaaagagcacaaacaacaacagcagagaagaaacacaaagcgaacaaagatgaggaagcgacaagaacagagaacag

SEQ ID NO: 485433 - DNA, 1018 bp, Homo sapiens
  misc_feature (4)..(4): n is a, c, g, or t
gganggcgacacttgctacggagtgcatcggacgtcgaagcctagagtctctgcgtctttccctcttccgtgcctcattcctttccttcctagcctggtcgtcgccgcaccactgaccaaaaaaaaaaaaaaaaaaaattgtgggccggccttcgggcctgaggagaaagtttttttaaagacaatttctgtggggcggccgggccccaggatagggttacggtgacctgggccattaggctggtccccaagggagactcggggccatggactaaagggggttggggtttcctcacccaatataaaaaaaaaggccgggggggaccccggaggggtcctgaacaaattccaggatgggaggttccggggaggggcccaattacgggggattcttaatccaccgggggaggctccaagcgggggacgtctcgggatattaaaaatttaagggcccggccccgagggggtataacacaacaacacacaagcaaccacacacaatccatatcctcgcaaccacaacaagagcgcaaaaacaaacaacaatgatgaacatacaccatagaagacacaacaacacaaacaacaacaccagaacacgaaacacacaacacacaacaacaaataccacacgatcacacacgatcagtagcactaacgacaaaaagagggacagagagtaaagaacaaacgcccgtctgcggcgccaacaagcgaagaccgcacaagcgggcgagacagcaggcgggcccaccaatgcgggacaccggcacacacgcggaacggtaaccgacacaaagcccggcggcagcagagagcgaggcagacacgcagaaccgcgccgagagacagagagcgagacgcgaggaagtgaccgacgagcagcacaccgcaggcgagcaaaggcagaacaccgcggaacaagtgcgaaccacacggcagaaacccacacggagccacaaagagggcagaagagaggcggaggaaaccggaagaagcagacacaggcaagtcgcgt

SEQ ID NO: 485434 - DNA, 880 bp, Homo sapiens
  misc_feature (6)..(6): n is a, c, g, or t
  misc_feature (15)..(15): n is a, c, g, or t
  misc_feature (99)..(100): n is a, c, g, or t
  misc_feature (137)..(137): n is a, c, g, or t
  misc_feature (259)..(259): n is a, c, g, or t
  misc_feature (263)..(263): n is a, c, g, or t
  misc_feature (287)..(287): n is a, c, g, or t
  misc_feature (297)..(297): n is a, c, g, or t
  misc_feature (305)..(305): n is a, c, g, or t
  misc_feature (310)..(310): n is a, c, g, or t
  misc_feature (313)..(313): n is a, c, g, or t
  misc_feature (321)..(322): n is a, c, g, or t
  misc_feature (332)..(333): n is a, c, g, or t
  misc_feature (335)..(335): n is a, c, g, or t
  misc_feature (378)..(378): n is a, c, g, or t
  misc_feature (382)..(382): n is a, c, g, or t
  misc_feature (388)..(388): n is a, c, g, or t
  misc_feature (431)..(432): n is a, c, g, or t
  misc_feature (599)..(599): n is a, c, g, or t
  misc_feature (698)..(698): n is a, c, g, or t
  misc_feature (706)..(706): n is a, c, g, or t
  misc_feature (720)..(720): n is a, c, g, or t
  misc_feature (723)..(723): n is a, c, g, or t
  misc_feature (728)..(728): n is a, c, g, or t
  misc_feature (730)..(730): n is a, c, g, or t
  misc_feature (733)..(734): n is a, c, g, or t
  misc_feature (737)..(737): n is a, c, g, or t
  misc_feature (739)..(739): n is a, c, g, or t
  misc_feature (741)..(741): n is a, c, g, or t
  misc_feature (748)..(748): n is a, c, g, or t
  misc_feature (757)..(757): n is a, c, g, or t
  misc_feature (760)..(760): n is a, c, g, or t
  misc_feature (766)..(766): n is a, c, g, or t
  misc_feature (772)..(772): n is a, c, g, or t
  misc_feature (777)..(777): n is a, c, g, or t
  misc_feature (782)..(782): n is a, c, g, or t
  misc_feature (787)..(787): n is a, c, g, or t
  misc_feature (790)..(790): n is a, c, g, or t
  misc_feature (793)..(793): n is a, c, g, or t
  misc_feature (808)..(808): n is a, c, g, or t
  misc_feature (814)..(814): n is a, c, g, or t
  misc_feature (848)..(848): n is a, c, g, or t
attttnccttttggncatatttaacagataaacttgacattacaagtaacagcaacacattcccattctactgaagaaaacaaatgcgatttagctttnnggttagaaaacgtatcttcttactgcaatctcaagtngcatttagaaagtttagttttcccttttctaacctctaaaagatgatatgatttttaatgcaatcatacacaactgttttcacattggaaataatcacgaggaatcaataggtttaggctanctgnctgattggttttgcttccattgtnaatttccggnggggtccngcggngtngggggttnnggaggggggnngnggtcggggcaggggtgaacggccttggtctttagagtgggggngggnacatgnagcggcacacggggcaggtgcctgacttctgaagccagatggnnacacacggcttgtggaaatagtggtggcacggcagctcagttgccacctcccccttcacatattcgctacagcggatggggcagcacatctcctgaccaactgcgccatgatcttcagtgaccaggatctcgggaagagcgtcaatgctctccttgcttgctggtgnattggccacctctacatccactgcgagagactccaagtgcgcaagggcagtttccattgcctgggccaggcgttcttcaagtgccatgtaggtgagganctgagggnccacataggaaaantgngcttnangcnnccncncnaacccantcttgaaanacnccactnaaaaanagggnctcanattcntcnttncataggtctttcgcntacacnctggaggctatttctttaaagggttgtttgtttnccctcacacacgtgagatccccccgggtttga

SEQ ID NO: 485435 - DNA, 1744 bp, Homo sapiens
  misc_feature (128)..(128): n is a, c, g, or t
  misc_feature (186)..(186): n is a, c, g, or t
  misc_feature (424)..(424): n is a, c, g, or t
  misc_feature (458)..(458): n is a, c, g, or t
  misc_feature (968)..(968): n is a, c, g, or t
caactaacaaccgtactcaaaaaacttctagatcctaagcttatctccacaaaagagaacacacaaacagcaaaaaccatagggcccctctcaacccctccctgcacacacctcatcacttgaaaaanggtcctgctcacaacatcacttttaaacttctgaaatccgcccacaactgcccaaatnacaattgaaacccagccacccaaaatttctaaaggaaaaaattttcttctacttttccacaatttaccccaaaatctttctggctacatttggtacaaaaggcaaataacatacctctaccattacattacatcatatgtattaaacggtcaaaaaattatatatagacctacatacaataaaaaaaaaaaaatatattccaattcatcccttctaatccaaaatttcacgcaggaanatgcaggatctacacttacacatcgtaaaacgangcgatgggactggaggagtaactggacatttcaccttcaccttatacctggagactcccaagccctccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaaaacctctacttgtcctgcttcgcggactctaacccaccggcacaatattcttggacaattaatgggaagtttcagctatcaggacaaaagctctttatcccccaaatnactacaaagcatagcgggctctatgcttgctctgttcgtaactcagccactggcaaggaaagctccaaatccatcacagtcaaagtctctgactggatattaccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgct

SEQ ID NO: 485436 - DNA, 339 bp, Homo sapiens
  misc_feature (4)..(4): n is a, c, g, or t
  misc_feature (101)..(101): n is a, c, g, or t
  misc_feature (104)..(104): n is a, c, g, or t
  misc_feature (112)..(112): n is a, c, g, or t
  misc_feature (119)..(119): n is a, c, g, or t
gganggcgacacttgctacggagtgcatcggacgtcgaagcctagagtctctgcgtctttccctcttacgataaaaaaattcggtctttcctagggttggncgncgccgccnccatgancatgattattatccgttcctagggatgcccgcgcccctcggctacgtgccggggctgggccggggcgccactggcttcaccacgcggtcagacattgggcccgcccgtgatgctcatgaccctgtggatgatcgccatgcaccccctggcgagagaaccgttggggacccgatgaagaaaaatcaggctgctggcgatgacgacgaggatctaagtgact

SEQ ID NO: 485437 - DNA, 852 bp, Homo sapiens
  misc_feature (6)..(6): n is a, c, g, or t
  misc_feature (15)..(15): n is a, c, g, or t
  misc_feature (99)..(100): n is a, c, g, or t
  misc_feature (137)..(137): n is a, c, g, or t
  misc_feature (259)..(259): n is a, c, g, or t
  misc_feature (263)..(263): n is a, c, g, or t
  misc_feature (287)..(287): n is a, c, g, or t
  misc_feature (297)..(297): n is a, c, g, or t
  misc_feature (305)..(305): n is a, c, g, or t
  misc_feature (310)..(310): n is a, c, g, or t
  misc_feature (313)..(313): n is a, c, g, or t
  misc_feature (321)..(322): n is a, c, g, or t
  misc_feature (332)..(333): n is a, c, g, or t
  misc_feature (335)..(335): n is a, c, g, or t
  misc_feature (378)..(378): n is a, c, g, or t
  misc_feature (382)..(382): n is a, c, g, or t
  misc_feature (388)..(388): n is a, c, g, or t
  misc_feature (431)..(432): n is a, c, g, or t
  misc_feature (599)..(599): n is a, c, g, or t
  misc_feature (698)..(698): n is a, c, g, or t
  misc_feature (706)..(706): n is a, c, g, or t
  misc_feature (840)..(840): n is a, c, g, or t
attttnccttttggncatatttaacagataaacttgacattacaagtaacagcaacacattcccattctactgaagaaaacaaatgcgatttagctttnnggttagaaaacgtatcttcttactgcaatctcaagtngcatttagaaagtttagttttcccttttctaacctctaaaagatgatatgatttttaatgcaatcatacacaactgttttcacattggaaataatcacgaggaatcaataggtttaggctanctgnctgattggttttgcttccattgtnaatttccggnggggtccngcggngtngggggttnnggaggggggnngnggtcggggcaggggtgaacggccttggtctttagagtgggggngggnacatgnagcggcacacggggcaggtgcctgacttctgaagccagatggnnacacacggcttgtggaaatagtggtggcacggcagctcagttgccacctcccccttcacatattcgctacagcggatggggcagcacatctcctgaccaactgcgccatgatcttcagtgaccaggatctcgggaagagcgtcaatgctctccttgcttgctggtgnattggccacctctacatccactgcgagagactccaagtgcgcaagggcagtttccattgcctgggccaggcgttcttcaagtgccatgtaggtgagganctgagggnccacataggaaatggcttcagccactcctaacccatctgcaaatccatcaaagaggctccaatccacttctaggtcttcgctcacactggagtcatcttcaaggttgttgtttccatccagcatgaatacccanggttgcatcaac

SEQ ID NO: 485438 - DNA, 663 bp, Homo sapiens
taatgtatcataggtactgggaagaatacagcaagggtgcagactatcctggactgcttatataggtatctcaacacccagtttattaccaagaaactaaattaacagaagcggacccttcagttatggctatggtggtgtacgatctgaatgaacccacttatggacacatacggagacgctacgcattggcatatgtggcggacatgctggttgaaccattcaggccatccttatccgaatgctgctccgacgaacatcaaaaatgatcgtggtggagaagacccaaaccagaaagtaatccagtggggtataaactccttgtgtacatgtggaaccagtataagaccaaaattcccctaaacagtttatcaggaacattttggagtctcccttgctgactgaacacaggacgagtatcacaaaccacgagagcttcaaattgataacaagaatcaaagtggtcacagtatatggaaaaggttctaggtagattacacagatgaacgaaattcgatgtcgaaaatactacatccaagttcatatactaaggtgatcaatgcaatgtcaacaggaatggtagcagacacattacagtttttacatgcgaatgtcataataaattcgacagagaaacaacacatgcctggccatattgtagta

SEQ ID NO: 485439 - DNA, 1230 bp, Homo sapiens
  misc_feature (454)..(454): n is a, c, g, or t
gtagaggatccccggatgactacgggggaagctctgaccatttagccaccaaatgtaggtgtataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaaaacctctacttgtcctgcttcgcggactctaacccaccggcacaatattcttggacaattaatgggaagtttcagctatcaggacaaaagctctttatcccccaaatnactacaaagcatagcgggctctatgcttgctctgttcgtaactcagccactggcaaggaaagctccaaatccatcacagtcaaagtctctgactggatattaccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgct

SEQ ID NO: 485440 - DNA, 214 bp, Homo sapiens
aggatccctagctggtcgcagtcagaaaaattacagggttatttatattattataagtgaacgctgaactgtcactgaacatttaattgcatatgctttacgtctccggcatttatattaaaaattcacaccacaaaatgaaaatgggaaaaaactggccaataactggatttctgtccctattttccactcgcaatcatatacttaggtacct

SEQ ID NO: 485441 - DNA, 450 bp, Homo sapiens
cactgtgtcagaccgtcccgatgccctccacccgtcgaccctctggataaccactgattactttgtacctgtggatttgcctgtccacgtgtcatgtaaatggagtcatggcccacgtgtccctctgctccccggaatgagttcgtccccagcgtgatgccggtcaaggcatatccggcagcatgcgtcagtcctccctcctttccgtggtcaaacagttttccattttcgtttatccgttagttgatgggttgttcctagtttgggctctttcaaatgcacctgtggacattcttgtacatgtctttgtatagacatgtgttttctgtgctcttgggtatattcctgggaatggagcttggtcatatggcaactgtgtttaatgtatttgtggaactgccaaacagtttcccaaggtggctgcaacattttgtaatcccgccgtcaatg

SEQ ID NO: 485442 - DNA, 147 bp, Homo sapiens
atccccatagttgctagatgaggatggatagtaactagggcaaggacgcctcctacgtttgttagggacggatcggagaattgtgtaagcgaataggaaatatcattcgggcttgatgtgtcggaggggtatttaagtgggttggct

SEQ ID NO: 485443 - DNA, 540 bp, Homo sapiens
  misc_feature (2)..(2): n is a, c, g, or t
cntatgaggatcccgaaggcgcacgaaggcgcgtcgtgtgaagagaccaccaaacaggctttgtgtgagcaacatggctgtttatttcacctgggtgcaggtgggctgagtccgaaaagagagtcagcatagggagataagggtggggccattttataggattagggaaggtaatggaaaattacaatcaaagggggttgttctctggtgggcaggggtggatctcacaaagtacattctcaagtgtggggagaattacaaagaaccttcttaagggtgggggagattacaaagtacattgatcagttagggtggggcaggaacaaatcacaatggtggaatgtcatcaattaaggctgtatttacttctttggtggatcttcagttactttagggccatctgaatgtatacgtgcaggtcacaggggatgcgatggcctggcctgggctcagaggcctgacattcctgccttcttatattaataagacaaataaaacaaaatagggttgaagtgttgggacgcgccatcgtgcgctacg

SEQ ID NO: 485444 - DNA, 362 bp, Homo sapiens
atcacaggtcgtggccatcctcccacctcagcctcccaagtaactgggatcacaggcacattcaccatgcctggctaatttttctttctcttttgtagaggtggggtttccccatgtagcccagctggcctgaactcctaggctcaagcaatctgcacacctcatcctgcctcggcctccgaaagcaccgcaattataggcatgagccacagtgcccagcctttcttctttctttcttttttttttttttttttttttttttttttttttttttttttttttttttttttttttttttttataacccttgggaaaaccgggttttttgggaaaaacttctgtggggggaacccggagggggg

SEQ ID NO: 485445 - DNA, 265 bp, Homo sapiens
tcgagagatcccctgggtgctaggtgactgtgctagcatctacacacgtggccaacgcagcagcccagcacaggacaggcatgcatgggcgcagggagagtcttcaactgcagtgcagtgcgcaacagtttttacaacagtcaagggggcagtcttgatccaaagctgcctgttcgaggagtcctgtgtctccacgaacagacgcgccttagttctttggctgggatcagctcgtgggaagcaacccagagtgcttcctgtggtg

SEQ ID NO: 485446 - DNA, 306 bp, Homo sapiens
gatcacttgaacccaaagaggtcaaggctgcagtgagccgtgattgtgccactgtactccagcccaggtgacagggtaagaccctgtctcaaaaataaaataaaataaaatttaatttaatttaattaaaattagaaaattacctgaccccaaacgatcctcaaaataagacttttgtaagcagattattgtatttagttaacaaaggaagagaaatattaaagtagcatatttttcacacaatacaccgctgtattagtccattttcatgttgttgttcgacataccagagactgggtaatttat

SEQ ID NO: 485447 - DNA, 466 bp, Homo sapiens
tttgcagcagctcctatctaataaagtaacaactcgtcagttgcaggctggtcttgaactcctgacctcaggcgatctgcccgccttggcctcccaaagtactgggcttacaggcgtgagcacctgctcctggccccaaccatctctttctacatacacttgcgtagacggcataaacatgcactgtccaatcatcatagcacaacacatgcaaattttccaccatcatttccgcatcagcagcaatcaccaagcagcagcaacatgtggtttccatccaagtgggcacagcacacagccagcaatttcaaaatcaacttttagggcacactgcacatcgcagtactcaatcaaaacttcagtctttcgctcaataatcaatcaataataatcatcaatcaacaacttcatagaatgtggcccagctccactaacatgcaggcacagaggccaggcatttactagc

SEQ ID NO: 485448 - DNA, 458 bp, Homo sapiens
ccactttctcttcctcctgctctggccatgtgaagacatgcctgcttccttttgctttacatcatgattgtaagtttcctgaggccccttcagctctgcttcttgtacagccttggaactgagaggtgaagctggctgggtttctgggtcgggtggggacttggagaacttttctgtctagctgaaggattgtaaatgcaccaaccagcgctcttttttctagctaaagatttgtaaatgcaccaatcagcactctgtcaaaatggaccaaccaacactctgtaaaatggactaatcagctctctgtaaaatggaccaatcagctggatgtgggtgggccaaataagggaataaaagtaggccatccaagccagcagcagcaacctgctcgggtccccttccacagtgtggaggctctattcttttgctcttcacaataaatcttgctgctgctcaaa

SEQ ID NO: 485449 - DNA, 143 bp, Homo sapiens
gctggggggttgaggggtaacaagatcccatctgtataaagtgcagtttgtgtccctcaaaatatgccctgtatggctacccaaaagcagcttgatgaacaaatccccccatggctcattaaagaacaaagcttccagaagca

SEQ ID NO: 485450 - DNA, 887 bp, Homo sapiens
agagagcgaaaaataggcgaacggcacgctgtcgtcgaaagccaatgctccctgagtcacggcgaagatctcaacgaaatacatgatgatgagctatgggtaggacattctaccagaatatggaagactgtgagtaggcacttgcggttattgtctatggatcgtatgcgtagaacttgtgcgtaatttactaggcatgttgtgatcacggcgacggataaaagcagagtttatatcctcagaataggggtatacacaagtgtttttcgctcagtatttactggaaaatggacatcactagtctttcagtaagatttctctcaaaaacgtgaaaaaccttggtaaaattgcaattctttctgcggatatatggtacaacatgacttaaaacttttttttttctattaaaacttaaaaggggaacaaaacttgaaaaagccctgttcttcagaaggtgagtgggttgagggaggcagtaatatgaagtgactgctgtgtattttaactaccagatttttaatattgccactgttaatagttggaaaggggaaattctgataagcgaaaggtggtatcatcctagggtaagctttattttcagaaacaaagtctaatatttcagattcttcttttggactttatacctctgagttattactaactgtaaagtgggtgtatatgaaacccttccatgcattttccagtatggtctgtaattttgacaggaaatccatgctttggtgggtgtctataaaaaggaatccgaagatatgtgacacgaagggtttaagggggaaagataatttgacttgaagacattgtagtaacctaatttttggaattatatgaagagggcgtgaaggagagaaggatcagggaataagagg

SEQ ID NO: 485451 - DNA, 361 bp, Homo sapiens
tctggagtcttgtctccgcaggctccatctatgagatctctgtggaatgagtgctgactctcctcggggtgacctgatcatggtctcccaggtcctggctccagaaggtggtctgtgagaacccgaataccagccagaccatggagctcgtccccaatttccaggttaaggtgggcacatctgccttccccatgtgccctggcactctccttggcacacccgctaggctgctcgtgggcttgccacgttctcaggctagtcactcccctcccctcggggtttggtcccaaggccctcacattcaccactaaccagcctcaagggtggggatgtcctcatagggtcggcaatgctctgtatt

SEQ ID NO: 485452 - DNA, 142 bp, Homo sapiens
gttagcactattgcatgtaagccactacatcctaatatcctctaaaagagctaagtagtacattgtagttcctgcccacctagacgcccgcaatctagttaaaagttaaaactaaagaataccaaaaagaaaaagaagctgt

SEQ ID NO: 485453 - DNA, 508 bp, Homo sapiens
  misc_feature (30)..(30): n is a, c, g, or t
  misc_feature (35)..(35): n is a, c, g, or t
  misc_feature (44)..(44): n is a, c, g, or t
ccttgaatggtgctgacagtagtgagcganaatgnaattaatgnacatgatgtcgtggtccagttgcagcctaatggtgaacgggattcaacatagcaaatactgtttgactttcagaacgatgattgggtttattctccgcttaaagaatgattagggtatatactggtaatttggattttttgctcccttcaaagatttctgtagaaataacttattttttagtattctacagtttaatcaaattactgaaacaggacttttgatctggtatttatctgccaagaatttacttcattcactattaatagactggtgctgtaactcaagcatcaattcagctcttcttttggaatgaaagtatagccaaaacataaaaaaaaaaatcctcagtatagcttgcaattaagacctagatcacagtatttaagtgttcagcgtttaatacatgaggtcagtgctacagacacctagtatgcactaacccagtttccacctccataaagtc

SEQ ID NO: 485454 - DNA, 123 bp, Homo sapiens
ctcggagttagtagatgatcttgtgctcattgcaaactcgtgcgcttccaggtttccagcaattctcctgcctcagactcccgagtagctggaactacaggcgcggttcaccacacaagcctt

SEQ ID NO: 485455 - DNA, 184 bp, Homo sapiens
tgttgggattacaagcatgagccatcatgcccagcctaaatcttactaccttttaaatacaatttttactttatcatattttaaatttccaagtgctttgtctattccctcttttggttcggtgtctacatgctggtggctttggctttctattcacgtttaagtatgaggcacagattgcagt

SEQ ID NO: 485456 - DNA, 125 bp, Homo sapiens
gtcgacagatatgggaatgtttggttgtgtgagtgcatgtgttacatgtgttgtgcctgtgtatcacaaatatctgaattacttggtgcaatcaatatgaacatgtttgttttcatatgtatagt

SEQ ID NO: 485457 - DNA, 604 bp, Homo sapiens
  misc_feature (92)..(92): n is a, c, g, or t
gtgtctcccgctccaccgcccttagtgagccccatcagctgcccccttttacttcgcatggaacggtctgtccaaagatcctcgtctgctangggcgagcgagacgatgcgttcttatgctactttgtatagaagaacaacaacagacaagaaacgaacaggtcgggcaattacattgttgggtccaactattttataagtgtgtgacggagatgctacagtagcgagcgagccgtatggcaagagcttataaatgattgatgcgaatatttggcactctgctcccccgtcgtgtaaggatactgatagcacaacgctcttacccccctacccatgtcccggccttttggtcggtccatcccttgtccgctttctgggccctcgttcctggtagcccaagtctcagagcgtttcctcttcctgaagccctagaggagttagggaatggagcccaggcaccagggggtctaactgtgtgagccactgagaagagagacgcaattgacccttgccattccaaagcgatagaggcatgagtggtcccctcttgtgccacctaggccagtttgaccctgggcattaactgggcttagaagaaacggga

SEQ ID NO: 485458 - DNA, 956 bp, Homo sapiens
  misc_feature (513)..(513): n is a, c, g, or t
agcggagtgactgcggcctgcatcccgatggtctgtctcctccaaggtctacatgattacctgaagtttaataagtaagaccatgaattatggcatttcttaaatgaacgcgttcaagaacgtgacgagaatgtgcatagaagaaactacagatgattttgaaggttatgtctatctaaatctcgactgtgcgatatatatatttagcctcctttaggtaatagccgacgaaagggtgtggggggagcctgagaagaccacgcgacctggtgtttcttggtgctcacccttaaagcatttcctggggggataatggccacattcaggcgtaaaacaggaggggttccaattacgaacacaataatttaagatggtgctactggggcccacaaggtgaagggcattactctggcgggtgaagcagctgtggtactctcccaggcgaaccaatgggtttaccatattgggatcttcggagacttatgcgcgttcctgaggccccaagggagacantacaacagagtgaagcattctgctagtgtccccgtgagttataaacgtagcttctgaagcctcctcgtgtctacaagggcgggtgtttggcgaatccacaagtgggcgatgaagatcaccagctgtaagcgtcaacatgtaaagccaaaaggttgccccccaatttttgacgaacaaccgggttccgcgaataaggggggccggggtttaaaccagataaaagaccttcgagataaacggcccatctaaattctcttggtgaagaagattatattgtctggaccaccaatctacgcaggaagaaagaagtgcctttagcgcagaaaagaaaaaaaagtctcatttatttgaccaccgggagaaagattatagggtgagaacgccggggcttttcccatgtagcccacagtggttataaaacccaccgaaaatttggggactcc

SEQ ID NO: 485459 - DNA, 358 bp, Homo sapiens
agttactgatgttttgcatatttaagagtgtctggtttggaaaattacctgagcagggtgtggtggcttacacccaataatcttagctacttgggaggttgaggcagcaggatctctcgaggccaagagttcaggaccagcctgggcaacatagtaagactcgtccctaagaaataaaaaaaaattagccaggtgtggtggtgcacacctgtagtcagtcccagctcctcaggaggctgaggtgggaggatcacttgaacccaggagtttgaggctttagtaagctatgattgcaccactgcactctagcctgggttacagagtgagaccttgtctcttagaaaaaagcaaaaaaaca

SEQ ID NO: 485460 - DNA, 151 bp, Homo sapiens
atcgatgtgcagctctgtctgcccgtctacgcctctacagtcccaaacgtctgcctcacaacacattcttcacggcccagtcatctacctcactgtggaccccgcgcaaggccaagctccgcgacctttcagcagcttctacatcagccat

SEQ ID NO: 485461 - DNA, 319 bp, Homo sapiens
tagccgcttcttgaggatccccctgcgcaggttaataaactatcaatttgcaaagcagcatgtcggacagagacacggtcactgattcacacccagtccgtgccgcagaccgtctcagacacgcacggtgggcctgctgcatgattcacacccagtccctgccacagaccgtctcagacacgcacagtgggcctgctgcatgattcacacccagtccctgccacagaccgtctcagacacgcacagtgggcctgctgcatgcgtgttacctggcttttggctccacgctcactcatagccatgtccacatgggggcttg

SEQ ID NO: 485462 - DNA, 263 bp, Homo sapiens
gtctgcggctgtccaagactgataaactaatcataactgttaattctcagccctctttgaacgcttgtcagatgagtcttaggtatttagtagacgtttgcagactttcctgccagtgtcataaaatcctatttatgaatcctgtcggtattccttggtatttgaaaaaaataccatatagtaccatacattagtgatttctaatttttgaaaaattataatagacattgcatcacactaacttacaaagatacaacgttctc

SEQ ID NO: 485463 - DNA, 487 bp, Homo sapiens
gatcggttctaccatgatgaaaagagtttgtggatggatggtggtgatggctgcacaacaatgtgaacggacttaatgccgctgatctgtgcacttaaaaatgagtaagatgttcagttttatgtgtattttgccacaacttctaaaataaacaaactaattaaacaaatgaataaatgaatcaagtgaaagaagagaagtcaatctctgagtccctgcttggggagcgggtgggttaagggcagcaccattgacatgcatatcatggaccagcaaagctgtaaatcacatctcctgctcacaagccttctcacacacatgggaccctttggttcacgtgccagccaggattcccgaagcaaattccttctataatcttcattctcaaggatgtagatgtagattaagaactttaccctagaaggtagggatgagcgcgcaagaatcccatcctcaaatatcccaggcaacaaaaactcagaatcaa

SEQ ID NO: 485464 - DNA, 214 bp, Homo sapiens
ctagctcagccaagcaggaggagctggaagccgccctgcagcggggcaagcaggatatggcacggcagctgcgtgagtacctaggaactctattagcgttaagctggccctggacatcgtagtatcgcctacctacctgcatagctgctggtagggcgtaggagtagccgtgttggcttggtagcgtgtacaggggtgtatcctctagtagtcg

SEQ ID NO: 485465 - DNA, 100 bp, Homo sapiens
tgcttcaagaaaaaagatacccatgtcagtagatatattaaactttaatatgtttgcactctgtaaacatacaacagcctaaagataaagtcattatcta

SEQ ID NO: 485466 - DNA, 354 bp, Homo sapiens
gttgacaaagccccctgagctctacagatgtggacctcagggaggccaagctcctccaggccacaggttcggactgaggaggggacactctcctggagagcagctccctgcttggcaggcgcaccttaacctggagagctgggtgcacaggcaggagcctccgggcctggatagccagtgagcctggcagggtggtgggaacacagatggacgtccccagcagggatggtgcgggtggagggaggagcgcccggcaggtccctgctgtctgggtctgctctggtggtggctgcgggtgagcgcctgtggactggtggcgtggcactgggctgctcggccgtgtgtttctgattc

SEQ ID NO: 485467 - DNA, 391 bp, Homo sapiens
ggatctgcactgactcgtctttggaaggagcagataatgaactctgtttctcgctgggggggatttacttcaactagtaaatgtactgtaagaagctagtcattaagatgttcacaaatcctttatctacatgaagtttgggagagatgttatctttaatccatttatatatagtttgaggggatggatccaactttatttgcttcaacagttcctatctccaaatttgacggagtagggacataaagaaaactacagtccctattccttaccaaacatctccaacatagcggtcctatattctagatcaatttctagggagcattttctagcatattagaccttagctttgtatgaaaaagttctagttaaccattactcgatcttgtaa

SEQ ID NO: 485468 - DNA, 369 bp, Homo sapiens
  misc_feature (163)..(163): n is a, c, g, or t
  misc_feature (211)..(211): n is a, c, g, or t
  misc_feature (258)..(258): n is a, c, g, or t
  misc_feature (279)..(279): n is a, c, g, or t
  misc_feature (308)..(308): n is a, c, g, or t
  misc_feature (354)..(355): n is a, c, g, or t
ctcgtgccgaattcagcacgagctcgtgccgaattcggcacgagcgaaccccagaggtgagattgtgatcggtggccagaatatctccatgggatattttaaaaacgaagagaaaacagcagaagattattgtgttgatgaaaatggacaaaggtggttttgnactggcgatattggagaattccatcctgatggatgcttacagattatnggatcgtaagaaagatctggtaaagttacaagcaggaggaatatgtntctcttgggaaagtaggaagntgcactgaagaattgtccactgatcgacnacatcttgtgctttgggcaaaagtgaccagtcctattgtgatcaanntttggggggtccct

SEQ ID NO: 485469 - DNA, 352 bp, Homo sapiens
  misc_feature (13)..(13): n is a, c, g, or t
tttcaaagtgtgnagtgcgtgcattgttttaaaaagtttggtagtactttttggccgtttggatatttaactccgtttctttttttttgaagacggagtcttgctttgtcgcccagtccggagtgcagtgacgtgatctcagctcactgcaagctctgcctccctgggttcacaccattctcttgcctcagcctcctgagtagctgggactacaggtgcccgccaccacgcctggctaattttttttttgtatttttagtagagacggggtttcaccgtgttagccaggatggtcttgatctcctcacctcatgatctgcccgcctcagcctcccaaagtgctgggattaca

SEQ ID NO: 485470 - DNA, 534 bp, Homo sapiens
ctagaggatcccccatgtgggcatcactgaggatggggatgtccagtttcacctgctgcctgtccttgaagagggaagacgcatgaacagagatggctacaccaattgcaagctcagcgcaaaatgagaagaaggactccttgttcaaacctaattaacaatttccaggcgggggcagcagacagttaaagcaatatggcgcccttccgtgcgtggggaccctgtgtgagttacgcaaggtgcggactcatgaaacttgaggtgtagataacagaagctatccacctccgaggctttccgggtctctagaactggaaagaatattttccgcacttcaacattggcatctgttcccctgtggccaaattagtagattgaatactgtctcccaaaaagatttgataaagggctaatccctggtatcggtgaatgggaccttattcacagaaagggtctttgcgaggtgtcattgagttaaggatcttgaaatgagatcatctggattatcaaggtgggcataaatccaatataagt

SEQ ID NO: 485471 - DNA, 102 bp, Homo sapiens
cgcgtcgctcggtggtgtgtactgcaggaggggccgtgcgtcgaccctgagcctcagcctggacagcgaccagagtagtggctcaaccacatccggttcccg

SEQ ID NO: 485472 - DNA, 563 bp, Homo sapiens
tggcatcgggggctgatggaagtggagagggggctggagagggcaccctatatccagcatgctccaaggttacagctccgtggtccaggccttgctggggaccttcttcacctgggcaatgacatcagccggggcagctctcgtgttcatattctccagcgggcagaggcggatcttagacggaagcctgggctttgccgcaggggtcatgttagcggcttcctactggtcgctgctcgcaccagcggtggagatggcgacatcctcggggggcttcggcgcctttgccttcttcccagtggctgttggcttcaccctgggggccgcctttgtctacctggctgacctcctgatgcctcacctgggtgctacagaagacccccagacagccctggcgctgaactttgaccctgcattgatgaagaagtctgatcccagggaccccacttcgctgctcttcccggagagtgaactttccatccggatagacaagcgtgagaatggcgaggtataccagaggaagaaggtggcagctactgacctcgcagagggcgtggccccct

SEQ ID NO: 485473 - DNA, 444 bp, Homo sapiens
aacagtcacaggtaaaagcacagaaatcatgtgaaggagccaaataatgaaacagacctctacattctaccagatacagagttcaaaaaggagacagtgaaaatactgaaggaattaagagtgcgtatgaaggaattaagagtggatatgaacagtaatcgcagattactttagaaaggaacgagtaaatataaggaggaaccaagaataattagtaaattcatttgcagaggtgtagggagcaaataatgaaacagacctctacattctaccagatacagagttcaaaaaggagacagtgaaaatactgaaggaattaagagtgcgtatgaaggaattaagagtggatatgaacagtaatgcagattactttagaaaggaacgagtaaatataaggaggagccaagaataattagaaaattcattggcagaggtgtaggactg

SEQ ID NO: 485474 - DNA, 806 bp, Homo sapiens
atactagctatatcgctcacacctcatatcctccctactatgcctagacggaataatactatcgctcgttcacttatagctactctcataaccctcaacacccactccctcgttagccgatattgtgcctatagccaataactagatcttatgccgacttgcgacgcagcggctaggccatagacgcctactagatgctcaatctccacacgacatataggccatagactacgtacataacctaaaccatacgtccaatgctaaaactacgtcgtaccacaacaattagtatcgcctaccactgagaaagacgcgtcgcaacacaacacatgcacatcgagaatcccacacgagcgacccacagccagacgtgccaagccatcagaccgccactacataaagggcaccaccccagacgtcaagcacaagcaaagccataatagccaagcctcggaacgccacgacaaccaatatggtcccgacacgcacagacaatagcaagaacacccccgaccacccaacaagtacaacaagaaaaacagaaccaaacggagggacaccaccccacccacgtcgccagtccgccggccgcaactgaccaacacaaaataccccagcgacacgccaacggacaccaggcacaacacaaaacgaaacaggcgcaccacacaaccgaacgcatcaccgcctaccacacaggcaacacaaacacgaaacataagacaagccaagcaagaacccacaagaaaccacaagcgcccagcacaacgcaggcaacacacacgcaaaacgaggaccggcgaccc

SEQ ID NO: 485475 - DNA, 1470 bp, Homo sapiens
  misc_feature (514)..(514): n is a, c, g, or t
  misc_feature (516)..(516): n is a, c, g, or t
  misc_feature (585)..(585): n is a, c, g, or t
  misc_feature (1251)..(1251): n is a, c, g, or t
cttgtggagcgcccccgccggggggcgccggatttcctccatgctcctctccgggagacttgttttgcgcctcttatgggccccgctggggtccccgggggatgatgccgcgcaggtgttgccgcccgccccgacgggggtcacccatgcccttgatggtccccctcttgttagcgccccctattatttttaaaggtgtggacaccaaccccgtgtatgtgaggtgcgaccacacgcggtgtttggtggacccccacataaaagaacgccacgggtccttggtgttaccaaccgggttgctccgcgggaaattttccctcccgggcgaataaatattccgtgttctggagcccccaccacggccgggtgtccccccttggaaaaggaagcgtttgaaagccctattgggaatggaagacccttttctgtataaaaaggggttggtagtaaaaacctttgttggggggggagatgtacccacaacatgggggggcaacaacacgacccaccacangnacacttctctcttggggttattattatagagagcgggtttataagggcgggccgcaccgttgtcttatnagggacgcctctggccccttctcaacagcggagagggaaatagggacccacagcccccttcccacaggagagccacattgcctctcacagaaaggtgtgcgggaaaaaggggaataaaagagagagagagagaaatacacgcacagcgcgcagaaaagccgcggggcgcccactgtctcggcctctttatatctctcgagagagaatgtttttccacagcctctgagatgagaaagagaatcttatagagagagggcctccacacacacacactatatgtctttacacactcggagagtctcccacaggagcccacacagtgagagactctcgtagagagagagtgtgtggtctctcttttctctgtggggccacagggagtcacacgggtgctctctgttctaaaggagggcacagagagttgggcccccacagagagttctctcacaggcgagcagaaaggacgaccctctgtgtgtgagaagagtttgagagaggtgtggagagcacgcctctgaaagagaaagagatagtgagaaacaccacccagagattctccgaatttctcccaaagccgggagaaaggagaatccaaaggaggtaccgtgggagggcgcccacagccaaggaacacacgatctccttttttccaaaaggcatatcccntcgaggacacacgaatcccctcttcaaggaggaaaaggtgggcttgttctgataaagctgagtggcactggagagccctcggccctcgagagtggttctgtgcccttcttcaagccacaagcccacaggttcttcctagaccccccgggagccagtgaactgtcctacctttttttctatcacccagaatgagctccacgatccctggaccaaatgcca

SEQ ID NO: 485476 - DNA, 1639 bp, Homo sapiens
  misc_feature (151)..(151): n is a, c, g, or t
  misc_feature (173)..(173): n is a, c, g, or t
  misc_feature (750)..(750): n is a, c, g, or t
  misc_feature (875)..(875): n is a, c, g, or t
  misc_feature (1160)..(1160): n is a, c, g, or t
  misc_feature (1299)..(1299): n is a, c, g, or t
  misc_feature (1311)..(1311): n is a, c, g, or t
gtatataatgttcgttcttgttggggtgttgctcgagaatgtcagaagattcacggttggttgtctctctcatagctagcatatagttttgaaatagcgctcttgggtgtttgatctttgtttgaaggccccgattgtgttagctcggacnacagataagtgctcctctaaangggcccggtaatgttcttgtgtgtcatacgtaggggccgctcctccgtcagggggtaatgtattgtgtgcacaccacctgggaagataaggcacaaagggagccccctttggggtgaataattatgtggtccacaagagactctttgttcccggcaacaagacttggtttctgttccaaagaagagtggcgcacaagagggtcgaccccaacaaaaacctctttatttttccaattttgggattgtgaaaaataatatgcgacataaatgtggccaccacacgcgttgtgaaggttattttttgtaaacccttgggagatcccacgccgaccccgactgccactctttatgggccccttatttatattgtacccttgggggggttttttcttctcttctcgttgcggttgtttatatgtgtgtaaaaagaaagccaacgaaaagatggttgttaatcttttggggaacaccacgaacatcgtcttctcgggcgcgtcttttgctgggtttgttctaatgtggagagaaccactttacccacgcggccccgcaagatttaagaatgttttttttgggncttttataatggggaacacaacatatatccgtggtgcgcgcgcgtgttgcacagtgttgtgtttggtgggccgtcgtgtttcccacgacgtggttttttaatgaggtgaaatgtgtgccacaatnttatgtggagaaaaaatgcgcacgtttgtatgacacgcacatgtggtagaaaagagtggagagtgggctataaagttgataggactctttttaataggggccgcctctgtggccgcacaatataggtgatagtgcacattgtcacaatgtctcggggtatatttgggattctgtgtgtgcacacacacacatatacgcacagaaatctctgagagaagaactctttgaataataatgtataactcgagatggagtttcacacacatagaaatcacacagagattntggccacatattaagagatgtatgaccaccatcgagatttggctctataaatggtttataaatatattgtaagactgtcgttatatttttttgtgacacacacacacacacgagatgtggtgtataagagataataatnttgagaagtgtntcacagtcgagatgttaacgcacgtctgtgtccacaactgtttcacatgagatttttatatgagggcaccacagagacttttcacacagagaaaatataccttgagaaaatataagattatcacttgccttttgtccacttaatcacgccaattaaacactggccttaacacaaagttgtttgtgttaattggaccacagatttgagaaacttatatgtcgggagacacatataccctaataagagaattaactaaccttatctgccccttgtagaataatgtattaatccattttaccatttaagaaaataatggtttttactggga

SEQ ID NO: 485477 - DNA, 189 bp, Homo sapiens
tcggcccggcttaggtgctcaggaagactctcttgcgggcgtttggggtaagggtgcagcgccactccacgtctgctgtggctcctgctccagcgtgcccagacggatcatgtacagcttccagctcaaagcggggccgacctcagtgagctccacgttgcggtggtctgtcttcttatacacaacgcg

SEQ ID NO: 485478 - DNA, 1005 bp, Homo sapiens
ggagaacgccagcatgaagctggagctcgacgcgctgctgctccaatgtacgaggcgctgcagaccttcgacccggacggtggcccgcagaccccgtgtgcgccaagcgcctggggcccccttgtcgcgcgtgacctggggcccctcgtcccagtgcaaggtgtgccgccaccagcgtcatcacaatagtaaagtccaagactggatgcccgatcgatagggacgcgcgtctgcaccagagcgggtcttctgcggctgcccacctagagcacagtggccgaattttggctgcccctgtccctctgattatccatatctacttcatcgtttccctcccatcgtcgtatcacaccaccctatcatcgtcattccccttccaaaagtcaccaacacgtggtacccccagggggtcgtcccgggcttgacgccccctatatgcatcctcagatcacttgatcgatcagatgatgatactacgctatgcttggggactcgggccacaaggataacagagacagcgatcgacccgactgcgacagatcagaacaccccaaaaccccccctatgccacgctcaacccacgcggagcccaaatcgcaactggcccgcaagagacacgatacccaacaacggactaggagcagacacagccggagcgaaacacagaggcccaaaagacgaaggcgcctcacgcacaggaccatacaaataatgcacacgtcggaaaatccaaccagggtaaacaatacccaagaggaaacactaaaccacaggcttgcatcccagtcagggaaaatcaaaagctggcaacagtgctaatacgaccaaacaatggactaaggacacgcatacaaaaacgcatagcaaacagatcgaaaatgaaatcaatatactagcgacctatcagacagagtacacactgaggaacacaggaacattacaagaaataactgtattaagcagcacagcagagagtaagaagagcacggttcaactacctataag

SEQ ID NO: 485479 - DNA, 1047 bp, Homo sapiens
gggaagtctgtggctctacctacaccagtcaggcagccctggtgcttgtgaagggtcttggagaataggacttctccccctcatgcaccactgctgacacagctggggtttctcacaaaggaactcggcatgagtgcacctgtagacagcctttctgggacccttcaggtgactgcattcccacaggacaagtgccctccaggctcaggcttgtatgagaggtagagtcacaattcatctctacattcttgcagctgaaaagacgtgtctgtctgaaggtctaacatccagtatctgtaaggaacttaaacaaatttacaaaaaacccctaacccaccccattaaaaagtaggcaaaggatataaacacacacttctcaaaagaagacatacatgctgccaacaatcatatgaataaaaactcaacatcactgatcatcagagaaatgcaaatcaaaaccacaatgagataccacttcacaccaatcagaatggctattactaaaaagtcaaaaataacagatgctagcgaggttgtggagaacaaaggatcgcttccacaattctcggtgggagtgtcaccttagttcaaccattgtgcacgacagtatggcaactttcttcaaagacctagagtcagaactaccatttcatccagcaagccccattactgggtatattacccaaaggactcttcactggtcctatcattacgacaccggcatgtcatctgtccactcgcagccctattgtccatataccacgaccgggcttcgccacaggtgccgctcagggttcgcctggcttcgaccgtggttactttccgcggctggatcttcacccggcttttcacgcctcgggctctggtccttcggcgcccttgcgcggctggggggccatccttgaccatctgcggcccggtccgcatgcgtgcccttggcgtgtcccctttagccggcatccgtgcgggcaccctggcgctctcgacatttctgtcgcaccgccccgctgtctcctgcgtgcattcaccccgcgcgtgtgtccctcg

SEQ ID NO: 485480 - DNA, 363 bp, Homo sapiens
gtattcggcttgctaagtgcagatcggcgaaaacgacatgtatatattatcatactgatgatcaggacttctcgtactacttgaacggttcccttgccaatgaggccttggagccatctgacgcggtgcttagcccaaatgcgacgcgacagtgtgtggacatttatggtggcccatttgtcgagaacaacccggtagctccttatcagtgtgccggatcgaaaaatcacgtcaaccaaatctggccagcaccgggcgctccgggataatccaagtctccctgagcgccatcggaaagatggcgctcaggaaatgctggtgcatgcaatcacgccgccgaatgaagataattacggggagggg

SEQ ID NO: 485481 - DNA, 428 bp, Homo sapiens
  misc_feature (9)..(9): n is a, c, g, or t
  misc_feature (327)..(327): n is a, c, g, or t
gttgtaaanctgacttttatatgaagtttggagaaatacagccctccttcagttgaagatcccatgtgtttgcctgaatctcaacgtttttccccatgcccagtctccctgatgttaatgcctaatcctaaaagatcaagtagctgaggcccaggtgtggtggttcacacctgtaatctcagcactttgggaatccgaggcaggtggatcacctgaggtcaggagtttgagtccagcctggccaacatggtgaaaccccatctctactaaaatacaaaacttagctaagcgtggtggtacgtgcctgtaatcccagctacttgggancctgaggcaggaaaatcacttgaatctgggaggtggaggttgcaatgagttgagatcgcactactgcactccagcctgggcaacagactgagactgcctct

SEQ ID NO: 485482 - DNA, 536 bp, Homo sapiens
  misc_feature (23)..(23): n is a, c, g, or t
  misc_feature (26)..(26): n is a, c, g, or t
cagaagctgactcttccctttgncgnccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaaaaaa

SEQ ID NO: 485483 - DNA, 340 bp, Homo sapiens
gtactatggggtgttcagtgtatgaggacgtccagcgagcaaatggtaatggaaccgtgtgtaggatttcctcacacagagtgcacatacgcggaggggcgggatgacgtctgaaaatggaaaactacagattaagaaggaaaaattccaatcccctccatctcatcaccccagttaaccattgttaacatttttatgtagaacttttctcgcacaatatttgtgaatttaacatgagaactgttaaaatttgtgaggtacattgcattctatgagatatgctggactgcgatattaactattaactgtctgctgctgttggttaggaactttgtcgatt

SEQ ID NO: 485484 - DNA, 1134 bp, Homo sapiens
tctaaataggtggtgcgggatcacaatccccagcagcaaggcggtaatgcgcgacagcgtaacggcagcgtcttcacgcgcacagacatcacttagcagatgcggcatcagatggtcgagcacctgacgtcctcgcggcccgatggatgcgcttatccagactctttgcggaaatcggcaatcagcgttagcaccatgttttgcgatcatcctcgctaagatgcgccagcactggcggtagtgtcaatcttcgctgacgaacgcaatcctgccaacagcatcacgccacagtgattccgacagcgacatcttcctgaggttatcactatacatcgtacgccaatcaattacattaaacacccggcgacacatagatcatatgtgcgagtcagcgccccggatcagattgcggccagacagcaaagtccatcgcaccacgccagccgcgcaccgattaagcatcatcagaaggaagcgtctgggatcagtccgacgaacaacgctatagcagacacggtaaaccagcacagccgcaggcaccagatacgcccaatcgccaacggtccagccatcgcaaccagacaacgcagatgcagctcggacaagggcgctgagcgtcggcagaacacgagcggcgatagcagcgacgcgcacgagtcccgacgcgactgagctggcacacctgaaacgcaccacacgaccaactcacagcgcacatggccgcctggcagcccgccgtcaggatgatagcccgggaccaaaccagggacgaccgcccgtcacacaggggcaatcaaccccgtaaccagtcagcggccgcgaccggaaaacagacgaacatcccagggacgcacggccacaccaacgggggacgcacgaaataagccgccaaacacgaagaaaagaccgccccggaaactacgcacaataaaaaggggactatgcacaacgcagatcagcacccaaacggccacgaaaccgcgacaagctcccaaagccgcaacccagaccacggggcacacgccaatggacacgcacaaccagcaacaaacacagggagggctacacccccacaacgcaagccgccgcacgcacgtcaccagcaccggacgaagcgacaacaccaaagaaccc

SEQ ID NO: 485485 - DNA, 819 bp, Homo sapiens
  misc_feature (23)..(23): n is a, c, g, or t
  misc_feature (26)..(26): n is a, c, g, or t
cagaagctgactcttccctttgncgnccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaaaaaaaggggaagaaacgacagcctcacttctgtatggactgctgatgtggcctgccatcctgttcagcgggcattgtctttggagcagcaggagactaggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaa

SEQ ID NO: 485486 - DNA, 894 bp, Homo sapiens
  misc_feature (23)..(23): n is a, c, g, or t
  misc_feature (26)..(26): n is a, c, g, or t
  misc_feature (558)..(558): n is a, c, g, or t
cagaagctgactcttccctttgncgnccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaaaaaaaaaaaaaaaaaaaaaaaaaaanaaaaacacaaaaaaaaaaaaaacaaacacaaaaacaaacagggggggcacacaaaagataccaccaggggagacaatgacaggacaacagaatataaaaaagggtgccccataatgagcaacactaaagacgaaacaagcagcgcgcaaataaaacaggagaagggagaaaaagccagcaggaaactggagaagaacacaaacaaggagaggacaaacaaggagaaaacacacaagagtacaaacgcaggagaaaacagcccagagaaagggggaaacagggaaattaagcgcaaaaaagacccacgagagttcgcaaatccagggaggcaaaaca

SEQ ID NO: 485487 - DNA, 561 bp, Homo sapiens
  misc_feature (47)..(47): n is a, c, g, or t
  misc_feature (292)..(292): n is a, c, g, or t
  misc_feature (310)..(310): n is a, c, g, or t
  misc_feature (379)..(379): n is a, c, g, or t
  misc_feature (440)..(440): n is a, c, g, or t
  misc_feature (474)..(474): n is a, c, g, or t
  misc_feature (530)..(530): n is a, c, g, or t
aaagccactccaccctactaccagacaaccttagtcttttccatttncccaaataaagtataggcgatagaaatggaaacctggcgcaatagatatagtaccgcaagggaaagatgagaaattataaccaagcatagtatagcatggactagcctcttttccttctgcataatgaattaactagaaataacttcgcaaggagaggcaaggctaagacccccgaaaccagacgagctacctaagaacagctaagagagcacacccgactatgttgcaaagtagtgggaagatntataggtagaggcgacanaccaacccgagcctggtgatagctgggttgtccaagatagaatcttagctcaactcaaaattaggccanagaaccctctaaatcccctcggtaaatttaacttgttaggccaaagaggacaggtctgtgnacactaggaaaaacctcggcggagagagttaaantatctacaccccatggaggcctaaaggaggcaccactcaggagggtccaagtcaanacccctcccctaaaaacccaccttttattta

SEQ ID NO: 485488 - DNA, 608 bp, Homo sapiens
agcgggatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttctggctcatcgccatcctggcgcagctgaaccccctgttcgggccccagctgaagaatgagaccatctggtacgtgcgcttcctgtgggagtgacccgccgcccccgacccaggtgcccagctctcggaatgactgtggctccactgtccctgacaaccccttcgtccggaccctcccattgacatcctccccctacactccctctctgagcctccgtcgcccctcctgttgggtaagggtgttgagtgtgacttgtgctgaaaacctggttcatatataataaataatggtgatgaaaacaaacaacaaaaaacctcctcacagcgcgt

SEQ ID NO: 485489 - DNA, 719 bp, Homo sapiens
tgtaggtttctatattacgtattcccgtgcatatggcgcatacaatgcaacggtcatgcggcttcactgtccgtgagcagactctcgtagatgtcctactggatccagactactctatccccattgtagtctggtgtgttggctggtatagcttctaataggactttctttactgcatgatatgtgacagtgttttcataatgaataattacagttgacatgaagggagttggctactagttgtgaacaaggagaaacatgaatgcctatatggtgacactgggtgaataatcttatttttacagagtgtcgttaccaatgtgtggtcgattcggaagtttgagggaaaattgagtatctgcccgtggataattttacaataagatgaatgcaatgatagcaattctccaataagtcacaagttcaggctattccttatagtgggcccatattgccctggtttaacctcatgttgcacgcgtttcgaaacttggtccacgagtcgtatcagtggtctgtaagacactgtatatccattctgtgacacaatacattgttggtagattacagtcgccaagggagcatgaccaaaaaagacgttgacgacagcgatgcgtttatctcattgtacacggtaatgagtgcacaatttgtgccttcaatcgacctcttttcttcttgggactatctgacaattccacgacttctttgggattcac

SEQ ID NO: 485490 - DNA, 893 bp, Homo sapiens
agcgggatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttctggctcatcgccatcctggcgcagctgaaccccctgttcgggccccagctgaagaatgagaccatctggtacgtgcgcttcctgtgggagtgacccgccgcccccgacccaggtactgtgctgggcgacgggtgtgggtggggaagaggcggaacagacacggctttcccacacccagggcaggcctcggtcatattactcccggatgcggccaaacccagcaccatggcacgggcctgcgttccccacgggtcgaccgacacaggcccagcggcagccaccccacacatccgcccaacgcccatgcgcgtccgcgccatgccagcacctggcgccagcaccccgaacccaaccacgcgtaaacacgtcccagcacgggcataccaggcgcatcatactcaatcccccactgaacaccgaccccaggtgcacgccagcgcagcacccgacacacaccaacctccccgtttccctgccatgcaacctggtcaccgggcccgcccagggcaagcacaaccgggcaaccaaagctcccccacacacccccgcgcacccccacatcacatcacagcagacacacccccaggcacagaacccccaacctgcgcccaaaa

SEQ ID NO: 485491 - DNA, 162 bp, Homo sapiens
gactctgagctgagtgcaccccagtggtctgctgtgatggaataaagcagattccaagtgccaagaactgccatcctcttcgagcacatcagtctcatcatccactatgactggtgccctgcctgggcctatcagggcctgatgcctggggcccggaaatga

SEQ ID NO: 485492 - DNA, 474 bp, Homo sapiens
acgagcaatggggaaaggattccctatttaataaatggtgctgggagaactggctagccatgtgcagaaaattgaaactggaccccttccttacaccttatacaaaaattaactcaagatggattaaagacttaaatgtagaacccaaaacgataaaaaccctagaagaaaatctaggcaatatcattaaggacatagacatgggcaaaaatttcatgatgaaaacatcaaaagcaatggcaacaaaagcagaaactgacaaatgggcttctgcacagcaaaagaaactatcgtcagagtgaacagacaacctacagaatgggagacagtttttgcaatctatccatctgacaaaagtctaatatccagaatctacaaggaatttaaacaaatacaaggaagaaaccattgagaagatgcaggaataaagtaatcttatatacaagctttgattaaaacttgaaacaaaaaaaa

SEQ ID NO: 485493 - DNA, 1750 bp, Homo sapiens
agcgggatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttctggctcatcgccatcctggcgcagctgaaccccctgttcgggccccagctgaagaatgagaccatctggtacgtgcgcttcctgtgggagtgacccgccgcccccgacccaggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcggtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcctttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttatccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagactaggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaa

SEQ ID NO: 485494 - DNA, 2612 bp, Homo sapiens
agcgggatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttctggctcatcgccatcctggcgcagctgaaccccctgttcgggccccagctgaagaatgagaccatctggtacgtgcgcttcctgtgggagtgacccgccgcccccgacccaggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcggtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcctttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttatccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagactaggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaaaaaaaaaaaaaaaaaaaaaaaaaaaaaacaaaaaaaaagagaggggcgcgcgcgcgccccaaaaaaccccccgcggggggcccaccccccgcccaccccaccttcgggcccaagggggccccacacaaagagggcgagcggcaatatataataacgacacgaagcgcgacggcgggcgcgagcgagacataacaacaacacgggcaggaagaggggaaacaaggcggcacacatgggagaaactctgggggagcaggcaacccaacctccgcgagggaggaggaacaaatatggtggggagaaaacaaaccaacaaggagcagatattataaacagcctccaaagaggaaataatataacaaattttaaagaggtgtttattgttgttggtttatcctttttgcgtgatctaatagcgacggacagagacaaggaaccatacgggcgccacacagggcgggcctctcagtaaagccgggaaacaaactacagtctataacacgagggggggactcgccacacacaaacaccccccgcgccccacccgaccgaaacgacacacagcacacaacaccaagccgagaagcacaacaaggcacagccgacagcacggcggccgaaggaagagagagacgagcagacgaggagcatggggaggaaggaggaacggagcaggcgctgaggccgagacagcgacggcagccgcacgcgagacgggcggaaaggcaagacaagaagcacgacacagctaaccaaagaaagaaaaacagcggacgacaacaaccacagggagagaagcagcaccccaccaacaaacagaccagacagaagaacagaagaaagacacaaaaacgcaacagac

SEQ ID NO: 485495 - DNA, 1637 bp, Homo sapiens
agcgggatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttgtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcggtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcctttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttatccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagactaggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaa

SEQ ID NO: 485496 - DNA, 1589 bp, Homo sapiens
  misc_feature (212)..(212): n is a, c, g, or t
ggacgcgtgggcaagatcaaggcctcgtttggattagagttagcttatgccaaaggccgtttggacatagtgatcatcaccatgctggtcgccaccgccgtctgctgttacctcttctggctcatcgccatcctggcgcagctgaaccccctgttcgggccccagctgaagaatgagaccatctggtacgtgcgcttcctgtggtgagtganccgcgcgccccgtaccaggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcggtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcctttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttatccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagactaggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaa

SEQ ID NO: 485497 - DNA, 903 bp, Homo sapiens
  misc_feature (1)..(1): n is a, c, g, or t
nctgtttctttcttgtgggatgtgtgtgttgttgtctggttcgcatgccggtcccgggtctggggaagcgcggtccccctctcgcgggtgtaccccccccgcgttagttttgtgagccagcccacatattggccggttatctctgcccctctcgtaggacccgtggctcccccgaagttcttttttgtccggagaaccccgcgccgacaaacttctggtttgcggcacccagtattccgagaggtgcgcagttggcgcgcgtccccgggccaaaatatcgcgccgcggttttctgccccccttcagcccccggggatcctcttctggtagaggcgcccggggagaatcatctcccgcccccccaagaaggccggcccattggccccccactcccgggaagatctccgccgggtaaacgcgccgcccaccctgcttcggaggtgttccacagaattgggcgaatccctccccacagagcggggccgcccgcggcctcctccccgctgcgcgtaacaattctgcgtaggaggaacgcccacccggtgggaagaagaagcgcacccactcccggtatttcttcgagcctcacaaagaggggcacacagccggggcgcctctccaggccacccccagtggcccccgaacatgttggagaaaccaacagggggcagtccaacaaccctggtgaaccccatcagacagaaggttgggacaaagaaagatcattcctcccgacgagcccgccttacgtcagctctcccaaccccgggccccccataatcgcccccctcacaaaaggcgcgagataccggcgagacgcggtggcaatgcgggcaacccccctaaagacgtgtgacacaccaccccagagccctttcaaataaaaaaaccttaaacaaaaca

SEQ ID NO: 485498 - DNA, 384 bp, Homo sapiens
cccgataacatgtgcgcgtatcggttggtctgcatgagttcttcatgacagaagctcctcacccaggaagtcctcacgagccagatgtgctcggaagaccaggtattcacctcatagtatctggtccagattggagccttcatccggccactagtgctagcactgccgtgacgccgttctccgcgaaggggtgtctagtcatgacgatcacgcacgcagccgctctcccacacctatctgtccaaaagtccagccacggtggcagcgcagcggtctctgggtggcgatgtacgcggggttcctcgggttgtgatccatgatacgctagcgttgatgtagtctgagtggctgtggctgttctccgccttcagcaggacccgggag

SEQ ID NO: 485499 - DNA, 325 bp, Homo sapiens
  misc_feature (53)..(54): n is a, c, g, or t
  misc_feature (122)..(122): n is a, c, g, or t
aaagggtgggggctgcggcgaggggacctgcggcgaggcggacgtcggagganngcccaggccggggctgcccggcactcctcccccgcccttcacacaaaggggcccagggaccccgcttnctgtcgcgcagcccagtcgctcagacctgagggctccgttccagttaccgctgcccgggcgggtttctgggtacggctcccgcgggggtcgtcggcccccgtccgcacccgaccggacgccggggaggctctgtcacgccaagccatggccacacgctggctcctctgtctctacgctgcccacagcctgctctcgccgcggg

SEQ ID NO: 485500 - DNA, 872 bp, Homo sapiens
ggcgagagaggctagggctctggaggaggcaaatccgggcaggaatgagatccatcagaagcggcagcatgacagtgggcaaaagcagcatgatgctgcggcatatggattactggatgaggtgcatcctgcaagatggacggatctacattggcaacttcaaaggcttgtagaacaagacgacatgaattgtagatacctctgtgactgtgatgagtgtcagacagagatcaagtccaaacgcaactcccaaaccagagctacgaaagggaagagaagcgcagtcctcggtctggtgcgtgctgcgcaggggagaatctggtctcaatgacagtagtagggacctcctcccaaagatactggtattgctcgagtttccagttgctggagactgccgggggacccagggatctggcagggctgctggcagaggaatcccagtctggggttcccatgccccaggctcctgcaggatcttgctgggccagtccgtggggttgtgcgggccatcccaacaggtgatgagcccacaaggaagaggtactgttgcagccgctgcagctgctgctcactagtcgagtattgctcggggcttctgaccccagtacctcacctggctcgtggggggttcctcccccactctgatgggccgaggagcaacccctccaggcatgatgggtccacctcctgttctgagaacttctatgggtccgccattgggggttccctctgtcagaggacgctagggggggtggccctccggcaatggaggggttctttcccttgtgccgttaggggctcacttccctggatttttccttggccgtgtgctttgggcacctgttcgtgctgttcccgtgtgtctcgctgtc

SEQ ID NO: 485501 - DNA, 449 bp, Homo sapiens
agcggcttcccccacccccttccccggctcgggccgccccacgccgcgcaggagagcaaagaaaccccgggcggggcagtggcggccgggctctccgaacgcgcgacccgggagggggcggggcctggcgggagggggcggggggcgcgatggccgcgccaggcaactgaccggggctaaacccgggatcccccctaaaactctgcgaaaagagattactgaccagaggcctcggatgcaagtggtgcaagtcgcagagcgagctcttgaagctatcgaccgggtcttaggatagcatcagacaggtgatgagagagaaagagtacgttgatggaaagagaccagcgagtacaggactcggagcggcagagggaaaataccacattcgacgcggaaacagcagaattaaaggtaggcaactctgacagcgaagctcagaacagccgcac

SEQ ID NO: 485502 - DNA, 497 bp, Homo sapiens
gaacgggtgatgcggtgcattcatgtgctctttgtgcctgtgtactttgtttttgttttgctttttaatgtgtattttgttttataggacctgtatgatttatgctttaaagaggttctgttttgatgtgtttccagtatttgtttgaagatttagagcccctttcagcagtttttgtggtggtggtttggtaatggctgattctctcagcatttgtcagaaaacgactgtatctttccttcatatatgatacttagtttcactggatacaaaattattggctgataattgttttgcttgaggaggcgaaagatagggccccaatccattctagcttgtagggtttctgctgagaaatctgctgtagatctgataggttttcctttataggtaaaccttgtgcttctgtctcacaactgttacggattctttctacctctggaccagcctgttagcccaaatgtccgatgtcaatgacatcgaagggccccgtctcg

SEQ ID NO: 485503 - DNA, 615 bp, Homo sapiens
  misc_feature (7)..(7): n is a, c, g, or t
acaaganagggatatggtaaacacgtggatgacagaggcatccggcagcataactcgaggcataccctgagaaagagttgtagggataaggaggatgatgtgtacagagtctaagctagggaaacagggaatggccaacccagagagagtcacatcatatctgtaaaggacacttattgtgggataaatggaggttgctaagtggagagtgctaagtagatatgttatatagagtacacactctttacaaagagtagcggtcgtgtacagcccagtgacagtggagcacatgtgtatatgagtcctaaataaaccctatgtcacattcactggctctgggtctcatcgtggacaaggcgacatccgtgttggaatcaatagggctcgagcatgacacatgtgcaggattgtttaaaatatatcaaatatatctcaatagaggtgttgaaatttttagagggcgagacgtgtcctggaatggggaaaaacttaatgtgacaaaaatgtaggatagagtggagctctctctctctctctctctctctctctctctctctctctctctctctctctctctctctctctctctctctctctctctctctctctctctct

SEQ ID NO: 485504 - DNA, 631 bp, Homo sapiens
agtaaacacctctgcgttgcagctctccctgtgattactctgagatcagaatccgtcagtatgtcatagctgtgtaccactcccagtctttgtcttccccaaatcttacatctagtgagcatgtgtgctgacttggagaagaggaatatattcattcctcagaatgttcagtccttcttctggcagtgcaacagtccaaagcatattcaggcatgtggctgtctgtcaggcacatgaattgttctgtttgcacctcaacatgggcaacagtctctacatctctccctgatatctgtggagcgctgtgtggaacgcctgctaagcaagcaggcctcatggcaactctggctgctcgtacatgctgtcttttcccaacaattctgtcattgccagcagcagcaagaacaacactttgactgcagatcaacattggagccatctgcaaatctcagctggaccatggcacctacaatgatctaatttcgtccaactaggacagacatttgctcttcaacaatttgaacctttggattcagcttgtagcagtagaagaagctccatttcatcacatgaaagtttccagcatcttggactcgtggtatccatcgtatcattagtagtcagcaagagg

SEQ ID NO: 485505 - DNA, 335 bp, Homo sapiens
atcatcgcttctggtagagtatgtcgcctcgacatataactcgtgcctctattctgccacagaaccggttgtgctctaacatgtgttctataggtagcttgtatggttcgctgggtctaagagttgtctctccttgggatgaagttcctagttaattccttacactcacaggtataagagttagcccatgatagaatgcgcttgatgacaatggttcatctttcacgtgcgtgtctatatgtcttgacacgggctccagtgtcatatagcctagcctatatcagcgtaaacgctgtggctacgattctatacaaggaagctctagtgcatttccg

SEQ ID NO: 485506 - DNA, 174 bp, Homo sapiens
gtgctgaggtactctacaggatccttgagccgaatgtatattatcgccagcggtataacgtttatccgcgcgaattgaagaagtctttatgaacatcccgctgtaaaagaagcggtgtgatccgggtaccggacgcttatcgggggtgaacggtgaaggcggtcattgtgctta

SEQ ID NO: 485507 - DNA, 120 bp, Homo sapiens
acatcgaagtaacgaatgaactgacaaaacattatcatgcaggaggaggagacagcaagagatatagatgtcacagactggaggaggacatgcgactactcagcaagctgcatcacagtg

SEQ ID NO: 485508 - DNA, 408 bp, Homo sapiens
ataccatatggtataggggattgctacccatatttggatggattggtaaatagtattagaggtaatttctgaagatattttagtgtaaagatattgatgtaaaaaaaaattcagcaacctatctatatatggctgtaacaaagaagagtgatttggactactgctacaaagtaggttaaatgatctctacattacttcatgcattaacattctctaaattacttcatatattaacttacatgtaatatatttgtagtatattctaatttaaatatccaacggaaagttggaaatgaatatagtttgtgtttaactgagttgagaaagcatagtatggtaattaaattctttttttaaccaaacattattataaataaaattgctgaattccaagtatttatacttaaa

SEQ ID NO: 485509 - DNA, 320 bp, Homo sapiens
  misc_feature (212)..(212): n is a, c, g, or t
  misc_feature (237)..(238): n is a, c, g, or t
  misc_feature (262)..(262): n is a, c, g, or t
acctcctgttcctcctcaactgtgctcccactagatgggcttgcacaccacacttaccatactctttccctctaccatctctgacctttgtaaatttcagtccctctgaacaacttcagcaaattaattgaacccgaagagggagtcacgggaaccccaacttgaagccagttggtcagaagttctggaggtctggacttacaactggtgtnggggaaacgcccccccccaccccgnnatttggtcataactcttctgcgtngattgttgtgatgtgagagtaaaggaaaaacgctgttacagagttatgataccgcgaa

SEQ ID NO: 485510 - DNA, 132 bp, Homo sapiens
  misc_feature (16)..(16): n is a, c, g, or t
ggcagccaggaagtantctaggtaacgacacatctacaacgttatcgtcacagcccatgcatttgtaataatcttctgcatacgtaatacccatacataatcgcgaggcttggggcaactgactagcttccc

SEQ ID NO: 485511 - DNA, 450 bp, Homo sapiens
tgggaaaaaagcaaaaatttgactttaatttaacttcaacaatgaccctgtgtacccccccaggaaaaaggtaggtggagggagagtggctcaggcttcctgtgtgtccctttaaccagcagagccccagaaacctataaaagcgccttcaccttagccctctataagttggagttgggaaggacgcagggaaatgggaaactcagaaggctcaaaaagttaaagaaggcgtgattggcacagccgtgggagaacaaggcctgtggaaaacagaggagaaggcgcttagaggggcataatgagagaagtccccctataagcgacaggatcatctcggcacgagtagaaccattgccccctgtgagcctcgtgcgacaagagagtaggacgtctcctttgagaagggcagttcaatattgggttgccccccttgcagagaggaaatctcag

SEQ ID NO: 485512 - DNA, 273 bp, Homo sapiens
agcatcctttgcggtgccttcccccttgccatgcggtcacatccccacgtgtcgcggcttcactgagctccatgctgagagcctgagtgcttctgagctcactaagtgcctcaagggcaaggccgacaagcccacctgggtcagtctggctagtgcagtaggtgcagtgagcctgggacataaattagaacgtaaaattgaaaaaggataatacacatatgctttaaggaactattcagatgctttaatgggagtgagacacgggtaacagaa

SEQ ID NO: 485513 - DNA, 118 bp, Homo sapiens
  misc_feature (2)..(2): n is a, c, g, or t
  misc_feature (112)..(112): n is a, c, g, or t
cnactccccccctcttctcctaacggacacgacggtggacgactcactcccctcccctcttctccttacggacacacgacggggggtaccgacgctcgacacttcgtaactnactggt

SEQ ID NO: 485514 - DNA, 396 bp, Homo sapiens
  misc_feature (124)..(124): n is a, c, g, or t
  misc_feature (144)..(144): n is a, c, g, or t
  misc_feature (152)..(152): n is a, c, g, or t
  misc_feature (232)..(232): n is a, c, g, or t
  misc_feature (239)..(239): n is a, c, g, or t
  misc_feature (255)..(255): n is a, c, g, or t
  misc_feature (308)..(308): n is a, c, g, or t
  misc_feature (311)..(311): n is a, c, g, or t
  misc_feature (334)..(334): n is a, c, g, or t
  misc_feature (338)..(338): n is a, c, g, or t
  misc_feature (366)..(366): n is a, c, g, or t
  misc_feature (381)..(381): n is a, c, g, or t
  misc_feature (391)..(391): n is a, c, g, or t
cacgttctgcggcaccctcgctaagaactccaccacctcgtcggtgtgcaggactgttccggtcgggttgttgggggtacacaggaagataagtcgggtgcggtcggtgatcgcggcggacatngcgtcgaggtcgtgatgcanatccttcntcaacggcgccgggacaggggtggccccggcgacctgggtcaggattgggtaggcctcgaaggaccgccacggaaagatnatctttnaccagcgccggcgaangcatgcatgagctggctggctaccttcgcgatccaacccccaccgtcacctgnctnacatttacgccgaagtgaccggngatnctggagcgtacttcctttggcactcatngacgggtaacaggtntgaacccttngcaag

SEQ ID NO: 485515 - DNA, 562 bp, Homo sapiens
  misc_feature (531)..(531): n is a, c, g, or t
  misc_feature (537)..(537): n is a, c, g, or t
tcactccgttacagcaatagcagctcaagaacggttacagaattttctgggatttaaataccctctagaggtttcccattggttacttggtgtacaccctatgtaaatgaagcagaggtccatgatcagtttgattggttgtgggaggggaccaatcagaggctgaagcaaagttacaaagttacaccaccctatacaaacatctgactggttgtgtaaaacgaccaatcagaggctgaagttacaaagttatactcctaggcaaatgaagacttggcctaagaccagtctgattggttgtgggaggggatcaattagcgatactttcaatttttcacctgccatgcagaaaaggggctgggggtggggaggttgcaaagggagtagcctctggtccttttgttacttgagcgtggaaagttggggttttccttttgacttagttctaggaagtcagcctgaattgggcttaggaagccaattccatgcctccagaacctatctcctggttccctccccttcagagatgtncctgtnctcctcaccagagactgtgaatatc

SEQ ID NO: 485516 - DNA, 467 bp, Homo sapiens
  misc_feature (277)..(277): n is a, c, g, or t
  misc_feature (440)..(440): n is a, c, g, or t
agacatcaggacatttctttctttctttctttttttgagatggagtttctctcttgttgcccaggctggagtgcaacggcccaatctcagctcactgcaacctccgcctcccgggttcaagcaattctcctgcctcagcctcctgagtagctgggattacaggcatgtgccaccacacccacctaatttttgtctttttagtagagatggggtttcgccatgttggtcaggctggtcttaaactccagacctcaggtgatccacctgcctccgcctnccaaagtgctgggattacaggcgtgagccattgtgtcctgccaaaatcaggacgtttcgtacaaggatctgagttctgagcctgtcttgagaaaagggaagactgcagacaacaccttgcagcagtggtggccgcgggtggaggggctgccttcccagggtgnttgctggccaagcatttcacccttacc

SEQ ID NO: 485517 - DNA, 178 bp, Homo sapiens
tgactcacttctgactttagttacattaagggggaacatccaaagggtgtttcagttttcattcctttgtttaccaccggctcttgacaattgggcagggaaattttcgggggcttcgaggactgtgcccaggagcagattgcggctcagagcccaggtccacctgctgtgagaaccc

SEQ ID NO: 485518 - DNA, 252 bp, Homo sapiens
cctagactatcccggcgtatcacattatcacagaggagagagtgatgagatgtgaggattctgcctgccatatgctgggtttcaagatgaaggaaggggggcctgaaccaaggggatgcctctagaagctggaaaaggtaaggaaacagattctcacctagacttccagaaagctctgctgttgccttgattttagcctagtgagacccatttcagacttccgacctccagtacgtgaagataatgtgatag

SEQ ID NO: 485519 - DNA, 790 bp, Homo sapiens
  misc_feature (459)..(459): n is a, c, g, or t
cctagatgaaacaggatgtcactatgtggccttgcatggactggcatctgttggttcaggagatcttcctgcctcaaccttccaagtatgcctccgactatgagcccttgctagtacacctagcggttaatgaagcgcgagagaagttcatttgatggacgcgtcctatactaccagcagaatgcatatgatctaggatggcaactgaagatggcgggatccacagtctgcactcctaccacactatgctactctggctctaactatgaggaagcaggggcatttttttttttcttggtgactagattgataagatgacaccgttcgtgggtcctgatactctaacttatacgggactgcaggaaccgatcgctactatctgctgactgtctcattcaattaacagagactggaggtcatcctgtagagcactgacggattttatctgtctgaacctgngcagaccacgtccaaggcattccatatgtgtggatcttcgcgtgtgagcatatcatccgggcacatcaaactaattgctttttttgttctaaaactatttttttaatcatcagatttatgctagctatatgggtattagcgtatctgggccttatggctctaaaagggggtctactgggccggtacccttgagggagggtaattgaagaactgactaactgatggcgtgcctaagacggtcagcttgtggaaagcgaatcaaatcactaaaaggcgtgctttcggttttgcccatgaggccggggtttactctggattaactggggagcga

SEQ ID NO: 485520 - DNA, 316 bp, Homo sapiens
ggcgtcgccagatcgatcctggaagacggcagccgccgtgactggtcagatcctccagcagacctacagtcaagtttgatataaactcgcacaaccatgacgcactgctcaatgaactacgggctgttctactgcttcacgaaggacatggacaaggtctagacattccatacgcctcgtgcaggtgccgctctgtggagggcagctgtggcttctaggtgcccgagtagcatcctgtgacccctccccagtgcctctcctggccctgaaggtgccactccagtgcccaccagccttgtcctaataaaattaagtt

SEQ ID NO: 485521 - DNA, 261 bp, Homo sapiens
tgcgattcaccgcgtgattctgtcagcagacttaccatgctcttcttccttaagtttcacttaaatctgtgtctgatacgtaactcttttcttaacatctattacagggtttctacgggtactggggattgattcattcttcttaatctttttcttgtcctatgtcttcttctgcgatgagtccaatgcctctccctgatggtcactctttacttcatcgggctctttcatatctcagggttcattttgagtgtctactga

SEQ ID NO: 485522 - DNA, 362 bp, Homo sapiens
taacgatcacccaaagatctttgagcatcaccccccatcttaaagatgaggctcagattagttacatatttcacctaaagttccagaacggtggattggtacccgatgataataaactatctactctttcttttggtattactctgtgcctgttagtgatctctaaataacactggtattgtcaatacaagttgaggtctctctgcgtcaataggcagagattattaattctaggtcacgattctggcagtcctagcgtccaaatgtatttttcacccccatcacggattgtgaaaacagcctttgtgattcctcccctctcaccagaaatgaacacataccggtgataaaattgaaggtac

SEQ ID NO: 485523 - DNA, 170 bp, Homo sapiens
caaacaaatggaaaaattttttttgctaatgggttgaaagaatcaacattggctgggcatggtggctcacatctataatcccagcagtttgggaggccgaggcaggcacatcacttgaggtcaggagttcgagaccagcctggccaacatgacgaaaccccgtcactaca

SEQ ID NO: 485524 - DNA, 1004 bp, Homo sapiens
gcgaggagccagcggagcaccgcgggctggggcgcagccacccgccgctcctcgagtcccctcgccccttatcccttcgtgccccccggcagcctccagcgtcggtccccaggcagcatggtgaggtctgctcccggaccctcgccaccatgtacgtgagctacctcctggacaaggacgtgagcatgtaccctagctccgtgcgccactctggcgtgctcaacctggcgccgaagaacttcgtcagccccccgcagtacccggactacggacggttaccacgtggcgtgcgcagctgcagcggcagcgaacttggacagcgcgcagtccccggggccatcctggccggcagcgtatggcgccccactccgggaggactggaatggctacgcgcccggaggcgccgagagcgcagacaacgccgtggctcacggcctcaacggtggctccccggacgcagacatgggctacagcagacccgcagactaccatccgcagcaacaaccgcatcaccacccgcgacagccggacgacgagccttcactgcgcttactgggctggtgaaaacgctcaagcccggacctcctgggaccgcgacacacgatgacgacgagcagatgtctaccgggggacagcggcggaaactgtgcgagtggatgcggaagccggcgcagcagtccctcggacaagcaagtgaaaaccaggacgacaggacaaaatatcgagtggagtacacaggaccaccagacggatggaagctggagaaggagttacactacaggacgataaaatcaccacatccgggagcgaagaagcccggaggtaagccggacaacgacagaggggactaatctgagaaggcaggggtacaacacctgggttcagaaaccggaagaagcacaaggagaagaaacacacacacggcaagacagtggaagaagaaaaagagagacaacacaagagccagcccgcgacacaacgcacccagcacagcagagcccgaa

SEQ ID NO: 485525 - DNA, 633 bp, Homo sapiens
  misc_feature (2)..(2): n is a, c, g, or t
  misc_feature (65)..(65): n is a, c, g, or t
  misc_feature (69)..(69): n is a, c, g, or t
  misc_feature (97)..(97): n is a, c, g, or t
  misc_feature (100)..(100): n is a, c, g, or t
  misc_feature (280)..(280): n is a, c, g, or t
  misc_feature (283)..(283): n is a, c, g, or t
  misc_feature (298)..(298): n is a, c, g, or t
  misc_feature (331)..(331): n is a, c, g, or t
  misc_feature (337)..(337): n is a, c, g, or t
  misc_feature (353)..(354): n is a, c, g, or t
  misc_feature (442)..(443): n is a, c, g, or t
  misc_feature (446)..(447): n is a, c, g, or t
  misc_feature (449)..(450): n is a, c, g, or t
  misc_feature (453)..(453): n is a, c, g, or t
  misc_feature (492)..(492): n is a, c, g, or t
  misc_feature (539)..(539): n is a, c, g, or t
  misc_feature (543)..(543): n is a, c, g, or t
  misc_feature (567)..(567): n is a, c, g, or t
  misc_feature (632)..(632): n is a, c, g, or t
anagaagctgcctcgcggagctggttggccaccagcgtggtctcctgcaggcgggtgatggtgancgcngagaacaggtccctcaagttcaaggtancgngggcgctcaggttacgtccggaatcctctcctacggcaaactggtgctccaagcgcacagcaccatttcggggccccagctggccagcgtgagccggtgcaccgagggcggcaggtccctgcgcaccctgaaaactgcgtgcgcggaggagccccgaaattgtaggcggcgccgccaccnggngccagcaccacctgnggggccaggacctcctgctccgcctggtcacgngtgtcntgcggctgcagcctgnnctgtttccagcagcaccaggtggcgccctcgcacccacgcccccgacccgttctccattagttaaaacaatactccgcttccatcgtnnttnngnngcnttcggtgcaccatgagctccagcgagccatctctcaggntgctgccccctgggagcggtcagtcagcacagtcagctgcatgtgtncatncgtgatgtaaatccgggtgttgantgtgatagtagtttcctgccacgggctccgtctggttcagtttccaggtgggtcgataatccgcnt

SEQ ID NO: 485526 - DNA, 195 bp, Homo sapiens
cctcaccattgctatgcaaagtgattcttgtgtacataaggatttaaataatgcacctatttaagacatgtgacaaatgcgggtctgggacccgctctattatgaagtcttgacgtgggtagaagagagaaaaagaatgaaagtggagaagaagaacataggattggggggggggagggggcgggagggggtggg

SEQ ID NO: 485527 - DNA, 1063 bp, Homo sapiens
catatcttgcgggtgttttctgtttggtcccgcggggccgtggtttcccagtgttcaacccacgggtagaccatcgtagttgcgccctttaggcccctacttttaggggggcaccccttttgtggacataaacgtttgtgttcccatatatatatccccgggcctgggtttccccggttctccgggatttttcccccggggagatgtcctgtggtaccccatccgggttccgggcttgtggcgctcttcacagtggccccgtgggacgtggagtgcccaggcggagttttggatgcccccccctatgtgacgacgggctcctccaagcgagccccgtccgaacgccctggcaatagtgtcccccttggcccacgtgcctatcgtcccacggctcccagctggtcacccacagcccctatcccggccacccacttgagtggaggtcacgagttttttggggaccactcacggacccgaaacgttgagggtacacatgtttccgcagtatcacgcacgcactggaggattcacccttggaagaatcctggagggtggagccctgcgggtccgtcaccactcacgccccaacaagccccctgagcacacttctaaggtgtgtttagccccctcttctaccacaagagctggagacccgtgtcactgttgtgccccacgaggtggcccccgcactgtgtctacctcttttgtgggcacaccacacccccacgctttgggcgtccccacaatcacttccgagggtccctcgagggagaccacgagcacgtggctcgtttggtggactcgtgtccctcgagcttcacgtggccaccgcacgagccccctggcctttgtggaaacctgcggcacgcctcggcctcgccacgcccactcacgctttctcgggctttcggggcacgaggaccgagtgaccctgggaggccctcggggctgggcccctgagctccacaaaaagtgcgttcttgaccccgatgaggccccgatggaggctgttcattccctgccgtgtcggccttgtaaataaagcctgaccccttcgctgata

SEQ ID NO: 485528 - DNA, 346 bp, Homo sapiens
  misc_feature (7)..(7): n is a, c, g, or t
  misc_feature (48)..(48): n is a, c, g, or t
  misc_feature (60)..(60): n is a, c, g, or t
  misc_feature (117)..(117): n is a, c, g, or t
  misc_feature (136)..(136): n is a, c, g, or t
  misc_feature (160)..(160): n is a, c, g, or t
  misc_feature (204)..(204): n is a, c, g, or t
  misc_feature (233)..(233): n is a, c, g, or t
  misc_feature (291)..(291): n is a, c, g, or t
  misc_feature (309)..(309): n is a, c, g, or t
aaccctnagaagccagttggggcagtccaagaagcccaagaaggcggntggcggcgcaantccgaagaagagcgctaagaaaacaccgaagaaagcgaagaaagccgccgcggccantgtaaccaagaaagtgctnagagcccaaagaaggccaaggttncgaagcccaagaaagctgccaaaagtgctgctaaggctgtgaanccaaggccgctaagcccaaggttgtcaancctaaagaaagcggcgcccaaggaagaaattagcgaacgcctacttctaaaacccaanaatgtcttttcagagccnccactgatctcaataaaagagctggttaatttcttta

SEQ ID NO: 485529 - DNA, 236 bp, Homo sapiens
aacataatcagaggagtgtgtggctttgtgcagctattggcgcaccactgcatgtcagcctgggtgacagagtgagatcatgtttcaaaaaggaagaaaaattatacacttgtaggttctctctaattacttccctgacccacacttttcatttgtccaagtgctggagctgtgtcctcaagatttttacaacttctgggaaggacgtccattgcccttgatgactgtgatgcacg

SEQ ID NO: 485530 - DNA, 598 bp, Homo sapiens
tgtgtggtgttatgggatataaactgttagaacgccttcttaaacattcacggagagcgttcttacaagagacaatctaagttaagggacatcgggtccttaatccatttctcaaggaacgagagatttttcctaagtcgaattctttgagacctttgaaagcgttcactaagcacattgcacgtaaaaaaggtttgaaccttgactcgactaaacatccctcggattttaggagcatgctaaaagggaggttctatctcaatagcattttgaagtgatttgtaagtaaaactgtgatccctaaatctaggattggggtcacaatctacctacgtatctttcctagcggggatatcgtaaaattaaggttatacccaacgcaaataaacatccctagcaaagggacatccatttatgtaagacatatcctaaaattcatgaagcatacaaggcattagtaacctaaactacataccttgggatttgtaacatgctacacataaggatcctatcatcatgtgactagtttccaaagttctagcatgcaaaagcaatcaagtaacaagataattaattaatcaaagattacattcaatta

SEQ ID NO: 485531 - DNA, 197 bp, Homo sapiens
aaagcatgctaagatacacagtcaaaatgagagttcgcagctgcaaacaccagactatgcaaaggtgaagcagccaggaagtctggaacgatggctttgtcctaacaggtcactcatcaaacacagataggaatgcatgacagtaacaggtaactggtactcaataaactcccactaccataaggaacttactgcta

SEQ ID NO: 485532 - DNA, 1324 bp, Homo sapiens
gttgtacagtgagatcgactgtgtactaatggccaagagtctggcggaaaagctgtatctatttcatgtacccatgtgctgtccatgcctcgatgacctactgactgacattcctgcacctctcagccaatgatcaatgcccaatgcatgcagaatggtagatgcttgatgatggccatctgacacccttgaaccccaactatttgcctgcatgcaaatgggtgatgcatgatttgctgcttgaactgttgtgactgtgtgtgcctgctgcctgactgatgaccatgcactgtattcctctgaatgcttgattgtgacaatgcatgacgctatcttgctcttacccatgaccaccatgtaacacataccctgttaattgcctgcttgcagctactacatgtgcaatggtagatgctaccaccgtgacgaccttatacaattggacatcactgacacgcactgctgtgcaccaatgctatcataccgtaacccatgtggataacgtgcttgactgccatatgcgacctgtgtgatgacgtgtgatgtggctgtgaccaaactgatgtgacatgtggtgacatactatcagcatgtgattgcatgggcgtgggaaatggacctgacttgctctacactgcatggactacacctgtgtgcttgatggattctccactgtgcacttgtggaggctccacaggacgcccaatgtggcccctgccccatgcctgcccttgttgattgcactgtccccgtaactcggaaggtttcactatgcaagaaaacgcaaaggccaacatgccaatggaatgtagaaggagcccccaattggagagaatcccaaaccctatggtcaaagttttagacctaaaattggggcgcccttggaagtcggtggaaccacatggtatcatgacgatacccttatgcaagcgccaattggaaaggctagaatccaaggataacacccctttgggcactagagttggaccccccccgagattggcgtcaaaacacgactggcggcggcatttggcgaatggcaaaacccaaccatcgggaacgggcatccccaggcttccagatggtttccatgaccccacaaacggttggaaagagtaaactcctatgaattcggacttcggccttggaattgggcccacaccgccaatggaccaacgtgggatctgcgcagcggagatgataaaggatgcacaacaggacattgttcgtgagctcccgccaaagacgaaagcggtgccgctctgtgcctgcgaaatgtacgtcaccccaaaggcataagctgcgcaaacatgcctttgggcca

SEQ ID NO: 485533 - DNA, 1293 bp, Homo sapiens
gaacgagtacctgggtccactatgccctgtccaatgctcaacccacactaagggcacccatcgacctagaagcatagggacatgcgtgtgactgacaacgtgcgagccaactcctatcgtggtggcacggaatcactggcatgagacagctgtcttcgtaggctgactactacgctcaagcgcggcactctctcatacacacctacccgttacctctgctagcgctgacgttgaactctccatcgtgcctgctcgagccgaagcccattgtcgagcggcggcagccaatcttgccgtgttgcgcctgcctcagcgcatcaacgcccctaagccgccctgcccgccttacgcgccacgcccttccctcccctttcctctccgcgctctacctgcctgcgatccgtatcgccgccgctcccctgcctcgctgccacgccctaccgcggtgccgcgatcaccttccgacctgtgccccgttccacgtagcgcgctgcactcgtggccttcgctcgcgccatcccctcctcgcgccccccgtcgcctccctcactcccccacgctccggcggcgccctcacatccccccccgaacgggccctccttctcccatttgccccaacgcgcccccttgcgccccttacccccctcctgcgcgttcgccctccgctccctccgccttccacccttcgccacttgcaccgcgagcctccttctctctttcacccgcctgcctcctaacgccaggcgcacctgctgccgccacccaacccccacgcgccgtctctctttccaccgcccctccctcctccgccgcgcctatctccgcccccgcccgcctgcgcctcccgcaccccctccacccgcccccgcccctcccccccccgccccgtcccctccggtcctacccccccccctcccccgccgcgcctccctgccgagccccctcctccccccccgcaccaccccccaccccccccctccctcacgccccccctccccccccccccccccccctcgcacccccgcccccccctctccaaaaccttttccacccccccaccccccccttcgcccccttcccacccactcctcaccactccaccccccccgcggacccccctcccctcctcttctccgccgcctggccctccccctcccccccctccccccgtccccccccccccccctcgcctcccccactcccccccccccccctcccgccccccctctccccaccgccctattctcccctcccccccccctctctctccccccgcccctccctggcaccccc

SEQ ID NO: 485534 - DNA, 138 bp, Homo sapiens
aagtgtgtccagattagaggcaatttaatgatagggaattggggcaatcaagaagcattatatacacagattacaataaaggttattggacaaattaaggcctccgaattcataagtcaccaaggctaaagaaccaat

SEQ ID NO: 485535 - DNA, 833 bp, Homo sapiens
ttctcccacctgtagtcgactcagagcctcctagctcatggcctccttaggatgcgagagcccgaaggcagtgcacaccgcagggaccgagtgatcctggggcggctcctcgcgtgcttgccccgagctccggccctcgagtgccgggacccctaggtctggcgcgaggaggaggaatgtcgaggtaggaggtaggatgcgtggtcggatgatccatctcgtgtgtgcatggttggatattcagtgattacgtggggcattgcctacgtatggatactagtagactccaactaatcccacttcattgccagtatgccccagacactaagagagcctcgaagcttctgctagaagatgttctgggatgagatcatatctccaccgagttgcgtggttagtataacggagtgcctaaactaggatgagaatatgactcgatttcttgggaaatgctttgcgcctcgcgcagtgagcactaggagagctctataagacctgaattcataagttgtgttgcctagtgtggtggattttggtgctggagataagcaagacaacgccgtcctttgctggaagtctactccttcattcgcagacgccatgactgccactgagaaaatcctcttcctctcttccattattcccgtttgactgctcctcacagttcgagcacttggagggctgctgaagttcctggggtcgcaggaagactcggggttgacctggaagatatattgtcagggtccccacctgggttaagaatttgtggggccctctggtgactggttcgaccttacgggtctccgtttaggtggtcccttggtctggccggc

SEQ ID NO: 485536 - DNA, 314 bp, Homo sapiens
cgcctccacctgtaaaacgtgaatgccgagatgctcagtatgtgggcgatgtgacttcttttgagcagattgcactacccgtcttgaggaatgccgactgcagcagtgtcccagtgcaaagagcgtgcgtcatcgatgagattggtaagatggagctcttcagtcagcttttcattcaagctgttcgtcagacgctgtctaccccagggactataatccttggcacaatcccaggtcctaaagtaaagccacttgctcttgtagaagaaatcagaaacagaaaggatgtgaaggtgtttaatgtcaccaaggag

SEQ ID NO: 485537 - DNA, 246 bp, Homo sapiens
gagacagagtctcgctccgtcgcccaggctggagtgcagtggcgcgatctcggctcactgcaggctccgccccccggggttcacgctgagggtgcctttttctgactttcatcaaagccctgagtgctgacagcagccctggggagaagtgaccgaaagattcccttggggcttgggaatcggggcctgagaggtgaaacctggacctgttgggttctcacaccttggcccttctgtcgtcttctc

SEQ ID NO: 485538 - DNA, 569 bp, Homo sapiens
  misc_feature (377)..(377): n is a, c, g, or t
  misc_feature (461)..(462): n is a, c, g, or t
actggcactgtacggagagagatgcttcaaattgttccacggataagctgcgaacactgttcttggcatgcgcagtgttcaaaatgaagaaggcaagtgtgaggtgacgtaagtgagtaagcttgatggagaggcatccattaacaatcgcaaagggaaacttatcttcttttatgaatggagcgtcaaactaaactggacaggtacttctaagtcaggagtacagtacaaaggacatgtggagatccccaatttgtctgatgaaaacagcgtggatgaagtggagattagtgtgagccttgccaaagatgagcctgacacaaatctcgtggccttaatgaaggaagaaggggtgaaacttctaagagaagcaatgngaatttacatcagcaccctcaaaacagagttcacccagggcatgatcttacctacaatgaatggagagtcagtagacccagtgnngcagccagcactgaaaactgaggagcgcaaggctaaagcctgctcttcaaaaaacccagccagacctgttggagtcaaaatccccacttgtaagatcactcttaagg

SEQ ID NO: 485539 - DNA, 380 bp, Homo sapiens
tagggctcctggcccaataatcatgactataagaatgactccaaaaatcgtaatgatcgcgttcgcgactacagtaatatgcgtgtgtgtcctcggttttcaggccgatcatgccaaataggcgatgcttttggaatcatctcttgaaatggtgaagctgcctttcacagacgcggcgtattctattggtccaccgtaagtttttgcttctaatgagacctacccactccagccccttccctggaggcttgcggaaccaattcatagcataatcaccaaaggtgaatccagacgctttacaggagagtctcagggaccgccctggctgtaccaagcctcccccagactccaccagccgcacctcacatgggcactcaata

SEQ ID NO: 485540 - DNA, 5027 bp, Homo sapiens
gcggccgcacctcgctctccctcgggctgctggttgctgactttggcgccatggtcaataacccacacctgagtgatgtccagtttcagacggacagcggggaggtgctttacgcccacaagttcgtgctttatgcccgatgcccgctcctcatccagtatgtgaacaatgaaggcttctccgctgtagaggacggggttctgacccagcgtgtcctgctgggtgacgtgagcaccgaggccgcccgcacgttcctgcactatctctacactgcggacactggccttcctcctggccttagctctgagctgagctccctggcccacaggtttggcgtgagtgagctcgttcacctgtgcgaacaggtgcctattgccactgactcagagggcaaaccatgggaggagaaggaagcagagaattgcgaaagcagggccgagaatttccaggaactcttgaggtcaatgtgggcagatgaagaggaggaagcggagactttgttgaaatccaaggaccacgaagaagatcaagaaaacgtgaatgaagcagaaatggaagaaatttatgaatttgcagctactcagcgaaagcttctccaggaagaaagggcagcgggtgccggcgaggacgctgactggctggagggtggcagtccggtttctgggcaactcctagcaggtgtccaggtgcagaaacagtgggacaaggtggaggagatggagccgttggagccaggaagagatgaggccgccaccacctgggagaagatgggacagtgcgctctcccgccaccccagggccagcactcaggggcacggggagcagaggcccctgagcaggaggcgccagaggagatgcttggccattccagctgctccagcccttccagggactgccaggcagagagaaaagaaggctctcttccgcactcagatgatgccggggattacgaacagctcttctcatcaactcagggagagatctcagagccgtcccaaataacaagtgagcccgaggaacaaagtggcgctgtcagggaaagggggctggaggtttctcatcgcctggctccctggcaggcatctccaccgcacccgtgccgcttcctattggggcctccccagggcgggagtccccgcgggtctcatcacacaagtgggtcgtccctgtcaacaccccggtcccgtggcggaacttcccaggtgggctccccaaccttgctgtctccagctgtgccatcaaagcagaaaagggacaggagcatcctcacgctgtctaaagagccagggcaccagaaaggcaaagagcgtcggtccgtgctggagtgcagaaataagggggtcctgatgttcccagaaaaatctctgtctattgacctaacccagtcaaatcctgaccattcgagctccagatctcagaaatcttcatccaaactgaacgaagaagatgaggtcatcctcttactggactcggatgaggagctggagctagaacaaaccaaaatgaagtccatttctagtgatcctctggaagaaaagaaagctctagaaattagccctaggtcctgtgagctgttttccatcattgatgttgatgcagatcaggaaccttcccagagcccaccaagaagcgaagctgtgctgcagcaggaggatgagggggtgctgccggagaatcggggctctttgggcaggagaggggctccctggctgttctgtgaccgtgagagcagccccagcgaggccagcaccacagacacctcgtggctggtgcccgccaccccgctggccagcagaagccgtgactgttcttcccagacccaaatcagcagcctcaggagcgggctggccgtgcaggcggtgactcagcacacgcccagggcctcagtaggaaacagggaagggaacgaagtcgcacagaagttttctgtcatcaggccccagacaccaccgccccagacaccgtcctcatgcctcactcccgtctctccaggaacttctgacggcagaaggcaaggccacagaagcccttcccgtccccaccccgggggccacccgcactcctctccgctggctccacatcccatctcaggggaccgcgcccacttcagcaggcggttcctgaaacactcgccgcctgggccaagcttcctgaaccagaccccagcgggtgaagtggtggaagtcggagacagtgacgatgagcaggaggtggcctcccatcaggccaacagaagccccccactggacagtgaccccccaattccaattgacgactgctgctggcacatggagcccctctcgccaattcccattgaccactggaacctggagcggaccggccccctgagcaccagcagccccagccgcaggatgaacgaggccgccgacagccgtgactgtcgctccccgggactcctggacaccacccccatccgaggaagctgcactacccagaggaaattgcaagagaagtcctcgggcgcgggctccctggggaacagcaggccgagctttctgaattcggctctgtgggacgtttgggacggggaagagcagaggcctccagagacccctcctccggcccagatgccaagcgctggtggagctcagaagcccgaagggttagagacacccaaaggtgctaatcggaagaagaacttgccccccaaagtgcccataacgccgatgccacagtattccattatggagacgccggtgctgaagaaggaactggataggtttggagtccgccctctgcctaaacgccagatggttctgaagctgaaggagatattccagtacactcaccagaccctggactcagactccgaggacgagagccagtcctcacagccgctgttgcaggcgcctcactgccagaccctcgcctcccagacctacaagccttcaagggcaggggtccatgcccagcaggaggccaccacaggacctggggcccataggcccaagggacctgctaagaccaagggcccccgacatcaaaggaagcatcatgaaagcatcacacccccaagcaggtcgcccaccaaggaggcacctccaggcctcaatgatgacgcccagatcccagcctctcaagaatccgtggccacctctgtggatggcagtgacagctccttgagctcacagagttcttcctcctgtgagtttggagcggcatttgagtctgcaggtgaagaggagggcgagggggaggtcagtgcctcgcaggcagccgtgcaggcggcggacacagacgaggcgctgaggtgctacatccgctccaagccggccctgtaccagaaggtgctgctgtaccagccctttgagctgcgggagctgcaggcagagctgaggcagaacggcctccgtgtgtcctcgcgcaggctgttggacttcctggacacccactgtatcaccttcaccactgccgccacccgcagggagaagctccagggcaggaggcggcagcctcggggcaagaagaaggtggagcggaactgatggggccgtcccgaccccaccccaacctgccatcagcagcccccacccccgccatttgcagggaggacctgggacacccagcgtgggtcaggcctccacaggcatttctgggtctggggaccacatcagctctgcgctgtgatgatgaccacagcccaatccagggcttcctcctctgggctctgctttctagggtggcatttggagcatgtcacccactggatttacagactccagccccttcctctgtccgtgctcacagtgggtgtcctcgcgcaggctgttggacttcctggacacccactgtatcaccttcaccactgccgccacccgcagggagaagctccagggcaggaggcggcagcctcggggcaagaagaaggtggagcggaactgatggggccgtcccgaccccaccccaacctgccatcagcagcccccacccccgccatttgcagggaggacctgggacacccagcgtgggtcaggcctccacaggcatttctgggtctggggaccacatcagctctgcgctgtgatgatgaccacagcccaatccagggcttcctcctctgggctctgctttctagggtggcatttggagcatgtcacccactggatttacagactccagccccttcctctgtccgtgctcacagtgtgtctccctttttggttttctttttttttttctttttgagacagtcgtgctgtgtcacctaggctggagtgcagtggcacaatctcggctcactgcaacctccgcctcccgggttcaagcaattctcctgcctcagcctcccagatagctgggactacaggcacacgctgccacgcccagctgattttttatattttagtagaaacggggtttcaccatgttgctcaggctggtcacaaactccagagctcaggcaatccgcctgctgcggcctcccaaagtgctgggatcacaggcgccagccactgcgcccggcccagtgtgtctcccttaacccaagagggccctcagctgtcccagggggcagtgggccatcaccagctggccagggcatggcctattctgccacatttgccaccctctgagcccaccagtcctgggcacagctgccctacacgtctgtcctgagatggacgtcaggtccagcctgccccggcagcccgggcccgtcctcctcagcactcaggccaaccccagccaccgccagcctgagaccaggtgtcctgaggctccctgcactgccacagcccagatgcagttctcctgacccagccgtgctacccggacacttgtcattgttaccagcagtctccaaactggacagtgcacaagggcccagaacaactctgatgccaccacaaaacaaacatgttcactagcggattccattctttgggttgaagctgcctccagcctcaggagcagtgtggaggaagatgagggccaggaaagaaggaaaccttggtttctccatccttgtgaatgtcctcgtctgtttcaaatacagtgcagtcagtttt

SEQ ID NO: 485541 - DNA, 163 bp, Homo sapiens
gtgaatttgtcatatgtggcccatattgggcaaattcgccggttagcggtaggctgcgtctctctaaggagaggcggggtggctggaattaagggtgttatgctcatgtttgcttgttgcaggtgcgagatagtagtagggtcgtggtgctggagtttaagtt

SEQ ID NO: 485542 - DNA, 104 bp, Homo sapiens
tggattctggccacgcaaagtactccttgtaccataataatagcggaaagctactatactgaaaaagtactagtgtgccctgctgcgaccctatcagaagatgc

SEQ ID NO: 485543 - DNA, 165 bp, Homo sapiens
aaaactaatagtatctatactacttacagcaagtgcagacacaaactaccaataaagcctatatagtaacccaaagtgtaagaataatatctaagtgtgatagttatactcacactttgatgctattctcacatttgtaatgctagaaacttgtatatccacatc

SEQ ID NO: 485544 - DNA, 482 bp, Homo sapiens
cccggccatgttcagttcatcgagttttgtaatacaagaatttgaatatgacttttataaaaatagtgtaaaaatggtagtacagtttgaacattcctaatccataaacttgaaatccaaaatgctgcataatacaaaacttttttgagcccaacatgatgctacaagtacataattctacacccaactttatgtgatgaatcaaagtcagaatgcaggtgtacaacagtttctccaagagaaaaaagacctgcctagccctccttcagctgccatatatcttttcctcacacagccagatgcacctacgcaagcatgcccacaaaggaaatacaatgccatgtgtatgtgtaagaaatgatgggttatacgtagcatataaattcagagacgggaatgatagtgatgtcaaacaaccacagactgtccacatgagtggctaagatagtgacacctttgctttaggatggtacagtgtatac

SEQ ID NO: 485545 - DNA, 652 bp, Homo sapiens
aagtatatcacttctcaccaagtgggtagagtcagttggctgtttgtcccttgttttttatttattccataattatgtttgtgctttttgttttgtaaacagtaatggaacgtacatttttattttgtttagaagacaactttgattcaatctttcaagaactgttccattcttggtttcttcttagggggataaaaagttaccagttaatttgttttgagatatttaagcattctttgagttatagaattgtgatgcagggatttgtgaatgagacatttcacatgtgaaaaggtgacttcactaagttaccctgcttgagcagaggtaaaagtgtggtatagtgtacactaaagatgtaaggtaatgcttaacctccagttgtggcaggtgcctctttagagtgttcccgctttctattaaaggtctctcaaaatttgttgcagtatatatttagtatagtatatgagtgtaagtgttatagaaagtatatgttataaatatacagtattttgttccagggggtgatcttgaataggtcctggtatttgtgtatatggagagtgtgaaaggaaagaaaggtactttctccctctagaaaatataaatcacccaaaagtcctgtttaaggtaagaaaaagtattgaaacga

SEQ ID NO: 485546 - DNA, 311 bp, Homo sapiens
  misc_feature (24)..(24): n is a, c, g, or t
  misc_feature (57)..(57): n is a, c, g, or t
  misc_feature (169)..(169): n is a, c, g, or t
  misc_feature (181)..(181): n is a, c, g, or t
  misc_feature (210)..(210): n is a, c, g, or t
  misc_feature (238)..(238): n is a, c, g, or t
  misc_feature (260)..(260): n is a, c, g, or t
  misc_feature (289)..(289): n is a, c, g, or t
ggatcacggggtcaggcgttcganaccagcttggccaacatagtgaaatgccatctntactaaagttacaaaaaattaaccgggcgtggtggtgggcgcctgtaatcccagctattcgggaggctgaggcaagagaatcgcttgaacctgggaggcagaggttgcagtnagccgagaccgnaccactgcacttcagcccgggtgacagtncgagactctgtctcaaaacaaaaaacanaaatcaaaaaaaccctagatgncgggtttgataggtgcagcaaaaccaccnttagcacatgttttacctatgt

SEQ ID NO: 485547 - DNA, 891 bp, Homo sapiens
gagagagtggggacgtccggtttcggagcgggagtgttcgtgtgccagcagactaaacagacgagtgaaatatgggtgatgtgagaaaggcaataagataaatatgaagatgtgcccattgccacaaacgttgaaaaggtgaggcaaggctagagagattgggactcaaagtctccatggtctctttgggcggaagagcaggtcaaggcccgatggatagtcttacataggcggcaataagaacaaaaggtagtgatctgtgggagaggatacactgaaggagtagttaggtagaagtcccaagaagtaatgcctggatcaagaatgatctttgtcggattaaagaagaaggaatgaaagggagactatattagcgttagctcaaaaaagctactactgagtaagtaatgtggcccgctgcttactttattccgaaacagaactgtctcatgacgttatgcctgtgtagccagtcctttaaatagatctcataccaccagaattcaggatcagtgaggtgccctgaccagaatattgtgttgggcagccggattacaattaggaagtggcttgtgttcctggcatgtgtcggcggagaacatacgtaacgtcgatcagtacatggatcacggtatacccttttaagattgactaaacttggtagtagtgttcacctgtcgcaccggggggggccgcttacactacgggatgcgtcactgcgccacaaccgggcgcggctttacagcgggcgcggcccgtgttaacacacagaaccggggggtatccttgccaagaagggggaaaaaggcaccctttgggaaacaatacgcaaggggtacgcagggcgtacccccactgacctcactctctgctggttagaactataaccca

SEQ ID NO: 485548 - DNA, 188 bp, Homo sapiens
tttacttctctttttactatacgtccggcttacatttaataaaggtccatagatgcggaatggggagtgacaggaatgaaaggtctcggtctccaccaggccaattgggagtgcccccataaaaagcttatgtcaaattttctcaaaccaacagatttcaaacacccagtaagatgaggtggggggat

SEQ ID NO: 485549 - DNA, 356 bp, Homo sapiens
  misc_feature (22)..(22): n is a, c, g, or t
agacttgggattctaaagccanatttgaccttgacctaggcaagatgtgacaataaaatgaagaagaaggttttgtctttaacttcatactttggtcctaaagaacatgaggtcctgggacaggcagagtcatactgaccatctgtgaacacctggcacttaattcaattccttgagcatagcagatgccccaaattgccatcttattgaataattgaacttcaaaagtttgttggccatcattcgatcaaacataagactttccaaaaacagcattttgaaagacaatactcatttgaacacttgcctttatctttatttgaaataaataacctcattacttagtcacttcagct

SEQ ID NO: 485550 - DNA, 234 bp, Homo sapiens
  misc_feature (60)..(60): n is a, c, g, or t
aggatccgtgaaatgatccagagagtccatatgtcatgaacctgaggcgcaagtacgccntctctattgctacgattatcggcatcattgtcgtcatcgcaagtgtgctcggaggggtacgtcctctcccacggtaaaatctgcgcactgattcagccttttcgaagtgctgattatcggcggtgccgcggtacggggccattttttgagggcgaaacccatggttatatgtac

SEQ ID NO: 485551 - DNA, 259 bp, Homo sapiens
cacgaggtttttattcatgttttagatttgacaaacagcacctcagtgcaagtgggttcatttttttttcagcattcttgcaccttttcccttacatagagacctgtacgctgggaaaattgtacagtgcacttaactgtcctatctgagcaggcttactttatactcagcctctgtatctctgattactgaaaagatacagatatcagaggcagagtcaagtggtatttgaacaccaactggggcagatgctacctta

SEQ ID NO: 485552 - DNA, 684 bp, Homo sapiens
gaccgcaacctcaagaccaccttcttcgaccccgccggaggaggagaccccattctatacgcaacacctattctgattttgcggtcaccctgaagtttatattcttatcgctaccaggcttcggaataatctccgcatattgtaacttacatactccggtaaaaacaagaacccagttcggagtacatacggtatggtctagagctatgatatcaattgggcttcctagggtcttatcgtgtgagcagcaccatagtatttaccagtagcgaatagacgctagacactacgagccatatttcagcctccggtaccataatcatcgctatccccaccgggcgtcaaaggtatttagctgactcgccacactccacggaagcgaatttgaaatgatctgctgcagcgctctgagccctaggattcatctttcctttgcaccgtaggtggcctgacttggcatcgtattagcaaactcatcagtagacatcgtactacacgacacgtactacgtggtagctcacttccactatgtcctatcagtaggagctgtattggccatcataggaggcttcattcactgatttcccctaattctcaggctacaccctagaccaaagctacgccgaagaatccatgttcactatcatattcatcggcgtaaatctaacggtcttcccaacaagc

SEQ ID NO: 485553 - DNA, 331 bp, Homo sapiens
  misc_feature (62)..(62): n is a, c, g, or t
  misc_feature (130)..(130): n is a, c, g, or t
gatctcgccatcaggcactgtagttgaatcttatcactgtgtcatagcagaaattccttcangatcttttaaaattaaaacaacaacaatgacaacaataggcccatgtctagactgtatggcacctatngagaatcagaggaaaggtaccaacctgatgggacgaagatggtccaccattctagattacctttgtttgttaaaagaaaaatcttgacttggatatttttgggcaaagcagttttaatacaacacttagttgaaaaatctcaattagcttattgcagaatagtagcaaaggcaatttaatttacataacttaattttgtcc

SEQ ID NO: 485554 - DNA, 196 bp, Homo sapiens
cctactcgacgaaacacaaatgtctaccgcctgcgacacgtccccatcagtgtcctgagctcgccctgtcacaactgcgcttcaacagttgggcgagtgttcgcggtgagcagtgcccccacctgctcctcagttccagcctgaccccctcccatcctttggcctctgaccctttttccacagtggtgccctaccc

SEQ ID NO: 485555 - DNA, 344 bp, Homo sapiens
  misc_feature (97)..(97): n is a, c, g, or t
  misc_feature (286)..(286): n is a, c, g, or t
  misc_feature (329)..(329): n is a, c, g, or t
ggaggaacccttggcaggcagaacctggaggtgtcagaggctcaactcctccatttaaccagcaggcttccagagtccccggaaaaaccttgcccancttaaacaaagtgcttctagatggagagtggtccctggggaaaaggacctggccatccccttccaatacctgctgcctgtctccctgacccatgatttggcaagttaggcccagtcaaacatggacagttgatccatgaggaaaaaatgctctcccccctaaggccaggaattttaaagcagggctggnttagctcccagggcaaggggttccctaatgcttatcaataaanaatattgagcctgga

SEQ ID NO: 485556 - DNA, 204 bp, Homo sapiens
  misc_feature (40)..(40): n is a, c, g, or t
  misc_feature (43)..(43): n is a, c, g, or t
acgccgacgtcatcgtccacggctaccgcgccggggctgnganaaaactggggtatggcgctgaacagctcgagccctgtcgcctgggttgatcgacgtgtgcctgaacgcctatggtggacaggtccatggcgtggaagacgtggtttcgacagtttggtgcaaatgagttgtggcctggcagaatcaggtatggcctgggaa

SEQ ID NO: 485557 - DNA, 410 bp, Homo sapiens
gcactattgatcagggtcagctaatcgacaatgccgatttatagctggcgcttgatcctacaactgacaggccagagcgacctgggccctggctcactggctgaggaatcacacggagacactgccacagagacagatacatgctaccatgatcagtataactcaaccattagcatgatcatctaccacctggctgacttgacttcagaatatagcgtaagctgtctaactagaacataaggaccactaacatattctgcagaaggagcatcggtacagccttttattgctatccatggggaccaaggctgacagttaggaagaaacactgagaggcccgaaccgctagcttacggccataccattggctcttcatcggcttccacagcctcctacgtacccttagccgg

SEQ ID NO: 485558 - DNA, 169 bp, Homo sapiens
tcatcgagctcggtaccatggtactcccatcatcgccaaggtctgtgagcatctcagagcgagctccagaagttcaagatcaagatcatgggcgagtttggtcagcagacggggtccatgacctaccagtttccctcacggcattatgaggcttgttgcatgagattaa

SEQ ID NO: 485559 - DNA, 153 bp, Homo sapiens
catggtaactaggcctcatagggttgtcatgaaactaattgatatattaaagcgagtttataacagtgctggcacaggggactaaatacatgataactgctatgctactgctactactactagtactactattactactactacaactgctag

SEQ ID NO: 485560 - DNA, 525 bp, Homo sapiens
  misc_feature (200)..(200): n is a, c, g, or t
ttttcacttctgctcctgccccctcccagaagctgagatgtggtagagactcagcattggccatgcagccacattaacatggcctatgggatggcaggacaagatggaagggaactgggatcttgaatgtttctgaacatgaaccacaccatgccctatcactgatctagtccacaccatcgcttccaatactaatgtantaatatccacaccatgccctatcactgatctagtccacaccatcgcttccaatactaatgtaataatatccacaccatgccctatcactgatctaatccacaccatcgcttccaatactaatgtaataatatccacaccatgccctatcactgatctaatccacaccatcgcttccaatactaatgtagtaatatccacaccatgccctatcactgatctagtccacaccatcgcttccaatactaatgtaataatatccacaccatgccctatcactgatctaatccacaccatcgcttccaatactaatgtagtaatatccac

SEQ ID NO: 485561 - DNA, 448 bp, Homo sapiens
tagttgtaggagtggatacatctttaatggtatattttggtttattgtcttatttttgatgtagtattctatcaataatttattaaacctggcatccttgggtgagcatggatttttcaactttggtgttatattgtgtttgcttttaaaaactgcttttgaggccaggtatggtggctcttgccatacccagcactctgggaggccaaggtgggcggattacctcaggtcaggagttcgagaccagcctggtcaacatggcaaaaccatgtctctgctgggagcacaaaattagccaggcatggtggtgcatgcttgtggtcctggccacttgagaggctggggcaggagaatcacctgaacctgggaggcaaaagttgctaggttgctgtgagcgaattctcaccattgccctccagcctgggtgaaaagagcaaactctgtctca

SEQ ID NO: 485562 - DNA, 448 bp, Homo sapiens
  misc_feature (237)..(237): n is a, c, g, or t
actctagaggaccgtctcctggtatcccaccctctcgttgcccagtttctttctttcattttttttctcgagacacagtttcactgtcacccaggctggagtgcagtagtgtgatctcggctcactgctaactacctccacctcctgggtcaagcgattctcacacctcagcctcccgagtggctgggattacaggcacgtgccaccaaactctgggccaattttatacgctttagntaggaaacagggtttcacccatgtttggtcaaagctgggtcccaaactcctgtacctcaagtgatctgctccccttcagcctcccaaagtgctgggattaccggtatgaaccaccacaacctgccaggaatttttagtttttagcttttgcaggagacttcaaggaaaggagacattcctctgtccaggaaacgggtggggataccagggg

SEQ ID NO: 485563 - DNA, 256 bp, Homo sapiens
ggcactttgaagacaacctcgtaggacatcttacatggaagcaataacaaacattactgaaagcaaaacattataacagtaattataagtatcaccacatacttatcaatttcttgatgctatccaaatgacatctacagatataggtaaaagtaggacatctttttctgtttacataaatatatccacttaaaatgtgataatgtggagacaaagcaagatttgattacataaacttttctctgcattggtcttt

SEQ ID NO: 485564 - DNA, 489 bp, Homo sapiens
  misc_feature (200)..(200): n is a, c, g, or t
ttttcacttctgctcctgccccctcccagaagctgagatgtggtagagactcagcattggccatgcagccacattaacatggcctatgggatggcaggacaagatggaagggaactgggatcttgaatgtttctgaacatgaaccacaccatgccctatcactgatctagtccacaccatcgcttccaatactaatgtantaatatccacaccatgccctatcactgatctagtccacaccatcgcttccaatactaatgtaataatatccacaccatgccctatcactgatctaatccacaccatcgcttccaatactaatgtaataatatccacaccatgccctatcactgatcgtccgttcgcatgttaacatgcgaacggactgatcagggaccatttgcagtagtgaactcccaggtgcctttgaggcagcagggttccacctgaatgagcatctctataacatgatcagtccgttcgcatgtt

SEQ ID NO: 485565 - DNA, 360 bp, Homo sapiens
tttataccagagggtctgaggtcctgtcttcacaagtgtattcataaattcttctgcaacacactgtcttaattgaggtggactcttccatggggaaatacttttctgcaaaggcatcaagcttgccacatatctttcctaaaaccaagaaaaaagttaataaaaggagtgtcttcaaaaatatttaaacagacctacttaaaaggaatgggtcttttaagtttttaatcatatgccctttcaatgtttcagcaacaactccatcactccccacaagagatatagctaaatttagactgacttgggaagtcagatttcaaataaaaattcaactaaatcttagatgcgattagggttagt

SEQ ID NO: 485566 - DNA, 770 bp, Homo sapiens
  misc_feature (56)..(56): n is a, c, g, or t
  misc_feature (331)..(331): n is a, c, g, or t
gtcacttgctcctcacaaattctgctacagctacactatgtgtacacatatggcancatactcctcaacctcttccatgctgattagtccactgaatttatcttgacaatttttcctcctaattacatgtacagctacctcattatctacagtatctgcaatacacatttcacatgtttatgtacactgacttccaaaaggttacacttacagtatgttagtttctaaaaaggagataccatgttagcaattctccacacagaatacaaactgagaatggagagctggcactaattactcatctatccacagatatcgtgagacatctcantgtgggaagctgtataatggaactatatacaattctacctgtaatgtgcaaattaacaaaggacatttccatttgttaatttttcacactttcaaatgttacccccccttttaacaaatttaaaacctttccctttatcacccccaaatttctccaaaaacttttaaagattcccaaaggaaaaggggggccaaaactttttaaaatttaaaaacccccaatttaatattgtattttgtcacccccaataggggtccactctcttcaaaaagggccctaagggggcccaatatcccaaacccctttaaaaacctctttaataaccctttttgaaaaaatgtcggacaaattttttcaccatattttttttcaccccctcaagtggtggctttttacaactattaggacagggggggccccccctctcccgctttttttt

SEQ ID NO: 485567 - DNA, 198 bp, Homo sapiens
gtcaacgagtagttcatcctctcccacaccagctggttagcacacggtagatatggacaggacgtaggaattactgcaaggggagtctagttggtctacctataaagttcagataagaatacgtgtccagtttgcattctcttatcactgtgtacacacgcttcccaaagcttttctttaattctgactctgcttccg

SEQ ID NO: 485568 - DNA, 111 bp, Homo sapiens
  misc_feature (103)..(103): n is a, c, g, or t
ggattacttattacagggaattcgacaaccgcacaagttggcagtaggtttccccaccctaattaatctgggaaaaattccctggtttcctagggttgttggntaaaagag

SEQ ID NO: 485569 - DNA, 110 bp, Homo sapiens
cagttaatctgaactcctctttggggcctcttaatacttctatccaagagcaatacaatgaaggtgaaaaccccctccaatccggaactcccataaagtttaacaaagca

SEQ ID NO: 485570 - DNA, 174 bp, Homo sapiens
ggagctgcaaaccgtgactcagacaagccctctctgagcagcttggtttttgggtgggaaccagccatcatccggtgtcctcccctcccttgagtgctggacagcccaggctttaataagtgctggtgttgctggtcaggctaggtcgctaggagggctgaatgcaagccaaac

SEQ ID NO: 485571 - DNA, 366 bp, Homo sapiens
gccaccaacacccctccccccccttttttggttatctccctggcccggcgtcccaccactgactcagagagagggggtggaaggaggaggagaaagaactcgcgggggctctggcgcctgggcagaaggaggcaggaggagagcggggaggcgagagcgcacggcggtggagagcccctcgatcaattttcatgcaagaatcattatcggtaaattggaaagctggctgcctgacagcagatttgtctcccctaatgaaagcgaaagggtaggggcgcagcggcgggcggctgaaggcggcggcggcggcggctccttccgtctctacgcggcatcttccaacagctccatgcttcgcagggcgat

SEQ ID NO: 485572 - DNA, 212 bp, Homo sapiens
gattgctggaatgctgacaaatgactccttcgaatataagcacattcctcgattcaagcaaatgcatggtaacatgagggaaatgagtttcctgagcagagaggtgtgggtgggggatttgatgtcccgcttcgatcagtcgggtttgtgagttgaccacaagcctaggtctcttagagtcattacctggaggtggccatgacaacttcaaa

SEQ ID NO: 485573 - DNA, 81 bp, Homo sapiens
tgccactgagcattaggtcgcaagggcttggcggtacttgtagtctcacgtgttacccatgcttcgtcctccccaccccta

SEQ ID NO: 485574 - DNA, 307 bp, Homo sapiens
ggtcgactgagaatgaagtgttaaaactgctgcttatggctgggtgtggtggctcaggcctgtaattctagcactttggaggctgaggcaggagaattacttgagccaggagtttgagaccaccctggggaacataatacagacccatctctacaaataataataaaaactagctgggtgtggtggtgcgcatctgtggtccagtccaggctcttcaggaagctgaggtgggaggatcacttgagcctgcactgagctttgatggcaccactgcattcctgcctgggtaacactgagaccctgtctc

SEQ ID NO: 485575 - DNA, 922 bp, Homo sapiens
  misc_feature (9)..(9): n is a, c, g, or t
  misc_feature (113)..(113): n is a, c, g, or t
  misc_feature (117)..(117): n is a, c, g, or t
  misc_feature (120)..(120): n is a, c, g, or t
  misc_feature (128)..(129): n is a, c, g, or t
  misc_feature (134)..(134): n is a, c, g, or t
  misc_feature (283)..(283): n is a, c, g, or t
  misc_feature (288)..(288): n is a, c, g, or t
  misc_feature (368)..(368): n is a, c, g, or t
  misc_feature (395)..(395): n is a, c, g, or t
  misc_feature (398)..(398): n is a, c, g, or t
  misc_feature (402)..(402): n is a, c, g, or t
  misc_feature (483)..(483): n is a, c, g, or t
  misc_feature (485)..(485): n is a, c, g, or t
  misc_feature (501)..(501): n is a, c, g, or t
  misc_feature (503)..(503): n is a, c, g, or t
  misc_feature (506)..(506): n is a, c, g, or t
  misc_feature (527)..(527): n is a, c, g, or t
  misc_feature (529)..(529): n is a, c, g, or t
  misc_feature (540)..(540): n is a, c, g, or t
  misc_feature (564)..(565): n is a, c, g, or t
  misc_feature (568)..(568): n is a, c, g, or t
  misc_feature (573)..(573): n is a, c, g, or t
  misc_feature (576)..(576): n is a, c, g, or t
  misc_feature (580)..(580): n is a, c, g, or t
  misc_feature (594)..(594): n is a, c, g, or t
  misc_feature (598)..(598): n is a, c, g, or t
  misc_feature (605)..(605): n is a, c, g, or t
  misc_feature (638)..(638): n is a, c, g, or t
  misc_feature (680)..(680): n is a, c, g, or t
  misc_feature (690)..(690): n is a, c, g, or t
  misc_feature (700)..(700): n is a, c, g, or t
  misc_feature (742)..(742): n is a, c, g, or t
  misc_feature (744)..(744): n is a, c, g, or t
  misc_feature (749)..(749): n is a, c, g, or t
  misc_feature (772)..(772): n is a, c, g, or t
  misc_feature (825)..(825): n is a, c, g, or t
  misc_feature (828)..(828): n is a, c, g, or t
  misc_feature (832)..(832): n is a, c, g, or t
  misc_feature (841)..(841): n is a, c, g, or t
  misc_feature (847)..(847): n is a, c, g, or t
  misc_feature (859)..(859): n is a, c, g, or t
  misc_feature (912)..(912): n is a, c, g, or t
cccatcccnccctttttatatatctaaatcccatttccctagattgtatattgcttttatatcaattattttatttttatgaatcgttcatggataactttctaactttaaantaantantgtttganntcaantaatttcttgacttacatgactttacaacaatctttaataattccccattacaaaagataaggatttaacttacactatcgccactttcctttgtccatctctctccaaatgtctgatagttacatcactttttaatacatctattggnttgantttatagctttgaacaatacactaatcctctagttcttgttccaattaactgaagatcttttcatccccactttgaatanataagtatctctacctttgactccacntcncaanctctaatatcacaatctcattctgccttccatccctattgtcagcattaattactttcaacttcagttctgaataaaaaangnaacctttcacaataantnaanaggctgatatgaacattgaanantaataaatganatccacattattttgggtatttanntanatctnagngggngcgtagtataagcnaggntattttnttccctacacacccaatatcatcatgcaagaanaaaagaaaaggaaatgtaccaatcaagcctcatcttattctncatgaaaaantcaaaatcangcctcaatttattttgctctataattggacctgaattttttnanataangttgatttgtctttcttttttcntgactaaataatcttctcaagcatcccagctcttcaatgatactatctatggnacngaangcacattcntcccanaaagcccgaganagtatgctctcatctgaaattggtctgctggatagctgtcactctagggtganataccctttt

SEQ ID NO: 485576 - DNA, 389 bp, Homo sapiens
aggtctatggtttagtaactgtcattaattttggaaaattattggctgtttttacttcaaatattccttctgcttcttccttttttccactgcagtaatcctattatgtatacgtaacaccttttgtaattatctcatagttcttagatattatggtccattatgaaaatttattttttactttccatgttttatacgcaaatttctctttgcatattgttacactgaaaaaatatgtctattgacatatcttcaagctcactgttacattctctagtggggttcaggctactgaaaagcccacatttgttctttatttctattacagtgttgtgtttttcttttttttccatttctatcactttttaattctttctttgagtttctag

SEQ ID NO: 485577 - DNA, 88 bp, Homo sapiens
atgatgatggattagctggtgcagtacaactaggcttaatagggacatgccagcctgggcaacagagcgagactccatcacaaaaaaa

SEQ ID NO: 485578 - DNA, 432 bp, Homo sapiens
ctttcccactctctctctgcaggtccggctcctctaagggcagaagccagaacttggtccctaaccttctccagtctccctccctgggcatttctctcataaccccatcagaccccccagtaatggcctgacgtgggttctggaaatagaacatgggttcttagaatggctctctgagacttcattgagttgtctgtcctatttctttcctcaacaaaatgtccacatcctcaatctcctgtctcagcaggaaagatgaaaagaacagtgaggcttaggccaggcacggtggctcgcacctgtgatcccagcactttgggaggctgaggtgggcagatcgcctgggaacgggagttcgagaccagtctgaactccctgtctctactaaaaatacaaaagtggccgggcgtggtggcgggcacctgtaaatcc

SEQ ID NO: 485579 - DNA, 1370 bp, Homo sapiens
  misc_feature (327)..(327): n is a, c, g, or t
agcggagtgaccttcgcgcgtggagcgtgcggcgctggggggtccgtgccccaacttcctcgtacgctccggcacgtcccacagtctcctgaccggatccctcctttgcgatatgtcctacgatgtgctccgaattcttgacgacacgaagggggaacgactggtggaggcctgcacccaaccatgacccccggcagagagatgcacggttcgttctggaccgactggtccagactgacctgttctcatggacgtctccaagcttgatgtgctctaatgccattccgcggctgcatggagcgtggctgaggaccgactagcatgctnccgagtgatcctgtacatccggtgcagtgataggggccaatgctagaatttccatgtttcccagaaagcaactccccatagcccgcggcccttgggggaactgtcgtttcctagggatccaaagctccgccaagggtaaccgtccaccgaggaagttgcgcttggccctggaactccgtttacccaagcgtaggcgcatgttcgtgcatgcgccttcgcacagcaccgtatagttcggaaattttgccccattctggtgattgcgtatacgcactatcatggcgtatccgctttcctaagtttgactgtgaagccattctcgcccctaccagggggttttgcctgtggagcacacaaaacttggagatgaggttcccccctagacaggtatgacgaccccttagaaggcaacgggcatccactttccagttgcgccgggataaagaagctcaatgtcgcgccccttaagaccgttggtgcttccaaaagcatgggaggccccccaatctcattcgggggacctctaaggctgtgaagcgatgagcctaagggggcggaattactcccagcaccgaggaaacgttgccttgttccccaacttcctaacaactggcaccgccgggtaattttacgaattccaaagggccttgggattggcgcaacaaatccattttggcaccggctgtggagaagttgaacatacagcaggacacgtgggaacggcggggcaagagagacaaacaagccacacccttagggccaaacaccctttgggagacacaattggaccgcagaccagcaaaggggaggctagacactatagagagagcggacaaaggacaatccccccatatggcggctagacaagggacgtatagggcgaactaggacgaggaaataaacacaagtaggcaccccaaacccagaccgattcacagggaaaatcatcgggacactatgcgattcgacgacgaccaggacagcataagagcagagatggaggacacaggaaaaggaagacccccgcgggcatactcagcaaa

SEQ ID NO: 485580 - DNA, 405 bp, Homo sapiens
acgttgacacttcagcctcctgagtggctgggaatacgggcatgtgccaccacgcccggctgatttttgtatttctagtagagacggggttgcccaggctagtcttgaactcctgagctcaggtgatctgcccgcctcaacctcctgaagtgcgggggttacaggcatgagccaccacgcctggcctataatgatatcttaaaagattgctttcttttttttttttttttttttttttaagagggggtttccctccaccctggggacaaaaaaaatttttttttaaaaaaaaaaaaaaaaaaagggggcccccccccttttttttaaaatcgggttgaaaaaaacggttttggggtttttttttcggtttaaaattgggggaaaaaaaaggggtgtggagggggg

SEQ ID NO: 485581 - DNA, 525 bp, Homo sapiens
caatgagtagcagcttggacccagaaacagtataccatacctcaccaatacgtcataacttaacatgcggttacttcggtttcctcatcaaatcgtgaccaatccaatgctctctagtgtctgatatgccccgtcccctttaagttgcttcacatttgatgcggttgtgctcaactactctgagcgatgacgaagcaaaacgccattggctgtttttttttttttttttataggggaggagctactttgttcctcactttacatgacctgtaatgcttagaattatgaacttgaagaactataaatgtcagggtattaaaatgataaactgatatcagacatgttcatagctgtttggttgggctgggagttcttgggatatatcgttatgattcaccaacgcgatgtgggattatccaatatctttcatattgataaaaaactcaaaaagtggtacgaagcggttggctttttatgtacatttgacagtggaaatggaaataaatttaaactaccaaaaaaaaa

SEQ ID NO: 485582 - DNA, 431 bp, Homo sapiens
cagttataacgaggatatatggataacgaagggaagaatgtaaagagggatagaatgataaacaagggagaacgatagaatgatagcagatatgacaggcagacagtagatatgatatagaggtccatatatatctgtacatagttgtatatctaaatgtatatctatccaactatctagctataataaaggagaaaaagaaaaggagaaaaatgcagagtgagaaagggaaactgcacagccatccctttcaccatgccagaacaccaccaggctaagcatgtatgtggagggagctgaagcccctcctgcagggatgagcacgctgcagatgaagatgtgagcaggaccagctcatcaatcacaatcacgcagggacacactagcacggcaagaggattagcactccagcctgctcaggtcttttctct

SEQ ID NO: 485583 - DNA, 804 bp, Homo sapiens
ggggaaatcggctgtgggagagagggtacgcgtctgaggagggaatgcggagggtatcagacccatcagaaccgccactatgtacggtgggtaacagcagcaagatgctgcatgatatcgattacacggatgaggtgcatcctgcaagacgggcggatcttcattgggaccttcaaggcttgtgcaaaggcacatgaattcgatctctctgtgaagcagtgatgagttcagaaagatcaagaccaaagtaactccaaacaagacagaatagggaagagaagacgacgctcctcggtctggatgctgccctgccgaggggcgaatctggtctcaatgacagtagagggacctcctcccaaagatactggctatatgcctcggaattcacactatgctggagactgccggaggagcaccagaggcatcgagcacgggacatagaatggagaggaatcccagaatgggagtatcccaatgccccaggcatcctgaccaggacttgcgtgggccagaacacgagcgagagtcggcagggcaacatcccaagaggtgcaagacccccacaaggaaagagagaactagaaagccaaggcagcatgccaaacatgctggccacacagaccaagaattagccggcggactcccaaccccagaaaccaaccctgagacagatggggagtcctcacgcccaacacaatgaggcgaagagaggcaccccctccaggcatgagggggcccacacacctggaatgaaactcctatgggacccccaaaggggctccccacagggaaaaagaatcaaag

SEQ ID NO: 485584 - DNA, 329 bp, Homo sapiens
tggggctgacttagaggatcccacacgtaacgcttcatcaaaaccacagatctgactcagcagtagtctgtctggggctgcccacgtggcgaaacagtaattacttgatctgggaacatgcagagacagactgatggacagtcagtgcctcagttctcattcctaatagtgtaaagagatagaggtctcttccttgagagtgtaggggatccagagccctagtgaccctaacagccaaaggtgggttccctcttagaagtccagactcttctagttgcaagtcacagaagcccaaatcaaactagcttgagcaaaagggggatttagta

SEQ ID NO: 485585 - DNA, 312 bp, Homo sapiens
cgctgacggtggttgctgatcgaggctattacaaaggcccgttcgatggccacaagcggccgaggctccggcacagttgggtacaacgtacaaacagcagtcgacgacaaacgccatctgatcattgcccatgaggtgaccaacgttcgtaatgatcgcgggcaactgagcaatatggctaaccaggcacgtgaagaaatcggtgctgaggcgctgacggtggttgctgatcgaggctattacaaaggcccggaaatccttgcttgcgagcaagctggcatcaccacctttgtaccgaaaccactgacatcg

SEQ ID NO: 485586 - DNA, 717 bp, Homo sapiens
  misc_feature (643)..(643): n is a, c, g, or t
atcccctccattgaaattcctcccccttaatcaatagttggcccccccccccccctgttagcccttcttgtaagccaccgggcgccctcttaattacttcaatatcttgtgaaatatctactttgtgtagatgttacaccggacaattttttctctattaacgcctccccaaagagtctataattactttctctccccgcgagtatacccgccccttaactctcccctcctcacacggaaatatgtatatagttatagtatttgagagcgcccacaaatatagggagagtctgtcggaatttgatattgtgttaaaaaaaacaggggttggcacagagaagggagggagcctctacctaggtggatttcacactgcctcacgaggattccccctcgcccttctccccccccgtcgacacatgtgtcggggatttagatgtagatcgctctctctcttgtacttctaaccttttgtatatctcacctcacgaggcgcataaccctggttctaaggagaattttatcaaccaaaattgatcatggggcatccagcagttttatgaagaatattttattcgcaataccccgcgcgggttcctactctttccgaaactattaatatcattattttctcatcttcganataatttctcacttttgcaggacacaatccgccacaatgaacacaccattcttctacacgaccccatcatatcc

SEQ ID NO: 485587 - DNA, 133 bp, Homo sapiens
aggcagagaggggctgaggactgtgggacgagagctagcagacgcacttagttgtttatagctcttcctgttgtaggcggcggttccaccatcaagtacaccaccacctcctcctccagcaggaagagctata

SEQ ID NO: 485588 - DNA, 209 bp, Homo sapiens
tttaaatgaggtggttgtttacttgttataggcatctttaacgttctggattttgggtatgccatttaaaaatacttccagatacacatggagattagtaatactgcagccgtatccttgcagaacacacctgtcagtgtcaggggtttcgaggtttttcgttaaaaaaagaaaaccaaaaagcaaacaaagataggttcctcaggttg

SEQ ID NO: 485589 - DNA, 359 bp, Homo sapiens
aatggcgtgaacctgggaggcggagcttgcattgagccaagatcgcaccactgcactccaacctgggtgacagagcgagactccgtctcaaaaaaaaaataaaaatacaaaataaaaataagagatggattcttatttatctggtcagcatagctcctgtttctgatgtaagatgctatttgttgcaactttgttcttccatcagattatcagaccatgcaagaaattgcttagcaactcacccctatcaaagacagagttacagggaattctacttgggctttgggtagctttgtcttcatgtttatcttctttggctttttaaggcgactgtattaatccatgctcacactgctata

SEQ ID NO: 485590 - DNA, 750 bp, Homo sapiens
cacggtggcttacacctggagcgcgcgggttgggaggccaaggccggtggatcacctgaggtcaggagtttgagacatctggccaacatggtaaaaccctgtctctactaaaatacaaaaaatcagccgggcatggtggcagctggctgtaatcccagctactggggaggttgaggcaggagaatcgcttgaaagcaggaggcacaggatgcagtgagccaagatggcaccatggtacgacagcccaggtgacagtatgagacttcatctcaaaaaatatgtatatgataataaaataaaataaaaataaaacaaaaattagccggtacacaataattatgcatcttatgggatacagagtgatatgtacatacatgtatgcaatgtgtaatgatcaaatcagggtaattggcatattcatcaccttgaacatttatcatttcttgggggttgtgaacacccttcatcctacagtgctacagaacactagaatattttcctccccgctagctataacttggaactgtgaaccaggctctccctaccttctggggcgggatatttaactaacgaaatggctcaagggcatccatggtggcatgatgggcagggttcattctttttaagggtaatatattccaggggggtaaataccaattgcttacacacaaataatttgggtgggtttggggttttgggaggggggctaatctccacccggggggggggaggggacaacttactccttta

SEQ ID NO: 485591 - DNA, 398 bp, Homo sapiens
  misc_feature (64)..(64): n is a, c, g, or t
  misc_feature (242)..(242): n is a, c, g, or t
agcttcatcaacccacaaggagagagatgtgcaggatatgcagtgataaccctgggacactgtngttaagctgagctcattgctttaattcaggccttagaactcagtgaagatccatcacagtcagctaacactggcagctcaggacaagtagaccagccagcaggacacagatcttcctacccggctgattcggagacgagaccaagctgttgctgaggacgacagccctgctctggtcnactccggaggctgaccagtctacacacggctgaagcttgaagaaacaacaagcccggctctagtcacgcactggcagctgaatagtctacgcatggccgaagcttgaggacttgtcaagcaagtaaacgtagttaaaaatcttaaaaaaaaaaaat

SEQ ID NO: 485592 - DNA, 1000 bp, Homo sapiens
cttatgccaataccatttacccgaagataaagtatagagcgatagcaagattgacacctggcgcaatagatatactaccggcgaaggcgaaaggatgaaaggattactaaccaagcagtaactatagtcaatggactaaccccttactgaccttctgccatatatggaagttaactagaaataattttgcaacggagagccatacaggctacaggagcccccgaatagccaggacgagctacgcttaatgaacatgctagaaagagcgcagccgtctatgtagcaaaatagtgggaagattctatggggtagatggcgacgagaccatacctgaagaccctgggtgagtaagcatgggtatgtccgaaagataagaatccttacgattcagacatttagaatttgccctacgagaacccatctataaatcgcccattgttaatactttagactggttaggtccaataggtaggaacgagcgtctgtgtgggacacttaggtagaaatacaccttgttagggagaagagtagacaaaattctagaacagcccgatacgtcaggccctaaatagactagggcatccaagtgtaacgaagagcggttcaatgcatcaacgaggcctacttatcctagaacaaatccgcagaacatagtaacctgaactccgtcagacccaagtaggaccaatctatcaccctatagaagaactaatgttagtataagtaagcatgagaaacattctcctccgtcataggcctgcgtcagattaaaacactgaacgtgacaattaacagcccagtatctaccaatcaagccagcaagtccattattgacccgtcactggtcaagccgaatacaagcgtgggtccataaggacaggtcaaacaccgtgacagggacgcggggaatctaaaaagaaaagaaaggggagacacccaaaaatacccgaagggcccaataagcgaaccagtcgtcaccacggcccaaggggcgcataac

SEQ ID NO: 485593 - DNA, 376 bp, Homo sapiens
tcacccaggctagtctcgaactcctgacctcaggtgatccacccggctacatcttccaaagtgctgggatgacaggtatcagccagcgagcctggcctaatcattggaacattggcatcatgaaaatgtcatcagctttgccaaaagacacaaccacttgactcgattggcgtttgtttaccatattcatgtcaattttatgtatacagttcgaatacccagggagaccactaacatcagttaaccaagtggggtatatacaaccaaagatgaaacccgaaagtacataaaaaggatttaaatccgattttagatgaacctagtgtgtatatctcatctctagactagttcatgtttatccgttaatttatgccca

SEQ ID NO: 485594 - DNA, 163 bp, Homo sapiens
taccagcaaaactgccaggccgggttttttttcaacaccagctgtgattgctgcaactgggcataaacctgacctggtttatattccctaaagttccagttttttttgcttaggaaatgttgcccctacctaaagtcctgcaataaaatcagcagtcaaacca

SEQ ID NO: 485595 - DNA, 1633 bp, Homo sapiens
  misc_feature (90)..(90): n is a, c, g, or t
  misc_feature (245)..(245): n is a, c, g, or t
  misc_feature (259)..(259): n is a, c, g, or t
  misc_feature (282)..(282): n is a, c, g, or t
  misc_feature (342)..(342): n is a, c, g, or t
  misc_feature (380)..(380): n is a, c, g, or t
  misc_feature (444)..(444): n is a, c, g, or t
  misc_feature (513)..(513): n is a, c, g, or t
  misc_feature (535)..(535): n is a, c, g, or t
  misc_feature (631)..(631): n is a, c, g, or t
  misc_feature (644)..(644): n is a, c, g, or t
  misc_feature (660)..(660): n is a, c, g, or t
cactatgtaagattgataaccctgttacactcaattcgtacacatacacctgacacgcgcgatctctacaaaagtctcctgcaattgacntgacatacattcagagcgtcgggtgccttatggggctgccgtgctcgtgtaactccgccacacaatcaccaacctatgcgaacttattgcgctcaagaccacatagcaccgtcactcaactgaaaatctgcctctcagacaacagtcttctcttngactcgagacatcngcgctccaacatgcacttctgangagcgtttggaatagattagtgagtgctcttgagatttgctagtctctagaattgacccntatccagcccgcactatagctcgtgcacgctcatcgtnagaagtatcattatgaagtggatggctcgtcgtgtgcgcataactaacatttccagagacggangggcgcaatactcacatgagcttgtgattgcaagtttgcgtgctttgacgctctaatgagcaaacgcanttgcacagagaaatattctagngctagctctccactccaagtccatatgctatctcgctagaggcggtagtaacgcccacaacacgttctgttgtcgaaatatcgagcttgtcaatgnctaccataacccnacgattggaagggggnccccaaactagtaagtaccaattgttccatagaaggggaggggccacaagctaggcattgagactgtaaactataccatcgtgttgagcctaagttctcgggcaacaagtcctctcaacttattgcaatatgaggggaacgaggaaacctcttaagctttgcgatagtgggacccgtacttcgaaagtgtaggagcatatcgtgccatgtgtaacgaatcccaagtacgctcagctccccttgcaaacacccgtaggtttcgtttgtaacctctatattcaaccgtcacaatgcttctgacgcacgtctcccaatcttatttgccggagcacgcgtaacttatagccaccatacctcaacccataacccttgaattatgctgttgcccatttcgaacacactcggtggcgtattaccacaccacagaaaccccacagcttacgcggagagtcccaagccctttctcggaaatgtacgccagattagaaaatatctcaaggcggtttgcacgaaaaacggcatttgacttcacaccaagcataattgccaaagacgtcaaaggccccctgttcggtggcgtttgaaacggtaatccttctatttcccgtttaatcatttcttgcggcatctataaacgttgggaccagtgttaaaaaccgaacacgtaaaattgtgggtttacacccgaggggatcaccgtttcacggtaaaagtggcgggaaaacgcacacgcaacacaggagatttaataagcgccgtaaaggagacgaaacaccaccatttataaggagaacggccctggtttccccctggacgaaattcatagaacgccgaaaagtgaaatgatcatttttacacctagattgttgtgccattaagtacaccagaagtatcaccggaaaaaccggacatcggcgtacaacaggagacaccacaaaggagcgcgcaccatgattgccccataatgagatgt

SEQ ID NO: 485596 - DNA, 532 bp, Homo sapiens
  misc_feature (532)..(532): n is a, c, g, or t
tgtggtgtggccttagccaggacatttctgatggcagacctacaaaatcagttcagcagatttggagaagtttctgtgatgtgtgagatcatcacactggaaagatgaccaatggaaacccacatgaaagtttattgcatactatcaagcatcatgtgtatgcagaagctggaccttgaaaaaattgtatgtcttgttttaaagtaaaacaagaatggaaatgtgtggaaccattacagaattcaacctatgcaaaatgaaatgctttcttgcacatgattgtgcccaatgatgatgatgaatgcatgcaagaatgctaatgaaatgaatgacatcagacaaacatgtgtaaactgctcaagcgttgattatgaaacacatgaacatgtgatgtgatgttgtggagtttctcaataatcgacaattgcattgttgctcatgtgtgaacaaggagatgttggctcatgtggacagttaatgcaaatttgtgagtattgtaggatgcaaagagttattgtgacatgaatgtacn

SEQ ID NO: 485597 - DNA, 224 bp, Homo sapiens
cctttgtcaacagagagaaaacaaatagaaaaaaaaactgaacaatgagacaacagcaaaagctctaacattcatgtcactggattcccagaaggagaggaaaaagagtgcagtgcccaaaaaaacatctgaagaggccgggcgcggtggctcatgcctgtaatcccagcactttgggaagctgaggcaggaggatcacttgaggtcaggagctcaagaccagc

SEQ ID NO: 485598 - DNA, 209 bp, Homo sapiens
tattatgcacacgacatccttcatgggacgagacaggtcgtgattgcaaaataagtgacaatccaagcagtttactctaactatatggctcacgtctgcaagtgtcagacatgcagctgtagagcagtcacgaagtcaagccatgaatacagggtatggaaaaacattccagtgagctggtcttctacaatcctgcaacatgttggggt

SEQ ID NO: 485599 - DNA, 341 bp, Homo sapiens
ttcgccaagtgtgttgtgtgctgaatgattggggaacacaccccctacagcctcgcacatcatggaaactagcaatgtacttggccagtaatgccatgtatcttgccagacagcaatggcatatgtgcccatcgatggagccatgagatcctccctgatggggaacatgacttgacgcgctgccagtatgtgaacgctaaggtgcttggcttgcttgtctacacggctctgagtgaccaccacatctaccttggaagtgcaccttgcctgacgaccaacatggtaaccccaggacatgctctgcctcaagaagttccctcattacggacattgccatgaag

SEQ ID NO: 485600 - DNA, 585 bp, Homo sapiens
  misc_feature (4)..(4): n is a, c, g, or t
  misc_feature (21)..(21): n is a, c, g, or t
  misc_feature (48)..(48): n is a, c, g, or t
  misc_feature (55)..(55): n is a, c, g, or t
  misc_feature (127)..(127): n is a, c, g, or t
  misc_feature (135)..(135): n is a, c, g, or t
  misc_feature (173)..(173): n is a, c, g, or t
  misc_feature (186)..(186): n is a, c, g, or t
  misc_feature (200)..(200): n is a, c, g, or t
  misc_feature (234)..(234): n is a, c, g, or t
  misc_feature (378)..(378): n is a, c, g, or t
  misc_feature (398)..(398): n is a, c, g, or t
  misc_feature (556)..(556): n is a, c, g, or t
  misc_feature (577)..(577): n is a, c, g, or t
gganccccgagtgattgatgngatatttgcacctagtaagaggggaanctccgcngggtaagcccccgggcccaagggaatgtgaccgtctcctgcttcccctctttgccctgattaagtattgaancccccagngcctgccctgcctcggtcccaacctcctataaattatnaagaacccaatgntttatccccccgtnaaaagaagcttcagaaaaaacattcccaacactnccaaatcccggatgactttgtggccgatgtccgttgatcttcaagaactgtgaaaggtttaatgaaatgatgaaagttgttcaagtttatgcagacacacaagagattaatttgaaggctgattcagaagtagctcaggcaggnaagcagttgcattgtctttnagataaactcacagagatctactcagacaggcctcgcacctttgccagagtttgagcaggagaggatgatggtaggtactgaggctctgatgagctttatcagcccgcagaaaacgccttaagtagatgggagaccagtcatataagtaaatacatgntttaatcaattgtttaaaaanaaaaaacg

SEQ ID NO: 485601 - DNA, 332 bp, Homo sapiens
gggtgggtatgaagaataatgcacacaaatcctaagaccactagataccttgatatatcgagcagcggggatcaaattgggatgcacatcgagaggtcgtaccccttaaccatcgcggcatgagaagaaagaggtctggtcacttactgcaccagagttcgcgtagacctccttccacactccgaatcttcaagcaggatggaaagagaccacagaaactgaagcaagaggaggatgcgccaaggacacgatggctctgatacacaaaagccggaacataggacaaggagggaagagtaaaatgagggagacagacaggaagttgaactatg

SEQ ID NO: 485602 - DNA, 140 bp, Homo sapiens
ctgccttagcctcctgagtagctggaactacaggcagagttgttttttttttagggtggtaggtacgttttttttaacatatctcctacttttaactatgtgtccctcacgtttctccttgaaactctaaataccttcga

SEQ ID NO: 485603 - DNA, 398 bp, Homo sapiens
taatgtaatcgacataacttttcccttaagggtgaactgtgaaagcttcagtccattccttcatgatcttgcacttctgcgatgacttcctgatggggaacgacttctttttggagttcgagatctggactttgatcggctgcttcttgtctcgtgacttagaaccccctcgcgatcttgacctcgacggggattggaaatacctcgatccttttatagaaccagacctagatcttctgagtgaagctgatcttgatctacgaagagagatagatcttgatcgtcgaggagatgctgaccttgaccttcgtcccctgctcctgctgcgtgagcgagagtatcgccttcctctggatcgagaatgtgatctagaccgtgacctattgataatgtgatag

SEQ ID NO: 485604 - DNA, 130 bp, Homo sapiens
ggtggtacgttctgctcctagtaagattacacatcaatgcatcccccttccagttagtacaccctcttaatcactcacgatcatagggaacaagtcatctacagcagcgcatcactggtgctcataacgc

SEQ ID NO: 485605 - DNA, 519 bp, Homo sapiens
  misc_feature (219)..(219): n is a, c, g, or t
cggaccccccaaatgaatcatgtaccgtgtcgctacgccgaaggtgtgcagacattcgcccgtaggtacggctccacgggtgtgttgctgaccagatagcggcccttgaggcgtgcgccgatgcggccggtccaatactcctgggagtcgaaagagaccttggaaatgccatcgtgctgactgtccagatcgatcttctggccgatgacttgggcctgnggttccatctcccaatgctcggacagcctgaacgggtagccggcctcggcggataacgccaaggcgtggcccttggtatccatcttcacccctcggtcggacttgttgtcgccatccaggcgggtacccatggccaccaggtcgacgtaccagccggtcggatcggtgagtgtccagtaagcgccgaagttgtcgccgtcgagtttgacccgcccggagcgatggttctgccagcccattgcaaagcccttcacgtcgccgcgcaggcggctctggccgataaagaggattcatttgggg

SEQ ID NO: 485606 - DNA, 169 bp, Homo sapiens
tattttccacagggtaatacccaaggcactggcatgagtactattggctaaaaaataacaacattctcgtggggtaaaataaaaatacatttaacgataacaggtttcattaaacagaaatggtctcctatttggtaagtgggaaaatgtatacctggtatcaaggtac

SEQ ID NO: 485607 - DNA, 508 bp, Homo sapiens
  misc_feature (17)..(17): n is a, c, g, or t
acctcgtccgtttaganaaacttgttgttgttgttgttgttgtttaatggtaaagctcagtagactccagcaccaggactggcatggagtcaaagcagcagggacggctgggtgaccccagggagcctcacatggcgaagaggatgaggaaggcgaccatcaaacagaagagtcccatggcctcagacagggcaaaccccagaatggcataggagaagagctgctgcttgagagatgggttcctggcatagccaataatcaagctaccaaacactgtgccaatgccagctcctgatccagccacaccaactgtggcggccccagcaccaatgaacttggctgctgtgtcgatgtcccgggaaatgacactggtctggaattccgtcgggccacctggagaggggagctgctgcaggaaggctgcttagatggggcctctggtctgctcaggagggaggcagacacaggcctgattagacccctggtacaggagcgaatcagagctgga

SEQ ID NO: 485608 - DNA, 342 bp, Homo sapiens
aggtgacctagaggatcccacacgtacgcttcttaattggtggtgctttaggctactatgggtgttaatattttactctctctacaaggttttttcctagtgtccacagagctgttcctctttggctaacaggtaaattacaaggggatatagagggttctgtgggcgaatttaaagttgaactaagatactaattttgtataggcagctatcatcagagcacgggtacggtatgtcggctctacctatcaatctttctcacctcattatgttacatagacggggggggctctcttagctgtgctcaggtagctcgtctgtgtgtcgcggggggggaacccc

SEQ ID NO: 485609 - DNA, 358 bp, Homo sapiens
tcgtctggggctgccaacttgccatccaaatcggaggaaaacccggaaatcttaggggccacgtgacccacggccacggccgcttaggcaagcaccggaagcaccccgggcggccgcggtaagtgcgtgggtggctcgtgcattcaccaccggattcaatttcgacaaattaccacccaggctactttggggaaagttgtggtttgaagctttaccatttaaagaggacccagaagctttctgtgcccaaatgtgttcaacctttggacaaattgtggtggcctttgtggctcaggtgaacagacccgggtgtgaattgcgtgcttaaaaacaagacgtggggcttgcctcccattca

SEQ ID NO: 485610 - DNA, 87 bp, Homo sapiens
  misc_feature (29)..(29): n is a, c, g, or t
gcaaatgcagtgccccctgaagagtcatntcctttaaatctcccctgcaaggacagctgctttcatacgcccttctgtcgtcttctc

SEQ ID NO: 485611 - DNA, 100 bp, Homo sapiens
atagctgaatctagaggataccgcggcgtaatggtgatactgatacagaataccaccaggcgtaggtatcggtctagaacaccagcccggaggggcaggt

SEQ ID NO: 485612 - DNA, 250 bp, Homo sapiens
tagctcggaccataaatatgagagctggattacaagcatgcactacacacccagctgatttttgtatttttagtagagacggggtttctccatgttggtcaggttggtcttgaactcccgacctcaggtgatccaccagacctcgtgcctcctaaatgtgctgtggattacagcgtggtcctctctgcatctggccgttccaaatgtgctggtaagatagagagctacaggatgaggagccaaccacact

SEQ ID NO: 485613 - DNA, 290 bp, Homo sapiens
  misc_feature (66)..(66): n is a, c, g, or t
  misc_feature (69)..(69): n is a, c, g, or t
  misc_feature (77)..(77): n is a, c, g, or t
  misc_feature (130)..(130): n is a, c, g, or t
  misc_feature (141)..(141): n is a, c, g, or t
  misc_feature (216)..(216): n is a, c, g, or t
  misc_feature (244)..(244): n is a, c, g, or t
  misc_feature (271)..(271): n is a, c, g, or t
ggcctctaagtgttgaaagggagagtcacacatagctcaaaaaaaaaaaaaaaaaaaaaaaagaantancaagaganctacaattaggagtggagcctgaagatgtgactgatttgctgcaatctcatgntaaattttgancagatgaggaattgcttcttatggatgagcaaagaaagtggtttcttgaaatggaaactactggtgaggattctntgaacgttgttgaaatggcaacaaaagnttttgaatattacataaacttcgttgntaaagcagcagcagggtct

SEQ ID NO: 485614 - DNA, 213 bp, Homo sapiens
acagaagacaacaaaagtatcatttactttaaaaatcaatgaatggacttcatcgaaattcaaaacttcgttttgtgaatggccccgtgctaggggcatgcaaagacaagctatagactgaaagaaaatatttgtaaaccaaacgtatactagaggacttatactctagcaaccacaaaaaactttacacaccctcaaacactcaactactac

SEQ ID NO: 485615 - DNA, 1120 bp, Homo sapiens
  misc_feature (983)..(983): n is a, c, g, or t
agcccgaaaggtgaagcatctggatgggagaagagtgatggcagcagtgatcagagtcagtgcttctggaaccacaggtgtgccgaagggtctcaagaggccctaatggcctcaatgtgccctgcagtgacttcaaggggtcacatagcctttatgggcccgcagtggcatcaaaggactcggttgggctgcttgagtgcccggagagccttgctctccctgagatcaactaaatgcccgtaggggcaaggctcgccgtagagctgccaagcctccagatcatcccaagagcctgaagcaccaccaacgtcgggattgtggcccttatgcaaggtgagggcaaatgattatggtgaagatacctttatggctaaaagaccagacgaagatttcccatcaagcagctcggacatgcttgcaaggcacatcatcaaaggaatacacatgattgtgataccccagaaaaatcaattgaaacgaaggcagagcatattataccttggagaaaggtatataggggatttccacatttgacaaggaaaatgatgataaaggaaattgaacacactatgtaacaattcgttacgtcaagaaaacgttcaggagagcacaaatagatgacaagaggcattaacgtggagaaaacagagtaaggtgaagtacagacaaaaagctgggaggaaagtggaaaccaatgggaaaggcgtataagtataaagaggattcaagtacgatcaaatgaaacttaggacaaacatcccgagagaacacaaggtaggcagcggactttggaacaaagcccataggaagaaaagagatgactagacggagcataagagtcagggagcagacataggcaggacacacccgtggggtggacacttaaaccacttccaatatttaccaagcataacgttatatggagacggcaacacagcatgagacacaacgaacaggacataccacaatcaaccacttggaanctggacagttagaatggatctgagaacaggaagcaggaaacaggttaaaccactgaggagaaacgtaacttgagcgacaccaggaaaagagtacccccacagaactaaagagcacgaatgcacaaccgaccgattgc

SEQ ID NO: 485616 - DNA, 458 bp, Homo sapiens
tgactctagggatccccgtgtgtgtgtgtgttcagtgtggcatgtatggtgtgtgtatatacgtatggtgtgcatgtgatgtatgtggggtatgtgtagtatgtgtgtagcatgtatgtaagtggggtatgtgtatggtgtgtgtgtaggtggtatatgtacatgcatggtgtgtgtatatgtgtatgtgtggtgtgatatggtatgtatgtgtgatgtgtgtggtgtgtggtgtgcataggcagagtatgtgtgtggtgtgtgtgtaggtggtgtgtatgtgtatgtatgtatgtatatatgtatggtgcgtgtctacatgtatctgtgctgtgctgtggtgtggtgtgtagtatgcgtatgtgtggtgcatatgtgtggtgtgtgtgtaggtggtgtatgtgtatgtgcatgtgtggtatgtgtacatgtgtatgtatgcacataatggggggtac

SEQ ID NO: 485617 - DNA, 136 bp, Homo sapiens
taaaatagaagagaacaacagcaaaaagcaaatgacatctccatttctcagtatacaatgggacagaaagatgctctaagaacagttgtaaagcaaaaagatggagcctgggcgacaagagcaagactccatctca

SEQ ID NO: 485618 - DNA, 442 bp, Homo sapiens
cctgtcaggtggtcaaaccagaatgactccattttgagtgagggctaggaaaatgaggctgagacttgctgggctgcattctaaaaaagttaggcaatcctagctcttagatgtttatggttaaggggacaaattaataatgtttactaaacacacccagatttaggagtgtccgggtatcccgatatctggagaataaaggcattcctaattttgctttaaagacagtagtatcaattcttgaaaaatatagtaattaagaaaattcatccttcatcacaaaccctagtagcagaacacatctccccatataatacaagcattgtacctagggtgagtgtgttcctcctcttactttcaggaatgtcctactctgtctatagccacacctgttcttccaacagttcaattccttaataaacttgctttctcttagttaaaa

SEQ ID NO: 485619 - DNA, 964 bp, Homo sapiens
ctcgaatgtcttcgcttgtttggcctgcgcttgcttcaatccgcattggttctgcccagtatacactcgagaagtaacagttatagctagtggtcttgcatgattgcatgaaatgtgtactcacaaattaaacttgttctgagtccattcaaatgtgtaaatagatgtagattgaaagtctccggatttgaagcatacatgtcgaaagtacaccttatcagtggtgaagtacagggttttatagtgtaatatatacagagtaagtgttggtataagtttgacaattgaggtcaaaatggattctgaatgattttgcgatatgggatgaggaaatgctgtgtgatccttaaggagttgagcgaaaactgctgtattatcaaagtgaaaaaagattgcttattacgtctacattgtacagtaaagcttagtgttactaagtatcatgtttgtacagatcatgtaactcatggagatgagagaatatgtgctctgttgctagcaaaggacaaatctcttggaaatgaacactttctgtcttgccttgccgtccaaatgaattaataggcatcgtgggagaagataaaaggcgagatgggccaatccttcaagcagggactaaaagtcgctcttcaaatcattacttaagcagaccaccattctgttaccggatcttagagtatctttcctaaacatgattgtcacgataagtatgttagcgaagttaagtgccaactcctgggatgtggtacttttcaccgtgcatattcaagggacatttcttggctgtcgggtgcaaaaaaacaacaccccgttttaaaaggctccaaagggcggaaaacaaaagacagagcaaaaggggacaagcggacatggcagcaccatgggcaatgcatccaacgcacaactaaagaattatgcaaccagacgcatataaatcaaagtgaaacacacaacaaatagcgac

SEQ ID NO: 485620 - DNA, 125 bp, Homo sapiens
tttgtcacattactatacatatcacaggcaattgggctggctgcataaatgcacacatcgagagtggcttacatacatgaagctgtatttgtctcatataaaagatgttctggcggtagtgaagt

SEQ ID NO: 485621 - DNA, 154 bp, Homo sapiens
acctttctgctgtcatcacgtatcgtacgtgctgagaacaaatattactaaccgcggctaaaagagatttccgcacgttgcattaattagatcgtgtcaaatattcatgttcggtatacatacacgcgaaagttctattgtagaacaattaaca

SEQ ID NO: 485622 - DNA, 186 bp, Homo sapiens
ttctcatttctcagctaatggccttcacattcatagctatcaccacgaaaatccatgattagtaaaattaaagagcgtagttttcaaattctatcattcatttgatctttgttttgtttttgtttttttgtttgagacagagtctcggtctgtcacccaggctggagtgcagtggcgcgatctctg

SEQ ID NO: 485623 - DNA, 457 bp, Homo sapiens
cataaggcacagagagtaatatgtaagttctgagcttacatgctggaatttcactgaaaaggtaagagaagggcggggggtgaaggaaaggagtacattcctttttggccaaaaaggctgaaccgcttctctttgtctttcacttagtccttttcccgcttggcgggactggactcgctggtgatggtgacgacgcttggtggggagggtctgcgcgcggttggatgcttggcgtgcttctgggtgctggcagacacctcgtgtttatcagaggagatggcggaagagatagcctggatccatgtgttcctttcctcatcgtctttggcttggaagaggtactcattgccatcatttagtcttagctagaatacgtgtttcttcttttagtaatcaagggccacttcgcagacagcttcttccaactacacagggacctcactgtggggaagggaat

SEQ ID NO: 485624 - DNA, 335 bp, Homo sapiens
gatgaatcatcgggcacagagtggattaagaggataactgatatcagaggaaataagaagatctttggctacatcgaaggtctacttatgaatcaagtaactcagtgaataatctttaaagcgcaaaggtggtttttagacttgacagacagagccacttaaattcttgtataaaaataccaatttgcctcctccttcctcacttcgttaggttatggtagtgctcagacatctgcagtgttgaggccagtcactgttggaagtcatccaagaagcccattttgaggccattttgagccttactcttaagttctctatgaagaactacattgatt

SEQ ID NO: 485625 - DNA, 284 bp, Homo sapiens
cttcccgaaggtcattaatcaccgtgaccgcggtctctacgaaagactccagctgatcatgttgctctgtgcagcagacaacacagagatcactccagtatttcattctaacttctcagagaagacagatcatccacagcatggagctctgagtgtactacataacatacatgaatacagaacacacatccattaggatggctactgtccaggaaaaaaacagaaaataacaagtgttgtcagggatgtggagaaattagaacccttgtcatattctgtttatt

SEQ ID NO: 485626 - DNA, 178 bp, Homo sapiens
  misc_feature (163)..(163): n is a, c, g, or t
  misc_feature (167)..(167): n is a, c, g, or t
  misc_feature (169)..(169): n is a, c, g, or t
gaatcgatcttgacctggctgccaggaatatccagcttgttaccgactggtaaagaataagaccgctgatcatagagtgaagctccaggaatcagagagtctcatagcaaacctcgaaactgaggatgagatggttacagataaagcctttcaggatggattnaagnangcagagagg

SEQ ID NO: 485627 - DNA, 199 bp, Homo sapiens
  misc_feature (89)..(89): n is a, c, g, or t
  misc_feature (179)..(179): n is a, c, g, or t
ccctacaggacgccgccggtggggcggggtgtaaccgggttggctacgggtactactgtctgggtcgcctacgacggtctggtgacgantacgtgttacgtgtccttaccggacgacgaccggaccgacgaccgtaaccgccgacgggcgttctttgactgtgccaccactgtcttcgncctgacttgagggactcctc

SEQ ID NO: 485628 - DNA, 1035 bp, Homo sapiens
aattttcatgcacgtgtggtgaggtctttgagctctattgagtgttgcacgttgggtactcgaatgttgcaagctgcatgcagctgactcctctgagctgatgtttgatgtgcctgtccccgactccttcctcccccttccctcccccttttttttatgttttcctgttcccctttcccctcccttccctatccccgagactggatcctgatgaggcagctcgaagatttgcatctttcttgaacttctctaatctgaagtttattaacatttactcctgtccccgtcaccactcccacaatccctaatctattaataataactccatcactctagaaagacttcattacttctactacaaaaccgccaaaaattttcaaaacaactgcaaactaatcgcaaaaataccaaataaaactcctttattcaaacctaaatgtaccatagaagtgacaaaacccccacacttagcatacaacactcatcataaaaactagaactatccaatgaaataaaaccaccactagtaactacaactgacaaaaaacactccaaaaaaacaaaatacacaccaaacataaaaaaacaaacaaaaattaaatacaatacttacatacaatagaacaaaacagacatacttaaataaaaaccttatccttcccatggaaaccactaatattcgaaccaaatcctaagatcactatagaaaacaccctcaaaaacagtataaacatctagaatgtcaaaaaccataaaataccatatcaacagtatgaataactaacctgccatcattacgataatacatacatcaccctaaaaatctcccaacaaagtaagcataaactgacaatcatcaacctatgtcctacgaattgacacaacatatgcacaaaacttgattcatccaaacacaaaagcccacaaaactctgcaaaccacataatcaaaaaccccacatacacatcaacaccaatatcacacatcaaacatacaacacaacacatccaactaaccacaagtaaacacatacat

SEQ ID NO: 485629 - DNA, 618 bp, Homo sapiens
tataaaacgggttttttttttggattccctttagccccccccccgggttccctttttttggacaaattttttttgtgccttgccccttttctcctgtcttttttaagtccccctcaagacgcgggggggactcgtggtttcgtggagaaacccaacggggcccgtgagatattcacagtcgtggcgtcctccttccgttgaacccccgaaagatgaggggatggccataggggggggtggggttgttcctcccaaacgccccacgatattgtgtaaggcagcacaagggggggctctatctcatttgacccgctcctttttctcccgtgccccccatgtgtagtgggaccactttggggggggggaggcaatctgggtccccccaagattgggggtcccaccacgagagaaaatttgttaaggaacactaaccacagcaaaacttctccttatcacaattccacagtttcgtgtgtccaaacaaacaaaactaataaatacacaatcaaaaaacactatctgttgtcacgccatctgcctcacaacgaaacgtctttaaaacaaccattagtacgcacgcgccccaaagtatgacatgacaccatgctgcaatagtga

SEQ ID NO: 485630 - DNA, 335 bp, Homo sapiens
tgtccattccagtgcagcaccaggcaagcagcaagttcagccgcagggcgtctttgcatagtagtcagtcaagggtaggcacaggtgcattttcatcggcaatgggcaggtgcattcctcagggggaattgttctgcatcccgttctcgtgccacagcacatcaggcaggtggcagtgctagctcagggctagccaatcacatgcacagggccaagcatgaagtgcacaaggtcaacagcacatcgtgtgcagggtgggcactgtctcactgcagtcagcctcctccagcattccattgccaaccacggatctcgtccagggatcaccagcagct

SEQ ID NO: 485631 - DNA, 356 bp, Homo sapiens
cgcaggcttaactatcaacaatacctttccttaagaaaagagtagccgcgcacggtggctcacgcctgtaatcccagcacttttggaggccgaggcggatggatcacctggggtcagaagtttgagatcagcctggccaacatggtgaaaccccgactctactaaaaatacaaaaattagccaagcatggtggcagacgcctgtactgccagctactcgggaggctgaggcagagaatcgcttgaacccaggaggcaagaggttgcagtgagccgagaccgcaccattgcactctagcctgggcaacaagagcaaaactccgtctcaaaataaatacatacatacatacatgcata

SEQ ID NO: 485632 - DNA, 1076 bp, Homo sapiens
gcaaatgtgcggatgacgccggtgcagcggggggtgccctgtggggccctggtggccctgggatggggaaccgcggtggcttccgcggaggtttcggcagtggcatccggtggcctggggtcgcggccgtggaacgtgggccggggccgaggccgcgggagctcgcggagagcaaggccgaggatacaggagtggatgccctttcacccaagtaggagccgcatatggtcaaggacatgaagaatcaagtccctggaggagatctatctctactacctgcctattaaggaatcagagatcattggatttcttccatgagagagcctctctcaagggattgaggtaatgagagattatgcccaatgtgcaagaagcaatacccgtgaccgaggcagcggcaccaaggtacaaggcatatagatggctaatcgcgggactaccaagtgggccaccgtcaggtctggagatgtcaagtgcatccaacggacggttggacaccgaacataccgtggagccaatacatcctaggcaaagctactccatcgtcacccggtgcgaagaaggctcactggggggaacaacgaatcggcaaggccacaacacttgatacccttgcaaaggtgacaggccgatagaaggtctagtgcatggtaggcatcatccatggacacaggggcacctaggcatcagtactccggacaccttgttcataagaaggcttgctcaatgatgaggtggtaatcgattaaacatgtacacctacagcccagaaggatagacacatgacaacactagaggaaattcagcaaggcaacttatgatagccattatctaagaccctacagatacatgacccccggaacttcggaaaggagactggattcaccgaagtatccctataaggaggtcaagtagaacaactagtaaagaaccaaaacaaaaatatccgaagaagggaaaaagggtaagaaggtggtaaaacatacgggagaaataccaggaaaagataagtgaattaggttgaacaaaaaaagagaaaaagaaagaacagaacgagacatatagaggacaaagag

SEQ ID NO: 485633 - DNA, 175 bp, Homo sapiens
gttatatgctgctcatggtgatccggtaggttatggtcatgccaagctttcacctgaggcagtggcatgatctctgcccccacagaaaaactctgtactgaacatactcttactgcaatgagcaggtgagctgtgtgaactaaatctcttcccacaccctttatccagcactcgg

SEQ ID NO: 485634 - DNA, 536 bp, Homo sapiens
gtccaacatccggggttcaagcaattcctggcctcagtctcccgagtagctggggactacgggcacgggccaccaggaccggcggatttttggtggttttaagtagagacaggatttcaccaggtaagccaggagggtctggatctccggacctggtgatctggtccatctgggcctcccaaagggcggggattacagacatgagccaccgggcccggacggctacctgatctttgcttggcatgttaacaaggaaaccacagaaactcattttatacaaatgaaactctggaaatccatttactccaccttcagttacatggtatggggagttacatttatagggacataaggcggtggtccatttcataaatacacattcataccattggtctggtaccattccgggtagcagaaattaataaaggacctcagggagaccaggggctgggtatgagaatgagagaggatcccaagatattttaggactctgagtagtgaaggaaagagctggggcagggaccgggggcagatga

SEQ ID NO: 485635 - DNA, 1295 bp, Homo sapiens
  misc_feature (313)..(313): n is a, c, g, or t
ggagtgcgccgggcggggcgggtttgcgctttggccggcgctcccaacgctgcctgcgcggcctacagacgagtctccttaatgtcgatgcgtgggtgctcgatggctgggatcctggaagcgcttgtctcgagtccatgggctagtccggcgatcctactgacttagcgttgagcctgcgcctgccacgcagcccctgtgactgggatcctctcggagcaacgtgccggcctggctgcacgatcggagcagcagtggcatcctgctcagccgggctcgcggtggtcgtacctcgtgtctaaacacttcgtancatcatggcagctgtggccagccggtcgttgtcggtcaacgggatgagtagtgactgcggtgcgcctttgtctggggcacgcttttgtggaacaattgcttcgcgttggttagtttgactcgatgccattgttgtgcgagtcccgtagttggaccgaagatggaaaattacccaagggagacactatatctaaataccaaacacttgattgtccgccatatgaaccccgtgggtagagccattttctttggaaccgagggggtgaaacctttgtttggcaaatggctcctgctcgcctttctcgaagttttgcggggaacctaagagctttgcttcttgagccctcgaacagctggggaaatgagcggggtgcgccttttggtgtcttcggaaccggaccagtaggggcagggcgccttcccgccggaagagatggcccaatggcccattgtctcggttcgcggttgtattacccatggcagcaattgcgcgcttttttagccattggggtggccccctcaaaaggtaacggggccaagctgaaaagtttggtccccccccggtatagaaaactccagaggagttgtgtgcctatggctaagggggggaacttgcgcccctttttctcacaagaccgaatttccaacgaacccctgttaccgttgtaatatggggaggacgttgagaagttggtaggggccaaagagggggccggggccgtatttgtcagaaccgccacgctaattggccaatattaagaagggggccttcccaatggaaaaagacgttacccaaggccctttcgccgggggtcgaataagggctccccttccgatggaatcggttttccggggaaaggaccccttggcgggcctctgtattgcaccacctccgcactttaaaccaagaccatttcgacttcgttcaaccaaggaggaaagtggggccccaaagcggcgaatggttgattttcggcttccaa

SEQ ID NO: 485636 - DNA, 218 bp, Homo sapiens
ccccgcccccgcccggggggtggtttgggggccccgcacccccgccaggggaatgtttgcacctccgtttgccaaaggccctgggtaagggactggatgttccccatcaaggtccagtggaagtttttcaaaaggaaaggggcccccgccccaggtttcggggcccagggtttgccaggttaagggcccgttttaccaataaattgagggcccccaga

SEQ ID NO: 485637 - DNA, 135 bp, Homo sapiens
  misc_feature (114)..(114): n is a, c, g, or t
tgttgggattacaggcatgagccactgtgaccagcctattattattttcaagacagggtctcactctgttgcccagcctggagttcaagaccaggactccgtttcaaaaaaaangagaaagtgcaggatgtcgga

SEQ ID NO: 485638 - DNA, 194 bp, Homo sapiens
cgggtttatacaagacattcagttcccaggacaggcaggagacagtagccttccactatctcaactgcaagaggctttcctcttttaataatccagctgagcacagaccctttacgggtgtgggctgggggatggtcaggtcattctcatcccacaaggccatatttcagactgtcacatggggagaaaccttg

SEQ ID NO: 485639 - DNA, 909 bp, Homo sapiens
atgaccaaattttcatttgatgtttctactcatttattttatgcatctaaatattgtacatgtggataatggcatacacgtttgtgtgttcctcttgagtgttgtatagtgcgtgattgttcccgttcttacttcatggctatcggcctcattgtttccccgttcttatttgtcgtgtagcgttgccgaatatatgtgccaagatttatacagtctatgtggttgaattttcgtgaactggccatgtctggcacccaggggtccctaatcatttttatcagtccctctagtcactcagtccccggtaattcagttttattgaactctcgaagtggcgaatgtcaactgttggtgtataagtttaacctttcctataaaatggtgcactgtactttgtgtcttagtctatagttataaccctgggtagactcgttggtcctggcagtgtgagactgtacctatgatagcttgggcgtttatcctcacatgtctccacaccctttcaaagttgacatatggccatcccattggccagaatccatcatgacacacttaagcctgtggcactgggaacagaatagattttgccatttgagacggcatcttcctgtgtcagtcttgtttgtaaggtaggtgtgtgatggtggatagagatgaacgtaggtagggagtgccctcactaagtgcaaaaattacatatatgattattagactattgagtgatattctcacacattgatttgttttataagcaattgcctagataacccccgttttttagcttattgcttggaggtgggggtaggaagttaaggtttattcaatcgtgtcctgggtagggcgaaagttaattctagctatgtgatttttcagacaagtaagtggaaaactgcctgccgctgtttcaag

SEQ ID NO: 485640 - DNA, 1198 bp, Homo sapiens
  misc_feature (358)..(358): n is a, c, g, or t
  misc_feature (702)..(702): n is a, c, g, or t
gagagagagagaagtgaagattctatgctgctagctttgaaagtggagaatggggccatgagtcaaggaactcaggtagctccagaaagctagaaaaagcaagaaaacagatctccccttagatcctctagatggaatgtgttccaccttgattttagctcagtgagacccttttccaactcccaacttccagaactgtaagaaaagaaacttgcattcttttaagccactaaatttgtggtaatttgttacagcagccagaggcagctaatacagaaggtttcatcagagatgaggtgacactggaactgtgttccatcaaaggggacaggtatctaatacagaaactcaggtgttngaaaatattgaaatgtttgacatgccgggaggtgaaggggtggagagatgagaggagacctgccaaagcctgggtcttggagtgccagctctgtgtcaggctgtctggggtcaactccagctttgctaccttctctctgagtgcttgggctctcagcaaatgtcagcgaagattacaactcaattaacagggagtccgtaaaggcttggctcaggaggttatctggcagactggaaaatggattctgtgtttcttggcacctcaagtggtggcctttgtgccatacatgctgcttttttatcaatcctcttaacctcaggtgatgtctctgtgtttcaaaaacnattcaatacagccatagttgtgagtaagaagagaactttgtccttcctggcattccctgggacagcggccctgattcgtggggaagagttctgtcatgtggcacaagcagagcagaggtcacagactcctgcttggcacgtgacagctacattgcacaaccctgataaagctgcaaaacccatgaggcagatgcctgtcatcctactcatagttccctctcccaggcacctggtgccttcatcacatggtctctggttccccaacctcctcacagatctacccatctctcctcaatcccagggctcctgagctttgcttcttgtctcccctcacaatcaaacccaggacaacagaatcctggggagcttacggtggaaaagacactacctttctttcctcccagctgaacatttccaaacttttattcctcagtagccacagcttcaggcacttccctgtcctgtgcctctcagatgggttccagtgaactgaatc

SEQ ID NO: 485641 - DNA, 161 bp, Homo sapiens
gaggatccccacataggactagaggagggccctcccacgttacatagccagagggagccccaaatgcaaccagccgggggttctattcttgcctgcaaaagaacagagggatgaccttggcccaactcgatgggcacagacagacaacctaagactatcac

SEQ ID NO: 485642 - DNA, 613 bp, Homo sapiens
gaggggacatctcctcagaatgccctgcaaaccatgaaataaaaatggaggaggaacaactaacaatcaaacaaaaaaaaaaacgcaagaggaactgtaatatcatccctagcgactaacagtgagcagaggacagtaaagggggagtgcgtaaggagaggctggtttcaacagccgtggtgatgaaagaaggcgactctgcggaaaactaggcaagttgcacattttcaggactgtagccgctgtgccaaatgagctcaggcataccaagcccgatgcaagaccacagtaattgcagaagttcaggagaaggcttatcaccttccctgagagagaaaaacacatttgcagattttggcctgcatcataagagtgagcactccattgctttctttcctggccactactgctacaatccagcactaagctatccatgtccaggtaaggatcgcagatcgagaagcccaaatctgccagtgacaaatgctacgtgtttacctgcataagcttagaggaagcaattttcggaacaacggaacccttcaaactataagtactgacattatcgaacacttgccaggcactttcagcagaagacaaggaacttgaagac

SEQ ID NO: 485643 - DNA, 1434 bp, Homo sapiens
  misc_feature (328)..(328): n is a, c, g, or t
  misc_feature (453)..(453): n is a, c, g, or t
  misc_feature (672)..(672): n is a, c, g, or t
  misc_feature (912)..(912): n is a, c, g, or t
agcggagtcggggtggaggcggcggcagcggcagcggctgcgggcagcgcgcggggcgcagggcgcggggcgatcaccgtcgtgggctctgggaggcgggcagtgtggcacagggctcccatggtgccctgcccctccgtctgcggattgtggaggcctgctgaggctggtgcggccgtgggagtggtgctcaggtgactcgtctgctctacagagagtgatgccgtgactgtctgttttcagtcgagcctgagtcggccgccttcatgtagataccatacccaagtgccttttgggacaacgatacgggatgaatcgaaacgggatnacttggtattgttttgtgaccgctacctgaaatctatgcacctgtgctgagttgcttataccgaaatcgtgttgactctgaaccagttcttgtacctgtgtaccccctaaatgggtagaaccgtnacttgtaatattgtccctgtcctccaggagggcaaagttgggatgttttaccttcgcgctcagacaactcagccaggtggctagatttctagcttgcgtatggacagttgcgggtgaccttgtctagtcagtcatgcttgacgttggttttgggaagagttgtgggtcgaatagttttaaatccatcaatatgctttgtggaacaagctctcaaaggtntgcgtggtcacaagcaaattgaagtttgttgctggttcctatgatatttttcctttcggatctgaactttctaacagttcttgaatttcagtcagagtactcacgaagaaggcgcgaaaaaagcaccactggcgggcggctacttagaaaaaaaccaacttttcgtgatattgcacttgtggccaaagttcgaaaaggtccccgcctcggtggcggggcagttttagtgcgtccaagttnaggcttccgtgggcaaaagtttatgctttgagccaagtcgtgaagaatcaaagagtttgtcgttcgtcgagaaaccaagcgagagtttgcgttgagctccttcgcaggtgagttaacaaacccttccttaaagtagcctaaaggtatgctcaaaaaacctggctggggagggctcttttcgttataaaaaaggacagaaccgatcggggccgagagagaagaaaaccagattttaagttccttcttagttttgattttcttagttagaattggaaaagtcaatttgaagtcgaaaagagttaggggccgtcgaggtgggccgcaaaaacagagtttctggtcgggaaattttattcagagagctggttgggagccacacactgagcgagcgcagttgttagaacgcttgctctctggaggagcggagaagagctctctcatgagtttatgtgtctcctctccgttaccagttagattttttttggcgctttggttgtttggcggtcataagagagactcggg

SEQ ID NO: 485644 - DNA, 216 bp, Homo sapiens
cctggtggtgcatacctatttctaatgatatctgatgcttgattctggccttcagatatacatgcatatgtgcaaacatgcataataccatatacagagtaaatatacacatacatcacaaaagtataactaaagtctcctgctaacccaacacatacatacagcacagcactcacatacaatacacatacaacacacaaaacacacagtcgacgc

SEQ ID NO: 485645 - DNA, 151 bp, Homo sapiens
gacatcactactacagaaactagcaagcattaccaataagatagcgatagaatgaacctgcgcaataatatgtacccagggaaagtgaaaattttaccagcgttatttgcgaggcttacccctatccccgcaaaaggattacgggaatact

SEQ ID NO: 485646 - DNA, 483 bp, Homo sapiens
aatacaacaaagacaaagaaagcaaggttttctacagcatcactggccagggagctgacacaccctctgttggtgtctttattattgaaagagaaacagtgattgttgaaggtgacagagcctctggatagacaacgcattgccacatacactctcttctctcacgctgttgtcaatccacacgggaatgcatttcaggatccaatggagattttgatcacagtaaccgatcatacattactacaagcccgaattcatccaggacgtctttaaggggtctgtcatgaaaagtgctcttccaagaacctctttgatggcggtcacagccctttccctgttgtaaaaattgacacctacaatgccgccatcgcttacaccatcctcagccaagatcctgagctccctgacaaaaatatgttcaccattaacaggaacacaggagtcatcagtgtggtcaccactgggctggaccgagagagtttc

SEQ ID NO: 485647 - DNA, 440 bp, Homo sapiens
  misc_feature (122)..(122): n is a, c, g, or t
  misc_feature (127)..(127): n is a, c, g, or t
ccaagaaaagtaacaggcaagggttaacaagaaaaaaagaagttttcctctgcctagcaagcacacttcaaggacagttataagataatgctgtacgagcagccaaggccaaaggaatgggnttcangccccttccccccccagagcaatgttgaaggaaaaaaaaagagaaaaagataaattactttactgttactcctttcccaggcttcttaaacgtgattatgttttacaaatgtctgtatttagccagttcttgtttttcttttgacgcagctacaaggccacaaattatacactatatgattaactgcttttgttttacttttgtaagtctgcttataaaaaccccactcagtcgttgttcaatgctcagctttttggatgcgaatccactgagccagtgcgtacctaaaataaacaatcctcccgttctccgt

SEQ ID NO: 485648 - DNA, 604 bp, Homo sapiens
atacatgtttctactggtgagtcttttcaaataaaatgttctctatccttaaaaaaattagcacaagtcttacctccttcatgcagcttctctcatttactattactcacatccatttctccctactgtcttttcttctttttttggagatggagtcttgttctgtcccccacactggagtgcaatggcacaatctcagctcactgcaacctccgcctcctggggtcaagcaattctcctccctcaggctcccgagtagctgggattacaggtgcccgccaccgtacccaactaatttttgcatttttagtagagacagggtttcaccatgttggccaggctggtctcgaactcctgacctcaggtgatccacccacctcagactccaaagtgctgggattacaggcgtgagacagcggccgcagccactaatgagcttctactaggcaaattcatggatacttaacattcttaatctcatctgacttctctaaattatgacagtattgactacagaagagttgaaaacttttctgtcaagccaaagaaaaaatgtcattattatatatttcatggacccctgattttttactttttctaatgt

SEQ ID NO: 485649 - DNA, 273 bp, Homo sapiens
  misc_feature (161)..(161): n is a, c, g, or t
cccaagtggaaaaaacatcttaacagtagaaaatgcaatgtaacaggctaggtgcggtggctcactcctgtaatcccagcattttgggaggcccgggtaggtggatcacctgaggttaggagttcgagaccagcctggtctacatggcaaaaccccatgtntactaaaaatacaaaaaattggccagtcgtggtggtgggtgcctgtaatcccagctactcgggtgaccgaggccaagagaattgcttgaacccgggaggcagacgttgcagt

SEQ ID NO: 485650 - DNA, 175 bp, Homo sapiens
tgtcccattgtggtcagtggttacgaatcgactagcaacatgagttgcgggttcaatccctggcttgctcagtgggttcaggatctgacgttgccatgagctgcggtgtaggttgcagactcggctcagatcccgcgttgctgtggctttggcgtaggctgtcagctacagttcc

SEQ ID NO: 485651 - DNA, 850 bp, Homo sapiens
  misc_feature (426)..(426): n is a, c, g, or t
cgagttgtttttgtttttctttaaatttttaattttcgggggcacatagtttattggagaattttttttttttggaaatggcgggggtctctattttgtcccccaaatctaaagggcaggggcttatttcacaggcgccgttcttagcgcacttacaacctttaaacctccgtgggcctcaagcaatttcctccgtgccctcagcctggggagttagcgtgggatacacaagttgcccgccaccacgcctgggctctgccaattacttctctactcagctcgtgctcagtgtatacgtggtcttttctccctcccattacgaggagagtttattctccttctctccaggtggggctcaagtcctccagtgtgcaccttttcgtggtttcacgaggcttgagagtcttgtggggtgctccccacgtntagaaaaaggggtgccccgtggcctcctccacttattcgttgcgacgaggctatccaggtctccaaggctctcatataagacaagtgtttcctctccatatttttatctccagctccagcgtgccccccagggagccgtgcgcgtggggcatttccactgtgccccccgacagccctcgtccttccagcccccaaagggataagaaagcctcgggcgcccctgtaggagagttcccgagggaccaactccccggggaacggggggagagcctggctttgggtggttccacggcccccgggggctaaaagccactatttaatccaagcctttcggaagcctaacccctggggggggttagcccacccccggagaataggcaacccatgaatggtatggggtatggcccccacgggtgggccgccg

SEQ ID NO: 485652 - DNA, 201 bp, Homo sapiens
tcccacttcagcctcctgagtagctgggactacaggcacacatcaccatgatcagctaatttgtttttctttttctttttgagatggagtctcgctctgttgccaggctggagtgagactccgtctcaaaaacaaacaaaacaaaccaaaaaacacttcatctaatactgagaataatactttttttttttttaaaacagg

SEQ ID NO: 485653 - DNA, 132 bp, Homo sapiens
accagcaggaccagcagacccagacttcgccccggtcacctgatggctccagcaggaccagggagcacactacagcaccaggagcaccacgagcaccatctctgccagggttaccaatattcacctctgaga

SEQ ID NO: 485654 - DNA, 551 bp, Homo sapiens
gactagttctagatcgcgagcggccgcccttttttttttttacagttctcaaggaagagcacagaacaatttctacatttcatattgggagtatgaaagtagattctatttggtaatgctgataatacctaaagatgcattgaatgctgtggaagaatgcttttggatgttgattttgacctgtccatgattcagaagaaaaacaaacttttctgggagttttttgttctcctcgaggctcgtgatggtagcagtatgcgcgttaaaggtctttgatccgagttgtggaagcagtgtgtcgtgttcattgtacagagtagggtatcagaaatgttaccatagagatgatgaatactcgcatgcgaagagacgaagagactagtgaagactcgtataaagcgtacgacccggaggagagggccatgtagcaactagctagtcaggagaggaggagatacccttaccgtaggagaaggatatggaagagggataaatatctagaatgagagtggactcgctaagtcctggaaggtgagcgagggagccctaag

SEQ ID NO: 485655 - DNA, 196 bp, Homo sapiens
agatctccagtacaactaaagaaatgagggactcggcagggtgcggtggctcacccctgctaatcccagcactcggggaggccaaggcgggcagatcacaaggtcaggagttcaagaccagcctggccaacatcgtgaaaccccgtctctactaaaaatacaaaaattagctgggtatggttactcggcgtgtgca

SEQ ID NO: 485656 - DNA, 200 bp, Homo sapiens
  misc_feature (145)..(145): n is a, c, g, or t
gagtacatagcacatgctgccggggatgctgttgattcctcacacggctgaggttgtggagctctcaggaaagtgtgtgctgcaattgagcccgggctgctgtagtagctggtaggttcttcaacaagggcagatgtggtgctanggcggtgaagatatattgtgtgtgttgtgctgctattgaaacttctaaaactagg

SEQ ID NO: 485657 - DNA, 87 bp, Homo sapiens
cccccagagctttttattgggggaaaggaatgtaactcggggtggttgtccttcacttcccttctgtcgtcttctcgcccccgtata

SEQ ID NO: 485658 - DNA, 1162 bp, Homo sapiens
aggatgtttacaaagaagagatgaatgaaaatgaagaagttataaatattctcctattctcaggcagaatgagatcctgactgaacaggaggagctcctgtgccatggcatgcagtttcttgcgcctggatagcattgcctcagcacaacacagcaagcagcattagcaacgcgctccagagcgtgagcatttgctgaagattccagagtcgcccagcgagccacgtgcgaagttgagcactgcaggagtactcctcacgcagcagcgcagcagcgcagcagtagagtgcatgcagcgcagtgacgcttgcctagatctattcataggcacaggaccttcaccagcaggcagcagcacacagcacaggcagcttgtgcaacaatcacaatgacaccacatcacattatcgcaccatccacaagccacatttccaattgcatggccagcctgctcgcagtgcccacatacgattcgtgcatgcatggccgaccgattgccatacattgctgtgtcttgactacaccagccattgccaagaccgaagcccccaaaggccctaggcaagcatatgcattagcgcagccaagagcagagcacgcaacagcaggactttgcaagttggcctcgcggagagcgatgttcggccccggtaccaagcgccacaggcacgcatcgaccgaaacatgagccgcacacccttatgaacgacacaaacaccggacacgcttactaacgaacagcaacgccaacaacgggcaacgagcacccaggaacgcccgggccaaatcacgccacacatccagacccaacgacaacgcggactaaatagacacacgggacgacaccagtcaccaattccattagaagcaccagtgacgcattggcgctatgagacccgagtaatcatctggaacgatacacgggatcgacacacagtagtccacaacgaggcaaccccccggtatgccaattccgtttacccttggttaacactccctctggacgctggagctctcacacgtgaccggcgcactctatcactacagcatatcataacaacattatccttcggtcaacaaactagctgatgcataacctcccgttccttccattcacacactccagtccccatcctgtcctaacaccacacgcgctctatga

SEQ ID NO: 485659 - DNA, 500 bp, Homo sapiens
tgcacaaccatctatctggtctagagactagctgaacatgcctcggctcttatcttcagcagagtttgttgagtaagcttggagtcagccggtcaaccacaacttcagagattacaacaaagctatcaggtctcacatttccctatacttcaagaaccagtgaatcagactcagaaggttgtgtagagtacaaaaccaagactgcagggggtgggccagagaatacctgaagaccattttgcagggaatcttaggctacttgcccagacagtcccctggctatgacccctgggaaggtgagctgctacccgcacctggtttttgggagaggtgtacctggttaggctgttaaagctttgttaccagctttgtagagaagagtcctcccaccacaaacgtgggatccgtgcacgttaacgattactaggactatgcagaaaccttggttttttctgttttttttttttttttttttctctttttctttgttttttctcttt

SEQ ID NO: 485660 - DNA, 539 bp, Homo sapiens
ctccaaacacaatctatttcatttgatctgctggcctcggcctcccaaaattagccaggcatggtgacgcacacctgtagtcccagctactcaggaggctgagacaggagaatcgcttgaacccaggaggcagaggttgcagtgagccgagatcaggctactgcactccagcctgggggatggagtgagacgccatctcaaaaaaaaaaaaaaaaaaaaaaaaaaaaaactttgggggcccgcccggggcccccggaaaaggttttacaaacccaatccggtggagggcccgcgcggccccgggtagtggttacgaatggaacccgtgtcgccaaggcgttggtaccgcaagaggaagaatcggtggtaaagaacaaagggcgtaggtttcctcccaagaaaaaaacgccccgggcggacaacgcgagcggttctggaacacaactcccaaaggggagtacaggagggcaatccaggggactcctacaccacgagatgcccaggcgaccccggaatacaaatatagcccgcgcggtgtt

SEQ ID NO: 485661 - DNA, 404 bp, Homo sapiens
tatgtatgtatatatatacatacatacacacacaggggaaaattataatcctgtcattgtgacgacatggatgaacctggaggacataatgttaagtgaaataggccaggcacagaaagataaatactacaggatcttacttatatgtgcaatataaaaaagttgaactcatagtagagaatagaatggtgattaccacgggctagacggggagagggaaagttggggaaatgttagtcaaagcatataaaatttcagacaggaagaataagttcaagagatctgttgtacaacatggtgactatagttaataacgatgtactatatacttgaaaattgctaagagtaggttttaagtgttcttactacaaaaaaaaatgaagtcacacggggttaagtaagca

SEQ ID NO: 485662 - DNA, 461 bp, Homo sapiens
  misc_feature (221)..(221): n is a, c, g, or t
  misc_feature (230)..(231): n is a, c, g, or t
ttcccccggcaatgtggctcttaaaagcgcaagcacttagcgaaatccattgcctgagaaagaacccgtttggcccgctgagatccacaccataagttggggacggaggtgggatccctgccccctgttaacacatgagaagggaccccaccctttttccccagcatggatggccacagctcaacagcctcctttgccaccaggtgttggcagcccatgcntgggggggnngccattttttctccccaccaccctttcaaacattcttgaccagagatcccagccaggccctggaggtttgacagcccctccctcccaaagttggttcctccctgggagggcaatttcaggggtggcccccccccgtgttccccatcctcagttgaagtttgatgaattgaagtggggcctttatgccaactggttccttttgttttcaataaatgttgggtttggtaata

SEQ ID NO: 485663 - DNA, 1457 bp, Homo sapiens
gcacggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctattatgctgatatcagtgatgttgcattccttgtggttggtgatccatttggacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataattacccagtctcgggtatttcttcatagcagtgtgagaatggattaatacctggatgcatgcatgtttgtgtaacaaacaggtcttttggcttatctagtaagta

SEQ ID NO: 485664 - DNA, 1406 bp, Homo sapiens
gcacggagccggcgcttttgcagttgcttctgcggaaaggtggtagttaagaatttgtaaaggccagagaactacctacgattctctcagcggtctctcttctcctcaagtttgaaatgctttatctcatcgggttgggcctgggagatgccaaggacatcacagtcaagggcctggaagttgttagacgctgcagtcgagtgtatctggaagcctacacctcagtcctaactgtagggaaggaagccttggaagagttttatggaagaaaattggttgttgctgatagagaagaagtggaacaagaagcagataatattttaaaggatgctgatatcagtgatgttgcattccttgtggttggtgatccatttggggccacaacacacagtgatcttgttctaagagcaacaaagctgggaattccttatagagttattcacaatgcctccataatgaatgctgtaggctgctgtggtttacagttatataagtttggagagacagtttctgacacttggagaccagaaagcttctttgacaaagtgaagaagaacagacaaaatggcatgcacacattatgtttactagacatcaaagtaaaggagcagtctttggaaaatctaatcaagggaaggaagatctatgaacctccacggtatatgagtgtaaaccaagcagcccagcagcttctggagattgttcaaaatcaaagaatacgaggagaagaaccagcagttaccgaggagacactttgtgttggcttagccagggttggagccgacgaccagaaaattgcagcaggcactttaaggcaaatgtgcactgtggacttgggagaaccattgcattccttgatcatcacaggaggcagcatacatccaatggagatggagatgctaagtctgttttccataccagaaaatagctcagaatctcaaagcatcaatggactttgaacatagatatttaccattgtctgatgtaaatttcagccatatatggattgatatggtttggatgtatccccacccaagtctcatcttgaattttaatcctcataattcccaggtgttgtggtaggtaattgaatcatgggggcagtttccctcatgctattctcatgatagtgagctttcatgagatctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataattacccagtctcgggtatttcttcatagcagtgtgagaatggattaatacctggatgcatgcatgtttgtgtaacaaacaggtcttttggcttatctagtaagta

SEQ ID NO: 485665 - DNA, 1468 bp, Homo sapiens
atatcagaataaattcacacgtctagtgactttagttacatactcgtgtaggtggcgatcgtactaattttctgatccgccatccatagtgatgccgttcatgcacgttcacattcggaaggtcctcacccatgtacacgcaatttgcgctgcatggcgagtctagcgcgaatcaaccatttagctggtgacccgcaaggtgttccatcggacacttcacgtcaggatcggctcacactttgctcactatctgtctgtcatccggtcacatctaagtagtttgcactctaactatccgaaagcatgcactgtgggcttgccaacacgtcgcgccgacctgtactactggcatatatggtgagaattgtggatgaagagttattgctggtatgtctccagctattgatgagggtcaacagtgtgccccattggaaaaactagaacttgtcttggagcgggactggcggaagtcatattcaatgagctatctcagtttgagcctgaggttaccagcaaaaggtggcccaagtgaggagatgactgtgcctctcaataaagtatacaggtttcaaaaaagatcgggagttactatgatgaaataataacggcggcggtggcaccccatgccggggttccgataaatattctaccgagataggactgacgtccaggtgacttaaccagggacacaccttaagtggctcttacacctagcgcgccgtggaacaaagatgtacggccggtataggactgcatcctagcacgggcaactgctacaccagcgaccagttcgggcagcacttctgtcacggcgaccaggacagccagtagacggcacaccaccttgcgacacaaaaagtcaaccacggcagcatacttcacccgtcctactatctttttttccactcccacaccacacaccaacacaactacgcaaatcccaccaacacacacaacaaccaacaacacaacacaacataccagcaaccaatccacaaaaccgacaaccccctcccatcacaattcacaccaactacaccaccacctacctcaaccacaacgctcaccagacgaaagcacacggggaccaggcacagagggccaaagaagagagagcaagagaacgaacaagacaagcagcaagagcgaggaccgagcaagcagccacaaccaaacactagcagcaaacaggaagaggcacagacgacagcgagcaaaacaagcaggacagagaaaaagagagacacagcgaaacagaaagcgaacgcagcacgaagactcagagagaccacagacagacagagggacacacaataagccagcaaacagacagaaggaacacacaagaagagacacaccgacagagagagcagagaagaggagaaggagagaggcgaaacccaggacacgaccagaggggagaaagagagaagagaacaggaaaaaggcaagacagcagagcagacgg

SEQ ID NO: 485666 - DNA, 191 bp, Homo sapiens
gatgagccggtccgatggttgcagggaacttcctctctgtctccttattcgaattgtcatgcctattgcaaatccctgtgcagaattcacatctttactcacattccttaaaattttctacgaccacaaaaggctcttggagtctcagcttggttaaaatcgcccctcttgtagtgacgaacaaacatagg

SEQ ID NO: 485667 - DNA, 210 bp, Homo sapiens
actcatctcgacagttgtgcattggactcacttttaagacgtcgatcttatctttaaccagctattacaatcaaaagtcaacgtagacattatattctctccaagtaccaaaaaaagaataaaattggatgtatttgaaaaaaaaatatttgaatagaattaataaaattcttagggaggaggaagcagagaaggaaaaaaaggagaaac

SEQ ID NO: 485668 - DNA, 586 bp, Homo sapiens
taaacgacggcagtgtaatcgacggcagttgtaacactgagggtcagcagtaaatgctggtcattcgagagtgtgggtcacacgccgagagagcagactgcacacgcgaaggatcagaccggagagtacgaggagagccttccagcgtgtgtgagcgaacaggtgatggcaagatcctgtacaggcagtgcggggatgtgatgagggccctggtccaataaccctaccaaggccgaggtgctcaaggtcctggggaaccccaagcgtgatgagatgaatgtgacggtgctggactttgagcacttactgcccatgctgcatacaggtggccaggaacaaggaccagggcacctatgaggattatgtcgaaggacttcgggtgttggacaaggacggaactggcaccgtcatgggtgctgaaatccggcatgtacttgtcacactgggtgaaaagatgacagaggcagaagtagagatgctggtgccagggcatgaggacagcaatggttgtatcaactatgaagagctcgtccgcatggagatgactggctgatagacttcccagtctccccagagtccgtgcctt

SEQ ID NO: 485669 - DNA, 551 bp, Homo sapiens
gaattaacagaccgtgagataatataatgcctagttatcagcaataagtacaccagttcttattaaattaggagtatgtaattctaaattaattgattctctcatggtacatattatatgcaaggttacaaaaaaaaagtcaagggttaatgattttttagctcaaccaagctaaaagatgtgaacagagaaatggaactcaaagagcaacttgaagatacaaagctctgtgtaacagataatgtctaataatattcgtcaatttaccaatatctgtacttatattaacatgttctatcattttcctaataatttaaaagtcgattcacaaaaatatatatatatacgggtagtgccagaaaatggaatacattactaaatggggtcgagtagatgaatctcccatgaagaagaattccaaataatttatgaactcagccctcaaggatatggagcagaactgcaaacatcgctagatgtgagcagaatagtgactaccttccaagcattacatatggaacgggggaccataatatgtagcggaaaatctg

SEQ ID NO: 485670 - DNA, 902 bp, Homo sapiens
agcggggtcgcgcgccttctagaccgcccttcccctggcggctacgtgccggagggagcggaggcgagcgggagtcgggctccatggagagcggcggacaactgggcagaggcggagctttcactctcgagcaccactgagttccaagtgaccctgcagctatgcgtcaccgtcacctgcccgcagtcagagagcaggccgtcagagcccctgggacctagacacgtgcctcgaaacgcacactcccagaaccagaactagacgctcccagggcagcttccctagcggcccgcagacagtcagcccccatcagtacaccacactatcccccacgtgacagtgggatagggttgagcagcgcccagagagcccccaccaactgtgcagagcatggcccgggaagccacgacaagacacgccaatagcacgcccagagacggccacagatccattgatacttgaataggaaaggatttcccaaatgttccgcccaaactcacagaaccgcacagggaaaccaccttaaccccaaccgcggcgaacacggggccccatctcaagagcgaaaagccgaggtgccgtagtcacatggccccatcgctgcccgatctcccagggacatcccgacgtccacgggcgagggtgaccgtcaagtgtgatgaccttgccgttgagcatggcagagctacgacacagcgcccctggcgtttatacccccgaggaaaccaccagacattgagaaactttagcaatccccctacggacagcaggcacgggcaaaccttggggaccaacccccgaggcaccgcaggcgtacaaccacttgagaccaggatgtgaccattgcacctgagcgaacagggggagcagtctctcacagtggaacggggacaggagcgctg

SEQ ID NO: 485671 - DNA, 929 bp, Homo sapiens
gtttttgagacggagtttgcactgtcacccaggctggagtgcagtggcttggtctcggctcactgcaagctccgcctcctgggttcgcgccattctcttgcctcagcctcctgagtagctgggactacaggtgcccaccattatgcctggctaatttttgtatttttagtagagacggggtttcgccttgttagccaggatggtctcaatctcctgacttcgtgatccgacctcctcggcctcccaaagtgctgggattacaggcgtgaggccaccgcgcccggcatgttattgatatctagcataaatgtggatatagcagtgacgaataggctagggttcttgtccgctttgatgttcttgtccttgcctcatgatcatcatatcatagattccgacaagtgagatgctatgaatacaaaggtgggtgctatgtcaatagccgtatgataggtacgtgaggagaacaaaggttgggatcacgttcatgggaatacgtgcacagtctttgagggacattacggtctcctgaatcgctttattagcagacactgggaggaaactacagcattggacttacgaaacacagaatgtactcgagaagcaccgcgacgtcagacccgggagcgatgcgtcacaatgacatgcgccaggatcacagggaggcacagcttccgcgaacagctagagcaccagcggagcagtagggcctagcaggcgcaacgggaaagcaagagaagtataaccaacgcgggctggacatgacaagggcaggagacccgaaaggcgagaaccagaaagccaccgtcgacacggggcgaagagacataagtaagcggcaatgaaggagacaagatgagcgaacagaaaatagaaagtggagacccacgtgcccggcagagtcaaaacaatgcaggacgagcaaaggg

SEQ ID NO: 485672 - DNA, 379 bp, Homo sapiens
  misc_feature (48)..(48): n is a, c, g, or t
  misc_feature (76)..(76): n is a, c, g, or t
  misc_feature (112)..(112): n is a, c, g, or t
  misc_feature (122)..(122): n is a, c, g, or t
  misc_feature (139)..(139): n is a, c, g, or t
gtgttatacccatacaatggaatattattcagcccataaaaaggaaanccttcctacatactacatcatggatgancctttcagacattaagtaaatcacaaaaggacaatnctatatgaancccactgatgtgaggtncctagactagtgagattcatagagacaaagtagaacaaagattacgttttgtcacagggggcaggagggaatgggaatttattgtttaaggggcacagagattagtgtgggatcatgaaaaagttccggaggtgcatagtggtgactggtacatacaacgaatgtatttaatgcctttaaactgtaacttcaaaatggttaaaatttaaatcttacgtacattttgccacagtaaatttt

SEQ ID NO: 485673 - DNA, 107 bp, Homo sapiens
cagcagaatctgaattataagtgacagacatggaggcagaagaagtaaactctgctagatttcagctgtgctcaggtcataatagttttttgaggtttggaatttac

SEQ ID NO: 485674 - DNA, 822 bp, Homo sapiens
  misc_feature (104)..(104): n is a, c, g, or t
  misc_feature (133)..(133): n is a, c, g, or t
  misc_feature (147)..(147): n is a, c, g, or t
  misc_feature (203)..(203): n is a, c, g, or t
gttgttcctgtctggttaaatagaaacataaatgaattacttatgtgccccagtggcttcataatgctgagagcaaagtcaattattctagcaggttctagaanactttatcatatcatggggttcaatgaanatatcaaatcatanatataataatcaaatctgaaagtgaatctaagtttcaaagacctcaaaagccagtntttaggaagctctttttcagatagagacaagggattatttcgacttcttgtctctgttgtctggcgcagttgtccggaacacagcagatgttccacatgcacagtcgcatcctatgtatgtgtgtttcttttccggcaaggactggaggtcctaagctttgtttatttggtgagccagtgcccaaatgagcaggggaatcttggcacagtcacctacacactcatttcagtgctctggccccttatccaagctagtcaaagtgtggtctatggtttttcattgcaagggatccccgggtgaatcttgtgtctgtcaaaggaggagaagcactgccctcaaaatatagaaaaggtgaactaatttatccaggcagcctggctatttatttatgtatttatttatcttgttgacgggaagattcaaattgacatacacaatcaccctcataaggatttcaggtaaaaaacagacaaagatttagatatcagatgtgttttacaattactgcaccagtctttttctacagaatctagtagtatatttccaatagatctaggtgaaaatttctatctcatgagccttctgtcagtatttttaaaattggatactctattagtg

SEQ ID NO: 485675 - DNA, 1138 bp, Homo sapiens
tgggcttgactcaggatttaaaaactgaaacggtgaaggtgacagcagtcggtgggagcgagcatcccccaaagtttcacaagtgtgtggccgaggcactagtgaatggcacattgggtccggttctctaaatagtcatgccaaatagtgacaactgcatggtgtacaggaagttccctgtgccatcctataagaagcccaccccaggtctactcgtcaaaaggagaagtggcccaggccgtcacaccacaagatccaaacaccaggggcaggaggaaaggcagtggcgtaaacgggtgcctaacagtaagtgttaacgtgacaaagagttataaaaaactacatcaccggcccatataaaaacaagcactagtacgcaagaactaacgggcggcctagcagactgtccggcaacagttgcaatggacgacccatacgacgaggggcccacacaacagaatataacacgccacgaagataatgacaagagacgcacccacacaagagacaactactgccgccacacgacgcctacgaacaaccacggcgcccaacgcagcagggaacacccatcccccacgtctgagcgaccagccgggcaggcgcaagcgcaaagcagacacaacccacagcagaggggccgcaacaaccagaccccaagggaccaacaacagacacagacgcacacttaggaaccaaacaaaacccaccaggacgcgccgacaagctaaacacccacagcaggccaccaccgcacgcccctcgaccaccaaccacaccccaccacacaaaacagcagagggagaggccggcgcagtcaccactcgcgaaggaaagagatcacacacaaacagcagcagacagagggcagggagccgcccaaaaggtagcgatacacgaacgcagcgggccaccaccgccgcgacgctacagaacgatccagggaggccgacacaacaagaggtgaggctggaccgcccgcacgcacaacaagcgaagtgagggaacgtagcagcaacaacgagacacgagaaacacagacaaaacagcgacagacacggaagggacggagccgccgtgcagctaatgcggaagacgcacagtgacgccaggccggaaccgcggcggcgacaccaaa

SEQ ID NO: 485676 - DNA, 439 bp, Homo sapiens
cggggtgatggttcctaccaggtttaggcgtgtcctctgcttttagaaagaggagagaagagcgggaaggactgcgtcttatggctcgagtgccatctcaacctcaacacaacataccaggtagacttctaaggtttttcagcctatctcctgactcctcaatgccactcctgtgcccacccggactctggtcatgctgccctgaacacactcccaggactggatgccttcgccacctgtagcttgcccagacccagcgcctcgagcatacatacacagcattcacgccgtgcttacacgccctcttgtctgagtcccactactcagtcctcattctgcgtttagccatactgcctgcgactacagctttcctctctcttcctccatccccccactctctccccttcactacttcccactcttttcacctctccagccg

SEQ ID NO: 485677 - DNA, 494 bp, Homo sapiens
gcatattctgacatctcaaattacggtgtctccattgactgtaccttcgaccggctgctaagcttatccaagcagattagttaatgcaaaataaacggttacttctatagaacagttttactcttggctaccatctttccaatcactttgcatccagccgcctccgtttgctgtgggaagagtccagctttgcctttcagctttcgctttctctgagctgcactgctctctggggtaatcgttgagggtctggcccgagtctttccactactctgcttcctatacgtggctttctgaggcctatgaagaggatacaccggcccccttctgtatagcaggtttcgtcagtgtctccgaggcaatagactgggaaggccttttgttagtaattctctttttctttcctggagggagggcagctcttcccagcggactttttagggatcttcactttattctctttcaaagacgtcttcatggggggaactttgagg

SEQ ID NO: 485678 - DNA, 238 bp, Homo sapiens
ggggcccccccccccccctttttggggggcccccggcctttttccccggggggggggggggtttgggggggcccctttttttttttgggggggcccccccccccctttcaaaaccccaaaaagggggggcccccccttttttcccccggggggggggggtttttttcccccccccccccttttggggggggggccccccccccccttttccccttaaggggggggtttttttttttta

SEQ ID NO: 485679 - DNA, 252 bp, Homo sapiens
  misc_feature (77)..(77): n is a, c, g, or t
  misc_feature (160)..(160): n is a, c, g, or t
  misc_feature (187)..(187): n is a, c, g, or t
ctcctcctccttcctccttcctcctccgtcctcctcctcttcctcttcctcttcctcctcctcttctccttctcctncttcttttccttcttcttctttctgggacagggtctcattctttctgcccaggttggagtataccggcacgatcatagcccgntgtagactcaaacttctgacctcaagnaatcctcccttcttggcctcccaaagtgctggggattagaggcatgagccactgcacctgggcag

SEQ ID NO: 485680 - DNA, 504 bp, Homo sapiens
  misc_feature (143)..(143): n is a, c, g, or t
ggcacgagcaacatcaaggctgcctgggggaagattggtggccatggtgctgaatatggagctgaagccctggaaaggatgtttgctagcttccccaccaccaagacctacttccctcactttgatgtaagccacggctctgnccaggtcaagggtcacggcaagaaggtcgccgatgctctggccaatgctgcaggccacctcgatgacctgcccggtgccctgtctgctctgagcgacctgcatgcccacaagctgcgtgtggatcccgtcaacttcaagctcctgagccactgcctgctggtgaccttggctagccaccaccctgccgatttcacccccgcggtgcatgcctctctggacaaattccttgcctctgtgagcaccgtgctgacctccaagtaccgttaagctgccttctgcggggcttgccttcttgccatgcccttcttctctcccttgcacctgtacctcttggtctttgaataaagcctgagtaggaag

SEQ ID NO: 485681 - DNA, 304 bp, Homo sapiens
gggtcgactactactactaaattcgcggccgcgtcgacaagaaagaaagaaaaaagaaagatagagaaagaaagagaaagaaagaaaaaaaagacacagaaagaaagaaagagaaaagcccttttaaaaactgttagaattttttaactaatattcaaaaggaaatgcaacttaaattaaaaataagtatttgtataatcagctcttcggcaaaaagggaaaattggctggctaaatcctagacattggctaataattttataaaagagataaatcagaaaaaaatgtcgacgcggccgcaaat

SEQ ID NO: 485682 - DNA, 334 bp, Homo sapiens
  misc_feature (116)..(116): n is a, c, g, or t
  misc_feature (140)..(140): n is a, c, g, or t
  misc_feature (297)..(297): n is a, c, g, or t
agaagctcgtgatcactgaccgtggtgctggcttgtcgaaatcggcattgctagcgctctgttcgtgctgcctgacacgccgtgtcgcgtaagattcctttcttcgagactcgttnctgctcccttccctcgtccttccntccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggttatngttcacccgggccccccgtcttcctccctgtcccccc

SEQ ID NO: 485683 - DNA, 1684 bp, Homo sapiens
  misc_feature (898)..(898): n is a, c, g, or t
  misc_feature (991)..(991): n is a, c, g, or t
  misc_feature (1027)..(1027): n is a, c, g, or t
  misc_feature (1398)..(1398): n is a, c, g, or t
ttagttttgtcttgttcgttttgtgtttttttatgatctgtgttctgtttcgtgtgtcttttgcttgttttcagtaaactaacaatactacaagaaaaagatgacgagaacagcagacacatatcatataagactatgatgtgtaggtattcctactgtcatcacaggctgcttgctggtacttatcagtagattatccgtccgatgcaggtgttgcctacacatgtttgttcgtgtgttgtggatatactccctctggtgtggttcttcctatagtatatttcattcctttgtgacgttgcttgtcaatcctattttctcccctcgaggtgctccagtgtgtggttccccccacttcccccccttgtgtttgttgttcccgcgttggggaaaggtgtttttcgggcgccttttcataacacacgtgggtggagtgtaaaccccgtggtcttgctccttgcccctgttcttccttgtgcctcctgcttggttgtggttagccctcatagaccctgtgcttttctgggcggacaacattttctagggatcccaagatcttcctcccgaggggcaaaaaacacaaagtcctctttcgtgtgagccataagaagcgctgcgccccctgggagaacaccctgtgcgggcgaaagatgtctttttgcggggaggtcttccccagagtcagttgatggccgccctctgtcccccctcctctccagtgcttgatgcacattccttgggggatttcctccattgtgttaatgggtgggataagacagaatggggtcccgccaaaaaactgtcccaaggcaatgttatgagtggtcgcagacacactcccccgcaacagacacggtggcctcccccctgttctcacaagagccgctttagggagganttcctcttttacccacccagtctgttctatgtggagtctgttctttctgtgatttctccgacccctgtcacagaccactcacactgtctctcngtctttagcaggcgctatctcctctatatataggangttacccattggaggttacgacagtagtttggcgattatgtgtgtctacacggtgtggacaggtacggcggaaacacccaagtgggaagaatagacaaaggcgccacaggggggctagtctcgcggcccccaaggaaacactcgtgccctctgtgtggcgagaagaacaacccccgggggcgtccctgtgggcgcaaaatgcagacctccacgcagggtacgccacgaactccggagtccttcctgtagtcggcgacccatccacgcaagactctggatggcccgtccacggtgtggagtcactgggactcacagtctcacaagtgtgtgtcaccgacagagagtgtgaggagatagggtttctttggganatatatgtttgtgcacgtcccgttgtgatatatcgccgggctcccttaaacgcgtcctgtttaccgtgaatggatgtcccgtgaactgacgtgttcgtatagagagggcgtgtgtagaagtatgttaagaagagtccccgtgcttctgtgttctagagcccgtcacttgtagtccacttttggagagaactttctcacttagaatctcatggggtctcctgttgtagtttaggacccgtggtgtcatagagagagtccaaatatgaacccgtctagtgttacgttt

SEQ ID NO: 485684 - DNA, 424 bp, Homo sapiens
ccggagtccgcccgcaaaaagggggacggcgttgttcggggaagaagaccctctgtgaaagaaagagaaagaaaaaagggccccaccagaactccccgcgttctggcgcagcgcggagaggaagagaaaaggtgtatacaccgtgccccacgtagttttcgcggcgccaaattttttctccccgcaaaaatatacacacgaccacgggcgatgtctttcttcgggaaacaacccccgcggggaacaacaaagaaatcatatttttttctcgacgcaaaagtagtgtcccgcgagaaacgcccactctttttttgacacaatgtgtcaactgaaggttttaacccccccccccggtaaaacatttaacccaacatttttttttttttttgttttttttttttggaagggaaaggggggggtttta

SEQ ID NO: 485685 - DNA, 296 bp, Homo sapiens
  misc_feature (78)..(78): n is a, c, g, or t
  misc_feature (102)..(102): n is a, c, g, or t
  misc_feature (259)..(259): n is a, c, g, or t
aaaaacatcatgataacatgcataaacagacaacgccgatgcactcgattagatacaatatctatagaaaactcgttnctgctcccttccctcgtccttccntccccgacaggtcacataacagctgcatcattgaccgcacagcgccatctctccctgagaataaagccgatagccaccctcctccggctccgagcctgcttctgccacacctcgctctcagttctctccacatttccatagagaccgtgtggttatngttcacccgggccccccgtcttcctccctgtcccccc

SEQ ID NO: 485686 - DNA, 820 bp, Homo sapiens
ttcaattggaagattatttggcctctttctgacaatgcccagctgggtcccagccttacagagaagctatgtctggaattagcacacacaagcattcggaatctgactctgagtaacagccagctgtccaccaccagaaatacaactttattgggactaaagtggacaaatctgactaacctcaacctttcctacagacactcacatgtggacgccaaccaccccttcgcctggataacacagcctcactcacatcagctcacacactaccataaaccacgctcagcacccacaataacatcatcccaccccccaccagctccgacccctcaaccccacccccaccacctccaccccaccctctttcactcgccctcacctcatagacgaccgtcccccccatcatccgatgacccccagtaccgatcccgccacaccagccggctgtaaaccaatcaccgtgggcccgcacgcgttctacatccatacataaaggcaagacaacctcccccccccgcccctgcccctaggatcagatcctgaaaccaaacaacttgaccccaatgcacctgcgcccgatgacgtccccccccacttctcttctctgccctcccctgcacccgggtttgaccgtacacaccaggcatgcagcgtgccccacccagtttgaaggtccacacccagcatccggcgacgtacatcgccagcgcccccgccacctatgtccgcgctatgtccaccctgacacaacacatcttttatcgcacgactttacaactcccaccccgcctccgcgccgactaaatagccacctcccccg

SEQ ID NO: 485687 - DNA, 129 bp, Homo sapiens
accagcacgagtggaatcccatagaaatgaggatgtggaacatagcagtaaggcccctgacagcaaggcacggactagatggttaaacaaggaccccgtgattactctttgtgtgtgtccaagacacaa

SEQ ID NO: 485688 - DNA, 150 bp, Homo sapiens
tggactatttggagaagcatccggaagaatttcgatgaggctgccaacgtttttgaattttaactgctgaagagaaccagctacagttgattgtctgcttacacaactgggggcctagctatgtgacttggacatatggtggttctgact

SEQ ID NO: 485689 - DNA, 190 bp, Homo sapiens
  misc_feature (153)..(153): n is a, c, g, or t
tcgcaacgcgactaggattaacatggtaagattaggttttatagaaaggaaatccatttgactgctccaacaattggattttttttttaaagagtaataaactaggagtggactcagttctctccacatttccatagagaccgtgtggttatngttcacccgggccccccgtcttcctccctgtcccccc

SEQ ID NO: 485690 - DNA, 918 bp, Homo sapiens
  misc_feature (11)..(11): n is a, c, g, or t
  misc_feature (123)..(123): n is a, c, g, or t
  misc_feature (143)..(143): n is a, c, g, or t
  misc_feature (165)..(165): n is a, c, g, or t
  misc_feature (175)..(175): n is a, c, g, or t
  misc_feature (203)..(203): n is a, c, g, or t
  misc_feature (205)..(205): n is a, c, g, or t
  misc_feature (223)..(223): n is a, c, g, or t
  misc_feature (237)..(237): n is a, c, g, or t
  misc_feature (240)..(240): n is a, c, g, or t
  misc_feature (242)..(242): n is a, c, g, or t
  misc_feature (248)..(248): n is a, c, g, or t
  misc_feature (250)..(252): n is a, c, g, or t
  misc_feature (254)..(254): n is a, c, g, or t
  misc_feature (261)..(261): n is a, c, g, or t
  misc_feature (270)..(270): n is a, c, g, or t
  misc_feature (279)..(279): n is a, c, g, or t
  misc_feature (298)..(298): n is a, c, g, or t
  misc_feature (306)..(306): n is a, c, g, or t
  misc_feature (316)..(317): n is a, c, g, or t
  misc_feature (332)..(332): n is a, c, g, or t
  misc_feature (337)..(337): n is a, c, g, or t
  misc_feature (357)..(357): n is a, c, g, or t
  misc_feature (366)..(366): n is a, c, g, or t
  misc_feature (368)..(368): n is a, c, g, or t
  misc_feature (374)..(374): n is a, c, g, or t
  misc_feature (376)..(376): n is a, c, g, or t
  misc_feature (390)..(390): n is a, c, g, or t
  misc_feature (394)..(394): n is a, c, g, or t
  misc_feature (404)..(407): n is a, c, g, or t
  misc_feature (413)..(413): n is a, c, g, or t
  misc_feature (417)..(417): n is a, c, g, or t
  misc_feature (425)..(425): n is a, c, g, or t
  misc_feature (430)..(430): n is a, c, g, or t
  misc_feature (440)..(440): n is a, c, g, or t
  misc_feature (458)..(459): n is a, c, g, or t
  misc_feature (462)..(462): n is a, c, g, or t
  misc_feature (471)..(471): n is a, c, g, or t
  misc_feature (498)..(498): n is a, c, g, or t
  misc_feature (504)..(504): n is a, c, g, or t
  misc_feature (514)..(514): n is a, c, g, or t
  misc_feature (539)..(539): n is a, c, g, or t
  misc_feature (546)..(546): n is a, c, g, or t
  misc_feature (551)..(551): n is a, c, g, or t
  misc_feature (571)..(571): n is a, c, g, or t
  misc_feature (583)..(583): n is a, c, g, or t
  misc_feature (596)..(597): n is a, c, g, or t
  misc_feature (678)..(678): n is a, c, g, or t
  misc_feature (747)..(747): n is a, c, g, or t
  misc_feature (788)..(788): n is a, c, g, or t
  misc_feature (903)..(903): n is a, c, g, or t
actttttatcncttcaatgacatgttatttttaaacagcagcggaagtcttaaacacctttacatgcttcgaaatactgttgatgatctgattttcaatactgtattgggtgccattaaaganaccattgttctttgaatcantctctgtgttgctgtgggaaanacggtaaggnagaagcactagaatcatggaggcaaatnantgaaacaatgtgatactnaaataatgctggantcnanaataancnnntnaaatgtngaataaaanatctgaagnatcgctccaatcagtcacngttactangctgcttttnnctgtgcttgcctccntttcntgccgtccttctccctttgnccccttcgncntccctncncccccggcctttcncccntgcccccccnnnngttccntttncgccggtngcggntccttctgtnctttcccagttttttttnncgnggttttctnttcctcttgggttggtatgtgccagtnttgatnctccacatcngcacactttagttcttgtgattgtnctttttngatanacatctcagggacattagtnccaccgactggnttgtgcacatttnngggatggggaaacatcttttcaactttttcagtaggtgttttaacggcgactcctgcgggcttgggagagtcatcagtgtnctcgatttcgcttccctcggtcccgtccgcgtcacttttcactgtgttcttcccgaagctgcccttgtnttgtggtggcggcacaggaagtgggcctggggatgcgtatncccggatgaggtcgtcgtcctcctgctcctcctctgaactaaaaggaggggtcctacacaaatcaacaccgagataggggcgctgttttcgtaacgctttaggatttataatatnaagagatgtgcctct

SEQ ID NO: 485691 - DNA, 414 bp, Homo sapiens
caacagctgacagagctgtaccgtgacatttcccagcaccttcgggatgaatcaggcaacagctactctcctgaagagtacgcgctgcaacaggctgccgatgggaccattttccttgtgccccgggggaccaaaatggaggccacagacttagctggcccaaaggggtggaactgctgatgggatttccttcattcccttttgataaaggtactcccccaccctgagtcccagaaggagctgagttttttagaccaaaaaaggatgcccatggccccaagtgtttggaagttcccaggtgtgttcaaaaaggcttgccctgagggagggctggaatctgttttccctgactcggctccccaggtctttagccccccccttgtttaagctttggtttataaagtgcgctcccga

SEQ ID NO: 485692 - DNA, 717 bp, Homo sapiens
  misc_feature (433)..(433): n is a, c, g, or t
gctgattctagctacgaccttggtctcaaatctccctaataatttcaagtttaaaaagcctctgtctacctagaggacagaaaactaacttttatcaagaacctatggcaacccatatttctaggcttgggataatatcatcaggtcctattttcatcaactgacacctttatgatagctcaggatcactgccttgattgctgcccctgagtcatttgatttctctcctggctatttgtgaaactcccaaggtgcccgcttatactcttagaaaaaaagtcttgtgtttccctctctgacctcctgccatctgccaggcaagaccacaactgctgatgtctcttgggagatcacagctcctctgggtgaaactgtcctatgcccgtggtccccattgctcacaaaattgtagctacagggtttcactgtggtntggcaggatggactcgatctcctgacctcatgatcctccccctttggcctcccaaagtgctgggattacaggcatgagccgctgcacccggctattctttccattctttaagttgaggtatcgaaggccctgtgttagaaatgcaacaaacagtttcttattaatgaaaatcttatcataatctattttttaactcttattttcaagttcaggggtagaaagtgcagtttatgtaggtaaacttgtttcactgaagagttgctgtccgaattgttcatcaccca

SEQ ID NO: 485693 - DNA, 753 bp, Homo sapiens
agcggggggtgaagctgggccgccttcgggggcttgagcttcattgagggtcgtggtccagcgcgtggtactgactggatggcggaagccccacggcggatggtcggacgccccttgctggtgctgggttgcccgcggctgtgtggctgtgcagatcttggcctgtgcggggcctgaccagcattgcctgcgatcatccactgtcggcccgtggtgcctgcgtgcctggtgtggacctcgtgcactttgatcaggcagcttgtggtctctcagtcgcatagagtggctattacaaggagccttgtgaagcgttcaacacgatctatcattgaatcctgatttctgggccttttaatggatgaacgccccaatacctcaactcacctagcaacggcggacggtgcagcataccgacggcgtgctcccccgttggggagcccgtctcgtgcgcggccctgacccgacgagtggttcgagggttgctctgcacctgctggttctttgctggcctgactctcgtctgtcgaacggggttacaccctgtgtcgtgcgctgggcccccacttgtgcaccatgtaacaggaatccttcttgtggcttgacctttgcgtcgtaccttcgttggcttgcttgtgttggatgtcttcatgagatggacctgggacccgtggtccctggaggtctcggtgtggtccatttagcccccttgcggggattccgggctggttttctcccgttcccttccttctctgg

SEQ ID NO: 485694 - DNA, 928 bp, Homo sapiens
gggacatgctgagaactgacggacaactggggacgcagtgacggctgacaactgacggtagaccgacacgacacgaggaccagaacggtggggacggacacgaggacggccggaccgaccacgacacggtgactggtgacggacacgacggactggacgctgacgatgaggcagctgagctcagctacgggcaagcgggcagctgcagatgatgaggatgacgatgatcgataccaagaagcagaagaccgacgaggatgactacgacagcaaaaaaggaacaagttccaaactaaaaaaaaaaaacggccgccgagaacctattcaccctcccattcccgtctcagaaatctacaacgtggatcacccttcgagctagagaggcccgcaccagacccacacgtgggccagatgccaaccgagagatgacacgcgactctcacaacaggccaaaccgcaaaaccatgacgcaattgtgcaacccacggagccaaacaaacaaaaagaaaaccaacacaaattatccacagagcccccctacatattcaatctccttcaacacataccatcttacacacccacgacacaacttaacaccacacgctactactacaacatatcacacaaactctaactactacacacgacacacacaactagcaaccacacactcccaccaccacaacacacgatacacataataaatacataccgagacactcgcccccaacaacccacacagacaaccatatccagaaacacacgataaaacacctaatgtcacccataatattaccataacacaatctccaccatatgactatacaatctatgaccccacgagactcccactatactacactacatccaaaacacggcaaacaacaaaacacacaccccaacgatcacaacaccaacgcaacaacaa

SEQ ID NO: 485695 - DNA, 137 bp, Homo sapiens
ccaagctgattgcctccatagaacgactgtccatgacaagatatctacctctttcctggcaattgaaaatggttaagtattgagagtagttggatggtatgtgaaataaataagagagtgatattggtggtataagt

SEQ ID NO: 485696 - DNA, 159 bp, Homo sapiens
gactagataggtaatgacagagacgtggtttgatgtcaaaatacaggtaccttctacacactgatgacttacagtgagagtagtgacagaattggaaccatctttctttctttttttttggcagggtcttgctctgcactccagcctggcgacagagtg

SEQ ID NO: 485697 - DNA, 741 bp, Homo sapiens
cggaggagtcgtgttgtgcctgaagagcgccagctgtgctcctgggcaccgcgcagtccgcccacgcggctcctggccagagcacccctaggaccccctgccccaagtcgcagcatgaactacctgcggcgccgcctgtcggacagcaactttatgtgcaatctgccaaatgggtacagtgacagacctgcagcgtccgcaagccgggccacaacctggcgcctcgattggaggacatacctgatagcacccgagctacacaatgaccgagaccccggacaaagggccgagacgataggccaagcgaagaaggttgaaaggatgagaagaaacgccgacgcgagggcaaggctaatcgggcgagagcatcaacgcccagaactgagtaccaccagagacatgaagaagcgacccaaaaaagccacctaggcgaagccacaaacagacaagagaggacacatgaacacagcaaagagaaccacccacacggaacggggcagaccgcgaagcaagcaggatacccgctgtggagggagagacacccgagtagacaccaccgagacgtacaccgcacaggaaatagaacccacagcagtccaccgataacgccatacagaaagtaatcccaccgagcacgtaacgcactatggacgaaacagaccatatgagcgaacacacagcgatgaggaccacaatacacagacccgagtatacctcaacaacatggcatggcacataccc

SEQ ID NO: 485698 - DNA, 128 bp, Homo sapiens
acacacagcgccattcaagaacgttgttcaatgcctcttcctaggaacattgctcctacagctaaacaacggctgcagatttggaaaccttggctacagcattgccaaacggtcagctccagtgcctc

SEQ ID NO: 485699 - DNA, 203 bp, Homo sapiens
ggggccccccccccgggggggggccccccccccccccctttgtggggggtttaaaaggggggggcccccttccctccctttcccccccccccgggggggggggggggggggggggcgccccccctccccccccccccctttacacctgttttcccggggggttatacccccccggggggcaaaaaaattttttttttttttta

SEQ ID NO: 485700 - DNA, 225 bp, Homo sapiens
  misc_feature (128)..(128): n is a, c, g, or t
  misc_feature (134)..(134): n is a, c, g, or t
  misc_feature (170)..(170): n is a, c, g, or t
tagtcgactagtgctgtaactgtgatagagttgtcgtgagatctggctgtttgaaagtgtgtggcccttcccctctgtcttcctgctggtccgggcctgtgagaccgagcgtctgttccccgctttgnctccgncatgatggtagacttccagaggtgttcccagaaacngagccagatgtcaccacactcctgaaacagggtggagaatttgtgagccaattca

SEQ ID NO: 485701 - DNA, 174 bp, Homo sapiens
aggcgaagctgttgggaggctggggttgaggcgcatgagcaggagttgtcctgttatagtggagtgctgtaggagccggtcagagggtgagtggggagcaggtgagcgagccaatgagtgcaggagggggcgtcgcgcggcgcagaggagcgccggggcagtgccgtggtggaa

SEQ ID NO: 485702 - DNA, 195 bp, Homo sapiens
agtccaacatgccagtggcccggagctgggtttgtcgcatatcttatgtgacccctgcggagcaccttcgagaaatctcgtctcgacctacgagctgaagctgatcggcgagtctgggctccggaacaaccgtgaggtctggagggtcaaatttaccctggaccaagatccgcaaggacgaccgggaactgctga

SEQ ID NO: 485703 - DNA, 605 bp, Homo sapiens
acgagtacagaggccatcctaaccaggggggccacgtctcaccggtgtatccttcacccatttttctggcacgtcatcctgccggtaaaccaatttaaatgtgtctggttacagtaaaccagctatgacaattaatactaaacaaatggaactagaacccattggaataggtatggaattggttttgccattttccatttgtaataaggatctaggggacccttattaaaaactcgttggaagaccatttcccttaaaaacaaagatgtgaagaatccagagaagatcaaggaccttatggcccagggcgaatttggtaatgcaggagctagaagcttggtactcccttaggaaatacagagctatgaaacaaggctataatccagataccaacaaaattaatggatcattactactttaattaagctatcagtgccagctgtgtatgtataccagatgtggtaaagtaattctaacttaaaaggggaagatatacttgtggtatcaaaatggagcataaggtggctgatactttctccgtatgaccagaagttgaaacctatttagttcagtagggcagcccagggatttttacacaacatgta

SEQ ID NO: 485704 - DNA, 393 bp, Homo sapiens
gccgtagctcatccaactctacaaaaaaaaaaaaaaaaaaaatgcccggtggtggtggtgtattgccttgttgtccccagctgttcaggtaggttgaggcgagaggatcgcttgacccaggaggctgaggctgctgtgagccatgatcatgccactgcactccagcctggacaacagagcaagaccctgtctcaaaaaaaaaaaaattcattaaaaatttatcccaaaatagttccaaagatatttataatttgcctcccaaaaccccgttgtttaacactttgcctgcagaattaggaaaaacaaagggactgtagggtgccgggattgcaaaacccaaacagatttgttccccttggatttttccgaaattatggttggggtttggggccc

SEQ ID NO: 485705 - DNA, 364 bp, Homo sapiens
tgaggagaaagcatgcgatactagtgttattagatgggagatgacttcactgtggactgagcctgaatactatctgtgtagatccgagaagcgtctttcggagtctggatcgggaagctttcctgtaactcattgacatggagtatagctgagttctactaaacatcagattctgctccagtcgtacaggatcatgccccaggaggccaatgtcctacattactgtgtggggaacgttcgtctcagcttcaaagctcgtgtatcttcgagtggcgttgaaccctagtctgatgctgggccactgtttgcataacatgtcctgggaacaactgtgaactgatagctcacagtgtctgttgtgctg

SEQ ID NO: 485706 - DNA, 778 bp, Homo sapiens
tgggagtggggcgtcaatatgaatttaaggattgttttccccagttctgtgaaaaaatgatggtaataataggaatacatcaaatctgtaaatggcttggggcaatatggtcatttaagaccaagtcatatgggttattcagttcataagcatgggatgtattctccgtttggctgtgtgtcatctgcgagtttcttctgtgcttggtagttcttttttacctcctgtggttcaatgtattcctaggtgctgtgtgtgtgcgtgtgtgtgtgtgtagctattataacatgggatggagttcttaatttggttctcagcttgacatgttactgggggtaatagaagagttccacggggtttcggtatactggattcggtactcctgaaacgtttacgtgaactcacttggtcacagtctacgagtcttctggaaggagtctcagggtttcctaggtataccagtcgtgtcctcgcaccacccggttttttttgactttggtcttttgcccaaattgcggactttctttttaacccttcttctcttctggcttgaatttctcggtggcttgggaacgtgcgcccattgctggtgttgccattagaccggtggggggcaggagctgccacattttcgggctttgttcaccccccttagcgggaagtcgtttccccgtttaaccccgcggcactgcaatgtgggggaggggtgtcagcaactctgggcgccaacataggggggggcttcccccacagccatctgttggcgggggctccacac

SEQ ID NO: 485707 - DNA, 186 bp, Homo sapiens
ctggtgtcatgcgtattgcctggtgtacctgcgttgctcacgaacggcttaggtcgatggccctgccctcagtgaggagacaggccatgcctttcacgtgcctgccgctcactgatttcatcctcaagtttccgcacagtgcccaccagaagtctgtccgacacgcctggcagaaggcagccctcc

SEQ ID NO: 485708 - DNA, 121 bp, Homo sapiens
cacgatcccctggagttcgccggataggccgagaaagtgttgtgggaagaacagtttcatttacgccgatcaatatgatagttgaaaatggcattttcggcgctaggtttggtctatggtt

SEQ ID NO: 485709 - DNA, 355 bp, Homo sapiens
cgatgtggtcttgtgcttcccctccctggccatgtgctccccgtgcgcgtgcctgccttttcctcccgcgccacctggtccgacgcgcaacccctgctcagcagtcacagaagcatgtgcccagccaccttggtctttttttgggagtcaggggagtaggagaattgtcttccgagaaaaatacataagctagtttcttgacctgtaaaggtgataatctttcatacttgaccaaaagttcccaaataaacttcccaaaccaattgttcaaaaagcttgtgattttttgtctcccccttcccaccttccatgccatggagcatgcccttgccagtggggcattaggtgtgggtac

SEQ ID NO: 485710 - DNA, 108 bp, Homo sapiens
taacgccacgatgattgcggcggcagcgcagctacgcgggccgcgtggtcgccagccaaaattcgacctcggtgccggcgggcgtgtcgcgccagtggcgagtgagca

SEQ ID NO: 485711 - DNA, 375 bp, Homo sapiens
gaaagaaagaaagaaagaaagaaaatactgatatagtaagtgctcaataaatattttttggataaattaacttgacaaagccaaatatatgaacaaaccacatacacttctaccgccctatacccaaaaagcccaaacaaagacctaaaaaaaaataaaaccgctaagaattctcaatgataacatccataaaaagagcaagaactgagaaagcaaaaccaactagaatagaagcaaaacctgtggatctgataaagacccaaatagaaaacctaacaatgaaaaataaaatcaacagcttacaaaactcaacagatgagctgtggtgctcagacccactgtggagagcataactgacaggccagccgcttgccc

SEQ ID NO: 485712 - DNA, 176 bp, Homo sapiens
  misc_feature (46)..(46): n is a, c, g, or t
ggcatcttcgggcttcgtgattactgcagcctcatccaaatggtcnatgctgcagcaaagcgctacaaatagaaagcctaccccgaaagcacattgcaacaggctgtactataggaaacttcagtgagacaaggatgccatcaaagctataggacatctttactggacaatattgc

SEQ ID NO: 485713 - DNA, 218 bp, Homo sapiens
atgaaagcacaaacgcttcgctgcctgtgctgaaggatggatgattgcatgggcatacggatggctggatggatcgatggattactggcaagatggatggctcaatgtttacatagatggatccccattcccatggcacacctaattaataggtgtacggacatgtggatgaacatcgaatgtggacttcaatatatggacccatgtactatgcacaa

SEQ ID NO: 485714 - DNA, 773 bp, Homo sapiens
agtgggcccgtacatctgctgctctgtgtcagccaatggagttcaagaacggctacatatctcctgtgaaggcacgaagccgatccacacgggagctaagtgccgtgccgggtccccatcgtgtgtgctatgaagatgccgaccatggtgcctcctgagcctcctgatgctgtgccccagctgagcgtgagcctgtgctgggggagggggagatggctgggtgcctgtgcggctgtgcgcttgcctgcactgtgtgcctgcctgtgtggtcgtggtgacccactgacctgtctcggtggacagctggcatcctggagagaaccgatgcctgcggagatgtagtgtgcaaggccttccagcggacggtcgtaccaaccttgaaaccgacacaatgctgtctgcgactcggacggagcaagccctacacagttgaccacggtggttggcacaagaccaggcgggctatcaaaagacggcaaggggacactgcattcgaaggctagccaacggttgccgcctcaccatttgactcgggtggcctgctgccagccaaatgcacgcacatataaaactttggttccaccaacatggattgggccacggacgggcgtttcttaccactgggtcgccggcgaatccagcgttcaagaacacgctacaccggttccaggcagcagagttgggcgacttccaacagcgcggaagacggggcccccctcatcccagaattgctggaggcaacattggtggaaggggcgatcctatcccagccc

SEQ ID NO: 485715 - DNA, 400 bp, Homo sapiens
  misc_feature (51)..(51): n is a, c, g, or t
caaagcacccaacttacacttaggagatttcaacttaacttgaccgctccnaaaaaaaaaaaaaaaaaaaaaaaaaaaatttttgggccgcccgggcccttggaaaaagttttttaagaaccatattcggttggggcgcgccggcgccccaggtagggtaaggttgacacattgcggcaaaaagcgtggtccccaaaggagaaaatccggcgccatgagacaaggtcgctggggttctctccaccaaataaaaaaaacgcgccggggggggaacaccggagggcggtctctggacacaaatcccaagaggggatgtcctgagagggtcatacacggggtttctatcaccggggaggtccaaacgcagacctcggatataaaataacccccggcgcgggca

SEQ ID NO: 485716 - DNA, 1081 bp, Homo sapiens
gggagtgtgggccgaagcagtgcgctgcggccgcggaagtatccccaggaacatccccaagaggagctggaaaaagcctcatccccaggctctgcagtctccacggaggaagaacctgatgctagtgaacgtcgttgcaggggccccctgggcatgggcctggcccagcacccgacatcctttctgggacctcccaggagtcaacgccaggaccctggggaaaggagtccacgagggactgaggcaacaaggcagggtcaggtggcccagtctggtgcccaagccccgaggcagggtcccagatcgctgtgcccactgtcgaaggcacttcctctgggctggagtggctactgtggcttcactacctcgaacggttgccagagcccggctgcccattgaccctgccactgagtgtggccgacgacttacgcctagtgcccccatatcttagacacgtagcagacggctcaggtccaatgcatgcatgccactccacagaacactggggacataaattaggacctggccaaccttcatggtgaggcacgaaggacttcgcagaaggacatgagggtagggcccttggggttcttagcattacttcgcagggtgcccaatatccaggcgatgcaaaatggcagagtacccaatacagacattaggatcgcacgaaaatcgccgacgaacggaacggcgtttccatggggcgagaacgaaagactggcaggactagtcagcaatgacgtgcatgttctttgccaggtcgggtgtgacacaaagcacccatacagcccaggtagcacccggggaaaggggaccccgggcaccccgtttaccatacttgccagcgaccaaccactgggtgggcgacccggagaaacgacattagagggaccgcacagggtgacgagaaccccagtgagcgttagggtatctggcccgcaagaaaaaacgcgagagagttggaagcacggatacggcgctggaaagaggcccacaagggaaaggggaagggaccagcaacgaccgaagaaggcactcactggacaggaccacccaagagacaccaaggggagacacg

SEQ ID NO: 485717 - DNA, 575 bp, Homo sapiens
  misc_feature (446)..(446): n is a, c, g, or t
gcacgagcttcataagaaaagtaccgaactcaatcatgaaactgagtaatttaacgatattaaaccttcaatgtaatgagcttgaaagcctaccggctggatttgttgaactgaaaaatctgcaattgctagacttgtcttcaaacaagttcatgcactacccagaagttattaactactgcaccaatcttttacaaatagacctatcatataataaaatccaaagcttaccacagtccactaagtacctagtaaagcttgcgaagatgaacctttctcataacaaactaaattttataggcgacttatcggaaatgacaaatttgaggacgctgaacctaagatataacagaatatcatcaattaagacaaatgcgtctaacttgcagaacctttttttaacagataatagaatttcgaactttgaagacactttgccgaaactnagagcccttgaaattcaagagaatccaatcacttctatatccttcaaagatttttatccaaaaaacatgacaagtttgacgttgaacaaggcacagttatcgagtattccggagaattactcaccaaac

SEQ ID NO: 485718 - DNA, 282 bp, Homo sapiens
  misc_feature (65)..(65): n is a, c, g, or t
  misc_feature (81)..(81): n is a, c, g, or t
  misc_feature (113)..(113): n is a, c, g, or t
gtaccccccgactagcccgacaggagacaggcaggagggctggggctgcactcctaccctcccancagaacgcaccccacngggagagctggtggtgcagccttcccctcccngtataagacactttgccaaggctctcccctctcgccccatccctgcttgcccgctcccacagcttcctgagggctaattctgggctagtcgggtctgccgggctagtcggggctgtcgggctagtcggggactgtcgggctagtcggggactgtcgggctagtcgggga

SEQ ID NO: 485719 - DNA, 225 bp, Homo sapiens
  misc_feature (17)..(17): n is a, c, g, or t
  misc_feature (20)..(20): n is a, c, g, or t
cctaaagtggaactgcncgnacccgtaggaggagaaaataataatgattctgctagtagtggcgaacgaacgtggatgaggctaaaccgtgtgcatgtgatacctggtaggggttgtgtgtgcggtgttgtgggccccaattggcggtgactaccatcatcgtgctcgtgtgttgttgttaggtgaagtggtttggaattacctgccggagcagttccacttagg

SEQ ID NO: 485720 - DNA, 476 bp, Homo sapiens
gccaaagcaggaggcacagccagtgggtgcactgaggcgcagcacttctgtgacattcctccaatgatgcgcaactccctactcgtgagaaaacgtgagaccaacccaaacggggagacattctgcagagtgaccagcgcttcaaaagtgtcaagtttatgaacgacacacagattgaggggctgcaacagattggaggagacaaagaagacagttcagctaaatgcagtgtgagatcctggaacaaaaggccaggaatggaaaaactcgtgatgttcaaattagggtaatcatttagttaatggtagtgtatcgaagttaaccttctgggtttgatcattgaactatggagccgggcatggttgtcacgcctgtaatcccagcactttgggaggctgaggtgggtggatcacttgagcccaggagtttgtaaccagcctgggtaaaaagacaaaaccccatctctactgaaaata

SEQ ID NO: 485721 - DNA, 95 bp, Homo sapiens
gggtttgactgggtcccgctacaaaccccaagtcaagcttaagttgaaatccttgtaagtctgtgctcttgcctctacctgcaggacaacacata

SEQ ID NO: 485722 - DNA, 697 bp, Homo sapiens
  misc_feature (18)..(18): n is a, c, g, or t
  misc_feature (24)..(24): n is a, c, g, or t
  misc_feature (26)..(26): n is a, c, g, or t
  misc_feature (107)..(107): n is a, c, g, or t
tgcacaccacatacacantcatancncaccacacaccacatacatcacatagcacacactacacaccacacacaccacatcaccaccacaccacacacgcatcacanacacatcatacactacacactacacaatcacataccacaccacacaccacatataccacataccacaccacacacacacacacaaacacacaccagtacattatttatcttctactttacactctaagggagggtttgacttagtctaattcactcaataaaatgaaaacatcctttcctgattcactcactcagtcgcctcatctttgtttgcatccccactgtgagcccatccgtttgcgtttgctgggactgagtgtagacagatatgcgggcagtgtgaggaaggcagggtgtgtctgggaaggttgtgctctagaactcaagatgcaaatcaggcccacctgtagaacttgctttacttattcatttggagatggatgtcatgctggcacccaggctgaagtgcagtggcacaatcatcacccctgcagcctccaaccagcctccagagtagcttagacaactggcgctagctacagtacctaggagtacagaagctaggaccaccaggagcagctatttttcgttatgttgttgttttttgttttacgtagagacaggtcttgttatgttgcagtgacatcctg

SEQ ID NO: 485723 - DNA, 116 bp, Homo sapiens
catgggcaatctgtaagggctgtgggggtggggggaccagcagactgggggcgggttgaatgtcagctgcttgaagagaggtccatggtgctagcactgaggccccgggagaactg

SEQ ID NO: 485724 - DNA, 153 bp, Homo sapiens
cggacgagattaccaataagataggcgatagaatgaacctggcgcatagatatagtacgcagcaaagatgaaaatatatcagctatatagcaggactatcctatactctgcatatgataactagagtacttgcagagagcaagctagacccga

SEQ ID NO: 485725 - DNA, 350 bp, Homo sapiens
atcgtcgacccggcgtcgccacaccatacgataaagcaagacattttataacgataccagagtcactatgtgggagggccgtacataacgcattcgaaatccatgcagtgcacgctatattttgctaagtgttggaaacgcaggtttcctcctttacaaaaatcatagacacggttcactacaattgatttagtcacgaattcctagactgacagaacctaaacaaagcaaatatgcacaagatataaatatatgctgtatatgtcatgtaattcatttaggctataatacattcccgtatttgcgcattttcaataaaatgtctctacatacaactaaaaacaaaaaaa

SEQ ID NO: 485726 - DNA, 127 bp, Homo sapiens
ctctctgcttatttggctttctgtcgagtatcacaccagtaccctgagtgcagttggcatgcccgcggttcatggtccttgggactcacaatggtggctcagaagactgctctccaggtggccccgg

SEQ ID NO: 485727 - DNA, 232 bp, Homo sapiens
cggggtgtcgactctagacggctcccggctcacaacaggcacaggcaacaggtcattcactagatatctacggtagggatctggctttgacttgggtaatgggtctgtcctcaaaagacttttttttttttttttttttttttttttttttttttttttttttttttttttttttttttttttttcaaaacaaggggggggcaactattttaaacaaaagcaacacccacca

SEQ ID NO: 485728 - DNA, 679 bp, Homo sapiens
atctcagctcactgcaaccttcatctcccagagctcaaggcaattctccgtgcctcagcctgcccaagtaggctggaagctacagatgtgtaccacctgcctggctgattttgtgtattctttaatagaggctggagttgccgccatgttgaccatggctgtgtcttgtaactccggacctaaggtgatccagcacatctcagacccccagagaacgctgggattgacaggctatgaactaccatgtccgcgctgatagtgtaatgcttgcagcgcaagttttgaagcatccggtcttgatatggacagtgtacctctaagtgtcgaaatcgtgtgagagttcaagtgttcgctgaatgagcaagagagcccttagggacgtgacgtacaggttgtgggagactggggcagtaacttgggcacgtgagtacagggacatgagggaagggcattcctggggaagggaacaggcatcagcgaaggcgagagtggctcaggcaagaggagtgtgatgtgcgtgtgtgggaacagtgaggccctgccttgagtgtccactagctcgatggcaatcatatggggccgtgtctatgcaggcgacaactctgtttcagtggaaatgccgttgcgggttcacacacgcagggagttgagaccctgctccatgtacaaaagttagcta

SEQ ID NO: 485729 - DNA, 1180 bp, Homo sapiens
caaagctcctacccgagtgtgcatgcaggatcgccccggtccgggaccccaggcgcacaccgcagagtccaaagtgccgcgcctgccggccgcaccttgcctgcctgcgtgcccgggcgccggccccgggttgcccaccctgccctgcctgcccactctgcccagtgtgcgagttgctagccccgcgcgccgggccatgagagccctgttggacaaacctcggtcatttgtcaggcacagcagcggtagacccctgcttctctaagtgggcagcggacagcggcacgcacattttcacctgtcccggcagacaacagcaaccaatctgcttgggagaacccttctcccttctctgagcaccagaaagatgtcgaagtgggtattccacagacgagaatttccgctatctcatctcgtgcttcagggccagggtgaacaatgtacatccaggtggagcctgtgctggactaccttgacctttctgcctgcaaaggtgaaggagcagattcagaggacagtcgccacctccgggaaccatgcaagcagttgaactgctgctgagcacctttggagaccgggagtctgggcaccttggcgttggactcgggaattcgtgggaggccctccgggagaaccgggcaggcctcttggctgccggttacttgaacccttggagctcaccggacttgcccttctcaaacggtttggagaacgggtcatgatgcaatatttccaactgggtgaagccttcctttaaaccaatctggtgggacaagcttctaagttgaagacgtcttggataaagtgcacttggaggagggaacttgttgcacattgtgagcagaacggattgctgctgtggacaacaagggggaatgcatccgggtgtggaggagactcctacaaaggggtgtgtgggcacgcaaaacagtggtttctggcttgtgagtgattggttttaacggaggaaagagaatcgtcttctcgacaattgaagagtcacgatttgttctaaacgacccagaatgtgtgatttttcaagagatgtgcgcgattgcgaggaaggataattatcgatgccaacatctatgatggtggagctggataatgaaacacacatagcagtgtgtttgagcaccaacacactgaatgttttaatagcgcagatgtccgcagatga

SEQ ID NO: 485730 - DNA, 110 bp, Homo sapiens
aacctcggcccgtattctatacgaaagcgttaagctcaacatatttaccaaccttttcttaattaacctcgccacccccttctccccgagcgatgtcgtcattagggttt

SEQ ID NO: 485731 - DNA, 273 bp, Homo sapiens
ctagagtatcccggctatcacataatacagctagggctaaggttttaactatcttaaagcccttcctgatagaccctaatacacacagatctctcaagcttcatgtctttgggagcacgtcatctgtagtgtactttgcttgcctaagctttcaccagatgaatcgctttgggcctggtcagtattaatgtttacatattagcaaaccctccacggattgatggctattaccttgagaatcagaaaagtcaggcaaagaaagacttctatcta

SEQ ID NO: 485732 - DNA, 367 bp, Homo sapiens
  misc_feature (97)..(97): n is a, c, g, or t
  misc_feature (123)..(123): n is a, c, g, or t
  misc_feature (213)..(213): n is a, c, g, or t
  misc_feature (228)..(228): n is a, c, g, or t
  misc_feature (234)..(234): n is a, c, g, or t
  misc_feature (270)..(270): n is a, c, g, or t
  misc_feature (343)..(343): n is a, c, g, or t
ttttgagacaggctcacccaggctggagtgaaacagcgcgatcactgcttactgcttactgcggcctcggcctcccgtgctcgagtgattctcccgncccagcctcccgggtggatgggactncaggcatgtgccaccaagcctggtttttgtgttttttgtagggacggggtttcaccatgtgtcccaggctggtcttgagctcctgagctngggcggtcctcccgnctcggnctcccaaaagtgctgggatgagccaccgggactggncccacttaatggggttttcaagaggttgggagcaaaagaatgaaggggaggaagagagcttcccatctttttncattaaccggattaacttaaaaat

SEQ ID NO: 485733 - DNA, 374 bp, Homo sapiens
  misc_feature (168)..(168): n is a, c, g, or t
  misc_feature (257)..(257): n is a, c, g, or t
  misc_feature (374)..(374): n is a, c, g, or t
acgcccgccaaggtggccaccgtcatcaacaacggctcccccaccatcctgggcaagcgcagctacgagcagcacaacggggtggacggtctggcaaaccacggacagaccaggcacatgggaccaagccggaacctcctgctcaacgggaagttcctaccccaccanaagtgcgccttgataccgggggggactccctgcccccaagttcaagcggacggcggattgaactgggatcgacgaccccgagatgacgntgttctacatgggaccacagagagagaccagagaagatccgacaagactgctcttcatacctcgagaaaccaaaagcgttgctggcccgaccgggccatacaaaagcccattcgccn

SEQ ID NO: 485734 - DNA, 671 bp, Homo sapiens
  misc_feature (164)..(165): n is a, c, g, or t
aaactggtgcattcaagacagcgtcaacttcattcgaagccagtaaccacaaattcttagacagaatgtcaccatttggggctccttggtaccagtggaatgctacaaagttagccttggaaagacagatgcgttcatatgtaaatataagaagtcgcactctnntctggaaactgtagcaggcttgctgccatcagccgggttcaggcccttgtaagttagctgtacagcagaagtttgctgtctctaggattcatatagcacccacagagctccaagtaaccaaattcccccaaagacaggaggtgtggctgatgggtacacatgcttggtaagagtttctgctttatattctaaagtacttaatgtttttgagaacacaaagttatcggaattattttgtttttttttttaaaaaaggggaaaaccgttttaagttttatcttctgtcagaatgtgaaaagttctgcccagtttctgagcaaaaaaactttcccaagttttttcaaaaaattaaaagggttttcaggggttcacttaagtgtatcacaatcaacaccagacgggatattttaacctattcaggaaatttttttttccgcgggaaacaatgttaaaaaacctttatgtgtacttcttttgatattaacttgattttgagcctgtaattt

SEQ ID NO: 485735 - DNA, 376 bp, Homo sapiens
  misc_feature (31)..(31): n is a, c, g, or t
  misc_feature (122)..(122): n is a, c, g, or t
  misc_feature (214)..(214): n is a, c, g, or t
  misc_feature (228)..(228): n is a, c, g, or t
  misc_feature (248)..(248): n is a, c, g, or t
  misc_feature (295)..(295): n is a, c, g, or t
  misc_feature (310)..(310): n is a, c, g, or t
ccccaaatagctcccccaggcccctcggccngccccatccatggttaattcctgtcccaacaaacacacacgggtagattgcctggccctgttgtatgtggtagggaccacagatgacccgnccctggtcactccctccctgcccaacattcagtcctggtatgtgaggccgtgccgtgaagaagaactccctggagctacagggacagggagnccatcattccctgncctgggaatccctggaagancttcctgcaggagtcagcgttcaatcttgaccttaagatgggaaggntgttctttttacgtnccaattcttttgtcttttgatattaaaaagaagtacatgttcattgtagagaatttggaaactgta

SEQ ID NO: 485736 - DNA, 847 bp, Homo sapiens
tttattatttctcctctttactttatgtgttattttaaatttaggtattttgggttagcataaggaacatttgtagcgaactaggatcagtatgccgtaggatttacagaatattttcacatgcttattttcatcatcggcagatatttgatgaatatgaaaatggaacatttttgtgtcatcggtttactaagtttatgatgaaatacaatttggatgtccaaggataacctgattgtaccaattttagaagaggaagtacagaatttagtttctggggaaagtgaagcatgatgggaatcatacgacccatgtactgatcatataactaacattatgccctgtatttatcattttaaacacatcaatcttgtgttcatattatggcttctttgcataatataggtttatgtatgctcggattgcattttaaaaagggaattactcctttaactctttctactatgtttcgctgccatcgtggcactgttgtgttttaacactgatccctcctatcctgtgctcaaggccttgtatataatacgatttcgcattcttggtcactcctaaatcacaataggctcattattttcttagttgtatgtcctttcccgcctttttgtcttttaatgatgcaagatccatcactgtctaatcccctttctgatctcgttgttgttcacttgagcccccatctcctattctttattacccaacgccggaatacgctacttatctttaaattcatcataccattctctttttacttttaacatcttatccgtttcgccgaagctgcataacgttgctatgccaccttagaaaccactcgcacgataactagcgg

SEQ ID NO: 485737 - DNA, 928 bp, Homo sapiens
ctagaacgctatacacagcaagcaacaagaaaccgtcagtgaactgaacgctgttccccaagttgtgcagcatccgacgttgtcgtgacatggtccgcactcagtgtagtggtgccacattacactagattttcgtttagtgggttctgaataagctggcgtggctccctagtgtttcccggagcacacgttcatttaattcgaagtgtatatctacaccacctgcggttgtgaaacagcacaatgtttttggtagccacgtacctggctgctccagggcgcccagcaatcacggggtccaattctgtcccaacagggctagccatgccatgtcaagatgtggctcagtcgcagttgtgccccaaaagggttgtatttgggagtgttggaccctgcctatcacgggccccgaagtcattaagtcatgcgacccgcacgggggttgcggagcccacgtgttagaacaaacaggtaaaattgaaccaccagggtggctaaagcctgcattgtcacacgcaagccccgcatgatctgagcaagtcgctcgcccaaacccgctggttcaatcctcctctctcttgtctgcccaccagggcagaatatttcacagcaagcggcaatgaataattccacacgtagaggcttgaaaaccatcttttcttaaagaacattattcccttgctcttgcagcctcatcatgggtatcgtgttccctggcgaaaattctccctgaggtgccctgcaccaaccggcacatacccaccatttagcgcgtgtatcttccacgaccctgtagattcttgttatgaggacatcacctatatgttgcggcgccgcatcaactcgcatgcgccccgacccgacgccaccgagtcattgagcgagaaacgaccgcaaacttcgtatacatacaccacacaaagcaaac

SEQ ID NO: 485738 - DNA, 292 bp, Homo sapiens
  misc_feature (229)..(229): n is a, c, g, or t
acttcattcgcttcacatacaccaatcatgctctatctcatccgctgtacacatcacacactgctacacatctcactgcctagcatacctacatacaccacgcttccgctgctacctcctacctagcttccttccatcgcctcaccatccctcgccatccacaacatccaacaaccataccacacaccaacaacactacggcggccgggcgggttgtttttgttgtttnctgctagaccagagatcggcggcccgccgcctccttctttaccataccaccgccacggggtgg

SEQ ID NO: 485739 - DNA, 662 bp, Homo sapiens
tatatcgttaaaagctactgtgtcccgcgaccattgacaggggcgttgtctagatctgcccgccacaattgtggcgacgggaaatcctgttcacgcaaagcggcgacacaacatttacaagtaaaccccgttccccaggccgccccccctcctacagtcaggaataaaagcccccttgcacagcaccaacaaacctaacgccgtgtggtgaaacaaaggcagtgcgaccacagagcacaacgcgaggcacaccgcgtgttggccactgccgcccacgggcagagaacctcctctcgcggtccccgaaggaggggttcactcccccccggacagcccacaagagcaggtaccgcgcgtttgtgacaaggttagctaggatggtgtgcactcccacccgccgccgcaatgatatgtggtgaggcatctatttgttcctggtgaaaaccagcagtcatcatgtacgaagacttgccgcctaggacacaaagggtcttatcatagaatagtctttgtgcctcatcactctgacacggggcaccacctttctgtccacttgatttctgtggggagtgattgagtttttaaagatttcactcggcacaaaaaatcagtgttataacccagtggcccacttttggaaaaaaacctctgcaaacattaca

SEQ ID NO: 485740 - DNA, 1239 bp, Homo sapiens
gcagcgcaggttgtccccgtttcccctcccccattcccttctccggttgccttcccgggccccttacactccacagtcccggtcccgacatgtcccagaaaaccaagcaagcacagcagcaaccctgcggaggcagaccggcgcaggcagcaagcaggacacgcaggagcaagcaaggtcatctgcctgagcagagctgaagcaggcaaagctcaacaggccaaatacccaagcctaggcaccacaacgcctggcaggctccgcactatccgtccatgcacagcagactccagcaaagggcaaaaagtcctatagactccaggcagcactcacacccatggccacaagccacagcatgcacagaatacgcagactgcacacagtgcacggcaccagacaaagaaccctggctgcacctggatgcatcaccatccaccaccccaacaggcatctgccccccagagcaaagtccatcagcacggtcacacagacaagacacgacgccgctggcacaaagctcgacctgactgcatgaaccgggcgacctctgaccagacaccatgacgcacgcccacacccatcccagccacccacaccgcggatacctgacgcaagagacttacatgaacacacacacccaccgcaccacaacgcacaaccaaaaggaaatacaagagaaagacgccacccagaacaagaagacacaagacaaacacagacacaacccaaacccacatcacatgcaacagcgaaagctaccaaaaaaccaccatgcaacaaccacaacgcagacactgcacgacaacccaacccaaccaccccaccacccacccaaaccgcacacacacccccgcgcacaaaacatacccacaacgcaagcgacaaacactacaccccagcaaaacaccaggaaacaaagcacaagacgacacgcacaaaacggagaagacagcagacgaccacaagcaccgccacgccccaacacagacggcgtcaagcacacacagcgccaaaacaaacacgaccgcacaaccaaccctatatcgagaccccaacaaagcgaccgccgagcagcacacatgcaccacgacagagacacggaacaagccagccagcccccagagccagcccaaaaccagagccacagcccacctcgcgcacgcccagcccgtagccccaacacgccacacccaaccaacaacacagacgacaccacgctaaccacaacaccacagcaca

SEQ ID NO: 485741 - DNA, 691 bp, Homo sapiens
agcggatatgaaaacagtctttttataccgcctttatcctggtgagttgtggaagtccggggggtctatatgtgtgtatgcctcttctgtattctcgtgcaggagagtagaggctttcttcttagagtgcatacagccgagacccaggtgaacacgctgactgtgaacctgccctagtatccgtgagtctcggatgctgtggcactgaggggatgcagacgaaatacttagcgagaggatccttgctacccaagcgtctacttctcctacctcaacaggggtccagggttgcagtgaactcagttcttgcgcccttgggtgacggacttcatgagatgatactgaatacgctagagctgatggggaggcgttatgactaatataggcccaggcctccttcccttccagtctctgtcctaggagcatacggcaggagcaaatcttagaggtagcagtctgactgctgatttctgcttatgatttgtcaaagccgtcgtggggtcaataagaaaatcggggtgatggagggggagaatgcccaggactgggagcaagtcgtctcatgctcccaggggttttacaaccgaaggatagtatgcgaaggcacaatgctggtcgtaagaacttacacagtccccgagagggatactaagtatatcctggcttggcaagaatgaggctcccatgccag

SEQ ID NO: 485742 - DNA, 942 bp, Homo sapiens
  misc_feature (778)..(778): n is a, c, g, or t
ccctcgtttggcggcggcggcggcttctttgtctcgtagaagagaagcgagacgcccattctgcccccgggcccgcgcggagtgggctgggggaggcgccgggaagtcgacggtgccggtcggctcctgcaggaggccactgtctgcagctctcccgtgaacgatgtccgacgtccgagaccgcacgcccgtgggcggcaactccatcggcctagggtccttcctcgcgggccgcgtgtgccctttcccgcgtggtagcacatgcttgggcgccatagctcctgggtcgccgtcagcctggagctcctgccgcaacgatgcagtagataggtggcacctaggcgcgcaggtgggccagcacctctagcaaggaacaagccactcaataccctcactctcgatggggtggcctagtgcatgggagtgaccgcgtcaggtgtactagaacatgcgaccgagaatggcacaaaggcaccactgggaagtgccagttgctaagtgagcaaaagggcaactgtccgtgtagctgagccacgtctggcataagcaaactcgaaaacttgatacatgggcagatgggcggtagtgacgaggtccatgtgggggcacaatggacttggagagttggcgggcctccactgtgccaaggactcccgatgtggacctcagcctgtcttctcgcaacagcggtataagccacccattcgtgcgcgcgcatgtcgggtagggcctacgtgtgagtgctagtgaccctgctgagtgtaccaaggttcccagnagcgaggtgtgttgccctgcttcgtatacgggagggggccccaatgattggtcgtttccggggtccaagggaacgggtgcgccacggatgcgaactgcgtgacttgatggcctcgcatggtccctgtgcgcgggccatgcgatgaaaccccgtggtgcccgcag

SEQ ID NO: 485743 - DNA, 556 bp, Homo sapiens
  misc_feature (46)..(46): n is a, c, g, or t
  misc_feature (50)..(50): n is a, c, g, or t
  misc_feature (64)..(65): n is a, c, g, or t
  misc_feature (79)..(79): n is a, c, g, or t
  misc_feature (85)..(88): n is a, c, g, or t
  misc_feature (92)..(92): n is a, c, g, or t
  misc_feature (97)..(97): n is a, c, g, or t
  misc_feature (99)..(99): n is a, c, g, or t
  misc_feature (103)..(103): n is a, c, g, or t
  misc_feature (251)..(251): n is a, c, g, or t
cgagacatcagctcacggcaactccgcctcccgggttcaaatgatnctcntgctcagcctcccnngtagctgggattanaggtgnnnnccancacancnggcnaattttgtattttagtagagacgggatttcactatgttggccaggctggtctcgaactccggacctcagaggattcgcccacctcagcctccggaagtgctggggttacaggtgtgagccaccacacctggcctcataatctatgctnttgatgttgcttttgtgtatggaacctgtttggtagaaatactgtataatggtttgctgctgtccatatctttctgactcactgttcggtggcatcacttgaaattggctgtggcgagagtatttacaccatgaggactggcaatgctataaatcagtgctctccactggagaggttcaacatttaccagcacactactgcacagcggtgcacacagatggttttgggatactgcacaatcacacttcacacatggtcacacataggcacagggactcacagaggcagatacaagtgtgcacaac

SEQ ID NO: 485744 - DNA, 160 bp, Homo sapiens
cataaaggggatctacgacctgatccgccacggggacacacaagctactatatgctgtgaattccatcaagaagaaagtcaacgacaagaacccacacatcgccttataagcccatgaaggtcacctcatcatgaactgtctggccactgttctttacca

SEQ ID NO: 485745 - DNA, 107 bp, Homo sapiens
  misc_feature (1)..(1): n is a, c, g, or t
natctgtattgagacagagtctcaatccgacaccctggctgagtgccgtgcacgatctcagctcactgcagcctccacttcccaggtttaagcatttttcgtgcctc

SEQ ID NO: 485746 - DNA, 165 bp, Homo sapiens
acgcgatggtagtgcacctgtgcgatactcgcctggggaacagcttcgcatcggtgacaccgtgcagactgaaggcgactccagcgtcactcttgaattcgccgacgcctcgctgctgcagcagcgcaaggtattccctggctgcgccctggaccagactcagcc

SEQ ID NO: 485747 - DNA, 297 bp, Homo sapiens
cacgaggtgtattgaccgctgtgtttgctccacgtggaaccatccatccccacaagttgacatagtgtctccccctcaacagttgccggaggaacaaacttccgtgtgccctgacacgacataagttgaaccaaacttgcattcaacggttcattaaaaaccatggcaagggccggaatgaaataaactaccctgctggagtcatgggagtcatcaccactgacaacacgggaaataatttccatctgatctacggcaccaatggtcgctttgccgtccatcataatagaccagagg

SEQ ID NO: 485748 - DNA, 169 bp, Homo sapiens
  misc_feature (124)..(124): n is a, c, g, or t
cgatccccaagcagttcatacagactcaaacaaatcaacagggatatactagtggaaaacacaatataaaactaaaatgccattggcttcgtttaaattgggttaaagagcaaaacatgtaacnaggcagaaagtctgtttcaaacaaattaaaaagctatgtgttttt

SEQ ID NO: 485749 - DNA, 579 bp, Homo sapiens
cacattaaggaaggggcaccttaccttctgccctaccaaagggacggcaagcttatgagccaggtgcccggggctggactgctcactgggcttgtctttttcctggatgttcgaaacattattctaggcaaatcccactatgtattgtatgggttggtggctcccatgcagccccaaatgctggttacgtttaataaggagctgcggccattgccagtgtctgtccgtgtgggccaggcagtgaatgtggtgggccaggttggcaacccaaaaattatcacagggttccaaaggcatacaaccccagtgttgttggcccacggggaacgggaaaaattggcccctaaggagttttttcctgttccccccattttggaaggttttgtaatccttgggaagacccccaattatgatttttaagtgccccccaggggttttgaactgcagttgatgttatcagcaggccatgcatcctgctgccaaggggggacacggctgcaaatttttgggggaattgtcgcctcctgtttttttgttattgagtgaaaaaaggttgttcaataaagatttttttcccca

SEQ ID NO: 485750 - DNA, 263 bp, Homo sapiens
acagagtatcagcaagtgagagatctgcctctgtagatcaacatcagtgtgatttatgtgtctgagacacaccccagatagcaggttacgccatgtcaccgagccccattgattacccagagggtcttagtcctggaaagtcaggccaacgagcaacgtttgcataatgttatctcttaagtattaaaagttatattttctcacagtttacacatcatgtttttccaaaatattttataccaaggtggctaggtataccatta

SEQ ID NO: 485751 - DNA, 296 bp, Homo sapiens
caggcgtatcacaaggtcaggagtccaagaccatcatgcgccaagatggtggaaccctgtctctactaaaaatacaaaaattatccaggcatagtggcgggcgcctgtaatcccagctactcaggaggctgaggcaggagaactgcttgaatctgggagggggaggttgcagtgagccaagattgcatgactgcactccagcctgggcaacagcagagcaagactccgtctcaagaaacaaaacaaaacgaaaaattactgaagtcgggtggagctcagacatcggtagttttcca

SEQ ID NO: 485752 - DNA, 105 bp, Homo sapiens
  misc_feature (36)..(36): n is a, c, g, or t
attgcacctgtaagaagccttgttaccaggtttccnaaccagtatttaggcgtgctcaaaattttgaatggtggccaactccggtcacttgaagaaagatttgcg

SEQ ID NO: 485753 - DNA, 504 bp, Homo sapiens
  misc_feature (28)..(28): n is a, c, g, or t
  misc_feature (39)..(39): n is a, c, g, or t
  misc_feature (65)..(65): n is a, c, g, or t
  misc_feature (290)..(290): n is a, c, g, or t
  misc_feature (457)..(457): n is a, c, g, or t
  misc_feature (465)..(465): n is a, c, g, or t
  misc_feature (472)..(472): n is a, c, g, or t
cccatttaggaaatccccattggattgnttcccccatgncctgtccctcaatataataaatattncccttggttgtatgggatacatgcacctaatacccttttggatttaacctacatgataaacacagtcctagatcgtttgggtgggtagttcctcctagaatggagtatttaaaaaatggagactataataaaaatcctaaattttaggagtattacaaaataatgcttaacagtttgggaggctgaggcaggaggataatttgaggcccaggagtttaagactgncctgggcaacatagcaagacactgtctctacaaaatagcaacaacaaccaaaacaaaaattagctggctgtggtggtgcacacctgtagtcgtagctacttgggtggtgcacacctgtagtcgtagctacttgggaggctcatagggaggattgattgagcctaggngatagagnctttgtnactctgaataatgcgttgcactccaagtctgg

SEQ ID NO: 485754 - DNA, 234 bp, Homo sapiens
acgagtgtatgtaaggaaaatatcatatcatacaaattttccctatctggctttggattgaaagcatcctagaactcattacaaaacacctgctccctctctgagaatgatgggtgcatcagtgggcttcatcagcgatggagcgacgagcgtgcccatgtttgaatggaccatgcagccgggggacctttcctgctgcggtatcagtagagacgctcccgggcaaggggccat

SEQ ID NO: 485755 - DNA, 530 bp, Homo sapiens
cccacttttttttcttctttattccccttcaaatgcgaagaccgcccaaaaaaaccaaacaaaaaaccccccccgcaattaagaaggaatacattcacagcgcgaaatggagcccgcttccaaaaaaaacaagaaacagccccccgaggttccgccccctggccaggactaagaaaggaaaactggccccacgcaaagaccttccaccccaaacggtccccagccaaaaatattagggcccccgaaaagccaccaaagcacccggaccttttgccgcggtcacaccgctcaaagctcacccggggaggaccccacaacacccacccgacaaaaccgttgtcccaccccccccccctttagaggcaagcaagaccaccttcatcctagcccacaaaaaaaaacccggaaacccccccaaatcttgccccccaaaaaagggaaccccccccacacccaaaaaacacgccctcgcaataaccaaaacccgccgcccccaaaggcgacccaaccaactccccggaggcggcacc

SEQ ID NO: 485756 - DNA, 132 bp, Homo sapiens
gtaccatggagagagaggccagtatgagcagggcccagatgaatgggaagaacttcagttgtgtgctggagtgtgctgagaggtagggagactgacaagtggctgaggtctgataaggcatggtgatgcgtt

SEQ ID NO: 485757 - DNA, 593 bp, Homo sapiens
ctgtgggtgcggtggaacagtccaactggtggtggttccgccattaacgaacctggccccgttgaaggttccttggtgccctaacctgtaacaccgcttcctgggggacaacccagggtttggaaaggattcaataaaacccagttgggcatcatcgcccctttttggttgaaaaacacctggaaaacccatcgggccccggggggcggagggtgccctgcaattggggttgtttttccccccggcgaaggccctgcaggtgggcatagtggaccaggtggtcccggagaagcaggtgcaaagcattgcgctgtcagcaaaagcccagtggatggccattccagaccatgcttgacagttgaccaaggccataatgggaaaggccccggccacccgcctggtcacccagcgcaatggggacgggcaaaattttgtcagtttcatttccaaaaaaccccatccaaaagtccctgcaaatgtacttaaaaaggctcaaaaaaaaaaaaggctaacgattgggctgccacaggcttacgcccacacgggcccctgtgggtcccagggaggttttaaacaaggtatttttcaactta

SEQ ID NO: 485758 - DNA, 436 bp, Homo sapiens
  misc_feature (16)..(16): n is a, c, g, or t
agtctgaaactgaaancctgtcaaaaacaaaggggggtggggctttaaagaagtgaaggtgaggaggagatcacacaccgtatgtgtttgcctaactggctttaccccaaaagaaaattaaactttctttgatctgtacaagttgatcaaacaaatggggtcattcttgtcatatgcaactaaaacagggtagacaggcccaggggaaaaaggcactcagggcacacagcattgcttcaaaatataattctctacaaacctagttgctaaaactacctgttgtaacctaaaaccagttttatctaacagctattaaaacaacctactgtgactgcaaaactggttttacccaccactgtcacacaccaatcagaacttgccagctcctcaaaactttactagggccaataaactttctttcaaaacaaaaaaaaaa

SEQ ID NO: 485759 - DNA, 195 bp, Homo sapiens
cggcattatcactgtgtgagtggtctcagtcagtctcctccctgtctcactctttccctctatttatttcactctcttgtatggttctaccctgcgacctcggtccccttccaggttcctgtttataagccccataccctctgtcccccatcttgtatgtgaaaacttgtctcaataaaccctttggacgtacat

SEQ ID NO: 485760 - DNA, 821 bp, Homo sapiens
  misc_feature (527)..(527): n is a, c, g, or t
tataaaaaaagggaaccttttttgggggccccgggccccggggcccggggagggggggccccttaaggaaaaaaaaaccttttttggccctttttttgggaaccccgttgtgcgtcggggtgtgacccccaatctttcttctctgggcggcaagttggaaacagccaggagagggttgaagggcacgaacactataccctctgggcggagaaatccatttgtgtgtgcgacagatggtaattcgcgggggccacactgtggcgggagagaaaaagggggtctccaaatagtagtgctcaccctctgcgcagaagggccccaaacacccggggtgtcacgggggtgtgagaactcctctatctcacggtgagaatgtttttggagaataactctcctgtagaaacaagatgctgtcgcgcgcgcccaatcatcctctcaccagggtgtggatgtgcgcccgggggaaatatatacctcccaagaacgcctgtggtgtgcacaaccgaggtgggggagaataccactcncctctctctttgtgtctcgtagaagaaaatgtgggcggccttgtagaaacacttctccctcgagagggggtgtgctcacaagtgggggcctctacgaacacactcctcagagaaggggtgatggagagtagtgttttatggctcccgagagaggagagggggtctctttccaccagaagagaaaacatttcgtcgagtttgtgtgtgggagaacacaacaacattgtgcccacttatctacaattatgttatgtataaaaaccccccgagcccataagtaaactcccccaatag

SEQ ID NO: 485761 - DNA, 1232 bp, Homo sapiens
  misc_feature (1158)..(1158): n is a, c, g, or t
gcaggtgatccacccacctctgcctcccaaagtgctgggattacaggcatgagccaccgcgcctggccagaagaaatctttatcttggtgtgcagtgtctggtgagggacaaatatcatctctcttggatctgaatctggaagaattcgcggcactgaagggatttttttttttcagacagtatccctctgtcgccaggctggagtgcagtgccgcaatctcagctcacggcaccctctgcctcccgggctcaagggatcctcctgcctcagcctctcgagtagctgggactacaggcacgcgtcaccaggcccagctaatttttgtatttttagtagagacagggttttaccacggtggccaggatggtctcaatctcttgacatcatgatccacctgccttggcctcccaaagggctgggattacaggcgtgagccaccacgcccggcctcactgaagggatttttttaatgtcacgtggctctcacaggtgcggtgtgtttgggtgcaagtgaagattacgactgatgcttaaaaacaaatgtaaaattccaggtggttgttgctatggggagcagctttaggacaatctgagtggtttcagttgcaagagtgtgcgtgtacgtccaagtgctacagtcaagattcaactgctggctttgagggcctctttaagaacagtaatgataacctaaggcagtttaacagtatggaatggttaccttttagaagttaagctatgggcatggaagttcaatcagtgcattgaagtttttcctttatctctcctatggttaatggtttctgcagaaaaggaccaattgatttctttctaaaacgttgcttcagggtgtagagacctttataggtcatgtttcaacttacagaaaatttttatagttcaaatataaattaagttcaatgtggaatttgtaatagaatttcaggtgaagtaaaatttccactttccttaggctgtttgcagtgcccagcaggccccatgatatcgagatggaagttctgttaaaggaggagattgatcagggatgggcagaataaggaatatgggcagctcaggctaatgatacaatgattgagatgtagaaagagggtcgggcatgggataacgcctgtagtcccactgccttgggaggccnagacaagagaatcgattgaggtcagaccagcctggtcaacagagtgagacctaacctgtacaataaaaaaaaaa

SEQ ID NO: 485762 - DNA, 340 bp, Homo sapiens
  misc_feature (20)..(20): n is a, c, g, or t
ggaaagctgcctcggggccnaccccttgcaaagggggtgtgtcccacaaacgctgctatgggtggggtggggggctggggtgctgcgtagccagtgtttgactttctattcaagtgggggaaagtgggagaggactgagagtgaggcaagttatccccagcccctgaccgtctgactgtcaatctataatggtttcagtttcaaaagagacatggtagaatcataagtcattaaccctccccatttcaaacatcctagatatatttgggggaccagactaatttggctagagtcacacatgagagatgtgggcactttaaaaaaggaatagcaaaaaggg

SEQ ID NO: 485763 - DNA, 123 bp, Homo sapiens
cagacgctcctggaactccttggccatgtagtagtagcagatggcgtccagtgcagcagttggtcgatctgagagcttgctggttactgtacatgggctgcgacaggtatcgtcgtcctagga

SEQ ID NO: 485764 - DNA, 351 bp, Homo sapiens
aaccgccagcccgaggaaaaaatgaaaaaaacccccccgggagaatgtgtttttcccacccccccgcaaacataattggagagcccttttaaaaaaaataaattacaccccccccctaagtgcttaaaaaaaatcacacgggtgggaattaagagttatcaaacgagagggcagaatgtaaatatccccatggagaaagaagtaaacataacacactccattttggtataaactaagaaaaatcctgccttgagatgctgttaatctggaaccgtaacaaaaaccctgtgctggcagaaacatgtgctgtttctactcaagggttaatggatttagagctatgcaggatgt

SEQ ID NO: 485765 - DNA, 364 bp, Homo sapiens
  misc_feature (74)..(74): n is a, c, g, or t
ctatggacaagaatatttgggtttaaatatggagtgaacatccgctcattatatcctggagctacttaacctcnctgtgctccactatttccatctgtaaagtgaggcaccgacaagacatcaggattaaatgagttaatacctccaaactattcatcagtgactgaccctaaataagcactagctaatagccctagttactcttaaattactctttctattttcaaaactgggtcgacggtaatattcctgacgaatgcaatttgaccaagacgtctgtcccgctaaaaacctccccacttttgtagactgggtaaacagaaaccaattattgcttctctcgagcactatcaaacttattaaa

SEQ ID NO: 485766 - DNA, 310 bp, Homo sapiens
  misc_feature (307)..(307): n is a, c, g, or t
atcaattgaccgttgtgacaatacacctttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttgggacttagcccacctgcacccggggggattaaaaagctttattgttcacacaaaaaanaaa

SEQ ID NO: 485767 - DNA, 452 bp, Homo sapiens
tatctgtgacctcccacttcaacaaattgtcatgtaattggaatcatacagtatgtagcctttcagactagctttttccaccattggccatccatttacttaatcctagtatacccctataggaaaaactttattaactacagtacagtgcttttgtacagttcttttttactttattcttacattctccactcatttccaaagttacttaggtcagcaccttatttctccattcctttcagtgaggttcttttcatacatttgtaatatagttattttgttgtattctgtattccatcttgggcttcctgaacctcctaaataacttttttttcaatttgcataccttaagattccctcttttgtgttgtatagttttatagattttgacaaatgaaaatagtgtcgtgtgtccaccattacagtagtatacatagtagtttcactcccta

SEQ ID NO: 485768 - DNA, 312 bp, Homo sapiens
gaattaaaaaaatttttcccgggatttatttaaaattttttaatttgaacccaaaaacagcgggctaattcatttttaaaaatgggttatttgtaatttttcctaaacagaggggcccccaagaatcaggcccttttttaaattttttttaagaagccacaaccaaagcgggggcctaataaagaccccccccagcccttgggttatttaaattatgtaagtaaattgtcctttgtccggcccccggccctttccaaagcctgttttattaaaaaaaaatgtaaaaaatgactaaagttttccttgggccca

SEQ ID NO: 485769 - DNA, 1314 bp, Homo sapiens
atgcgaacagcaatgcaacgcttagacccttacttcactatcttactacaaacaaacttaactcaaaattaattaaatactcctaaatgacaacgtgtgaacaacctactaacacacactactctaccacagaacagcatggactgctcacacttcccactgcacccttactactctaagcaatagctttactataacaacaaccgcaacaagcaaccaaacacggcaataacacactagcataacctgtggacctctccatccaaattaacaaaccacactcttccgtggcttcaacagcaacactcactgaacgctgacgatgaaacaaggaaccttacacgaacgcggcgaaaaaagaatattctgcacacggttcacggccacttccgacttcaccggggtccccggttactttctactacactactatttaacacgaaacctcctcaacaaaccccaaagcacgctcacacaccgaggttaccaaaagtgactcccaagctttaacgcaccccactctggtccggaaacggggaatctctggacagctacggcaaccacatacttcctccccagacacgcaacacttactatatagcaaacacttgcggcccaattaaatcacgaactggaaaccacatgaaccttggcatacaacgcatttccaacctaagctccaattaacgcggcaaccattacacaaagctcccaagagacccccaaccaacctggacgggaaataaatcgaaccctcctccaataagatccccaccctacgccagagtgcgaccctaagttcaacttcgcaaaaacacgcacccacgctaaaccccccagaaccgccaacacacgacgcaggacacggcggtcgaaccccagccaatagagaaacgcaacacctcggcgcaaaccccttccccacataaaccacctcagccctggcctcggcaccaacttggtcaaccaaaaggcgtagccagacccaccattccgcgacagcacaaccaagcttcaggacacgcactccctcgaaacaaccagcgtgccaaccccattaggagccatatcccgccccgataccacacttccccggcagcgccagcaccacaaccaagcgcgcacagcaactcgaacaggaaaacacgcgacaaacaccgcatctgggcacaccgagacaacaccccagggtgccacgaacacggacgcaccaagcagaagacacaccctcggacgaccaacgccaacaacaacggcgcagcccagcgcgcccacacaccccccacaacagcgacaccacgagacaccgaacac

SEQ ID NO: 485770 - DNA, 316 bp, Homo sapiens
gcacagacagcacagcacagcacatcacagacagaacagcacagacagcacagcacagcacagacagcacagtacagcacaggcagcacagcacagcacaggcagcacagcgcagcacagacagcaaagcacagcacagaaagaacagcacagacagcacaacacagcacagcacagacagcacagcacagcacatcacagacagaacagcacagacacacaggacacacacacagacagttaggagcaacaaccacagataaagcacaccacactatttaaattcatcctgtgctccaggaccccaggtcgacgc

SEQ ID NO: 485771 - DNA, 138 bp, Homo sapiens
agagttcaagatcagcctgggcatatagtgataccctatctcttaaaaaaagaagaagtttttaaatttgaaataataataggtactggataatatgcaaatgtcttttctgcgtcttttgagatagagtatcaggtt

SEQ ID NO: 485772 - DNA, 266 bp, Homo sapiens
catgagggggggtgctgtctcctcgatttgacaaaactgggctctctctgaaatgctcactcaactctatcgacacccgcatctacatgactgagaggaatgagtatatggtgacctgcctttacaagggcgcgtgtctagctcatgaggtcctgccagaaatgaataaaacgatctatgtttatacgtctaagtatgagacatggtgttatgtgattatgattaaaggcacccaatttatggctttttctctccaaaacgacgat

SEQ ID NO: 485773 - DNA, 176 bp, Homo sapiens
gctacaactatggactgtgcctttggaagctgaggcaggggtgattgaggatgcactgagctgtgattgtgccaccacactccagcttaaagaacttgcccaccaacataaccaattaatgaaagtcaattcattaaaaggtatagaacctctagttgggagcttgggtacctgtt

SEQ ID NO: 485774 - DNA, 252 bp, Homo sapiens
gctcgacaatatgctgacccaataccctgaactgtacggtgcgatcgtctcccaggtgcccctgctcgacatgcagcgctatcacctcttgttggccggagcgtcgtggatgggggaatacggcaatccggacgagcctgaagagtgggcgtacatccagacgttttcgccgtaccacctgttcgatccggcgaaggctacccaccggtgtttttcctgacctcgacccgcgatgaccgggtgcagtcgacg

SEQ ID NO: 485775 - DNA, 737 bp, Homo sapiens
gcggggagggagttggcgcctagcgcgcaggtccatccccgccctctgcagtggactcggccgcagaatcggggtcccgggctcctggaacttgtcccccccaggccgcggtcgaggaggtcactccagaccggatgaggacccggtgccggggggcggtgtgactggaagccgggggaggcgggaaggaggaggggatcgaggcccaagggacacgaggtgagagtcgcgggatcccgaatatctcgggacagagcagtcttgaccagctccggagcgccaggctcgcactcccgtatgcgagcgaacactagcgtcgactggcgagtagcacaaatagggcggtgtccgttttgatcgcctcccgtgcggcggggaacgccccgagagcccgaactcgcgcaaaatcagaaatgcacatcgcccataataccccaagagattctcgtggcacaccgtgaaattcggtgcaccggatatcgatagttctcctagcaagtgggattggtgaacaaaacggaacacagtgagagatgtcgttcgggaatatgtaacagtggaaggggcaaatcatgtggattaccagcaatgtaggactagagacttacccgtgttgagagaccacttggaatatactttcacgtgtgaggaacgatagtggagagcagaacgtgtccagaggggaataaatgacggattgtggtagaaaacagggaaagaaaagcccttagggacag

SEQ ID NO: 485776 - DNA, 264 bp, Homo sapiens
  misc_feature (150)..(150): n is a, c, g, or t
  misc_feature (213)..(213): n is a, c, g, or t
  misc_feature (251)..(251): n is a, c, g, or t
  misc_feature (257)..(257): n is a, c, g, or t
tttccaaaaaaaaaaaaaaaagaaaaaaaaatcagggatatagttcatatcccccttttttgtttacccccatgtccctgaatatcagcctgtagctaatggacttgggatttttggtttaagtgggcctcctggggatggggtggtacnctgagcttttgagcctcattgtaaagtaaaaaggtactggggcctgtgtggtaagccttgttnaaatgctttggtattcagtattgccttaataaacttcncccccnactgcca

SEQ ID NO: 485777 - DNA, 339 bp, Homo sapiens
gagctctgtacctgtgggtatgcatcaataaggaagggccaggttggggagagccccaagttgagaataagtaagtgaacaattagtgtatgaaccacttgttacgatactacgctagatcataaacacctgtgtgtaaaatgtatttccttacacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 485778 - DNA, 801 bp, Homo sapiens
ggccgttctcccagtcttcgcttcgcgatatgccatggcggagccgtcgggggccactcagatcccattccatctcctcgtcgtccttcggagccgagccgtccgggcccgagtgagcggcagggatgcccagagagtcctgaccccgacaccgtgaggagacctaaatcagtcttgcaaggctccatcctggtagcaggtaacaatgagtctagactatttctggagaggatgtgaacgaagactgggtaatagtctttggtgacacaccgactggaatcatgcatgcgttatcccatggactggcttctcaagctgatcaatcacgtgataggattaacatgaagcggtcaatccatggaagtccatatcgtcaatcgtggtcaaccaaatcaacgcataatcagtgaaatcttacctagagggatcgcggatcaatatcgccagaaatcactgatcccctagataacagatcagagtgactgaacaggggtgccaagatggccatgtatgccataaaggtgccagttaccccatggggagaccgattacgcacccaactattaacccatccattgggaaataacgcattcacgagaacacggcctattgtaatccccaatactaccgagattaacacaaaggttgtaccaatttgcacctgttggccccaagaatggggcattgaaccatcaaaaatcgcgatctcataacagagggaaacaccacacttgacacaagaagacaatacacagattataaacacagtacaggatagcaatacagatcatgcccattgga

SEQ ID NO: 485779 - DNA, 757 bp, Homo sapiens
  misc_feature (536)..(536): n is a, c, g, or t
cgaattcaggtaacagattctccgtgtgaaggctgaagaagataagattaccactgctcgatcgtgggaagacaagatcttgactcttagtaggagacggatggatatgagtgcgcgtgtgtgatggaggctcgaggtaggtgaaatagccccgtagaagaaggtggggtcgtgcgaggacggtgggaaacgtcaagcgtagaggatcctgggcaccaatggtgggacgaagggtgtgtcattttggaattctgatgaggaaaatcagaaacggagaggaagatgtcagtaaaactgaaggactgatgaatggacaaattgagaatagcccaagctagaggacacaaacgcataaaggtttctaaaaaaagcaagagtcattgttaagggcatatatcctgattgaaggtggatcgataggggtgaactgggaattgtaagcgcaagcttgtctgtcctaaaagggaccacgagggactgggggtctggtagaagcaacaaggctcaggggtttggaacttgcgttggacctaggntggttcgccaagcttcatccccgccgtaaactacaggtctccaatgtgccaacaacttgcgtttgagaaaatggggtcgaacacggataatgttggtggacctacagtcgggtgggacacgcaaagaccgtaaaggcccgatgccgagatgggacagggtagctatggtacagggaggttgtggaaattgctttgttgctccgcttcttcccgtcccaaaa

SEQ ID NO: 485780 - DNA, 234 bp, Homo sapiens
ttttttttttaccccccccctttggggggagggccccccccggttttttttcccccctttaaaacccccggggctctttcccccccccttttttttcttgggggggggggggggggttttttttccccccgaaaaagtttccccccctggcccctcccccggagttttttttgggccccttaaggggggcccccttcggccgggggccggtttttccggggggccccccccgcc

SEQ ID NO: 485781 - DNA, 895 bp, Homo sapiens
tcagttggagtcagaggatgatactagctattttgacacgcgcgctcagagcgataccaccgcatggactcggaggatgaggaagaagtgagtgaggatggctgccttgagatccgtcagtttctcttcctgctctcctaagggttcaacaaggtgtacagtcagcatggagcgggtctcagctgctcgaggagcgccggataccagccccgaccaatgcgcagccgtgaggtgaggagaaggaggatcattcacatggctctggcagggctcaataggccgagagcggagtctgggtgattggcctcccccttggagatattacaggaatgcggcatgtcgtgatgtctgagttcgtctccagcacagagtagtgactcaaagccctccaatgacagtgcgatgccgtgtgctcaggcctcctggatgcgcctcggttcccggagggccctgaggaggccagcagcaccctcaggaggcaacacactaggagtgggtatatggggtcctgacatgccccatctgaagaggggggtatctgggcctgtcactgaagcactcaggcgagcaacggccaaagctggatgaggaagctgttggccggagacatgtggttccagtccatctatggagagccgaggccgtgggacctcaagtggcctggaggagtcaagtcaatggcaacagtgaactggccgtgcgtaggcccgccacggatgctctcgggggactcaaagaagagcgcatgctcgccgggacagggttcaagtcggcgcaacaagcccctgaacccatccgggaaaccacccggccccggggcggcccggtcccactcacggcacccatccggctccaggggtttgccccggcaggccccacccccgccgcgaagtgc

SEQ ID NO: 485782 - DNA, 100 bp, Homo sapiens
ggagtttgagaccagcctgggaaacaactacttatgaggccttgtctctagaaaaaatacaaaagtcagctgggcctggtggtgagcacctgtggtccca

SEQ ID NO: 485783 - DNA, 224 bp, Homo sapiens
caggtagactaaccaggtattcaacagcctgtgcaaggcagagaagtgagaaattttatgagatagttttgtagactgaacagaaagatatagggtgggacagtggttagagaacaggctggagaggtaggccagaccacatcattaaagagcctatgggctttagtggggaattttgatttctacctgtattgcagtcaggagtttaagttaggtctacctgg

SEQ ID NO: 485784 - DNA, 487 bp, Homo sapiens
ccccccggggaaaaaccccccccccccccaggaacggttttccgcggggggcccccccggggtttttttttggggggtgccccccccttttccctttttctttccccggcctttcccttttttttttccttttttagccggtttacccttttaggggcccagggggttggaccccgtttaaagggtttggttccccccttccccccaaggggtttttgccccggggggccccccctccctttcccctttttttttttttttggttccccggggggggaggaccttcctttttttttaggggggaattgggttggggaaattggggtgggccccccttggattttggggttaacccccgttggccccggggtcccccccgggttttttcccctttttccgggggcccctttttttttttttccaatgggttttttttttggggggccccccttttttttttttcccattaaaaggttttaaaccttta

SEQ ID NO: 485785 - DNA, 430 bp, Homo sapiens
ggacctaagccaggcaggggaaggtagcaggacataaccacaggctggaatcacaggcaggagcaggaagagagcccaggagaacgaggtgacacaacacggctaagctccagactggctggtggaaggaagagctgaagtcgggacccagcaggaaacaaggagcatgaggccacatcgtttagcagagcttctgccaggctcgccaggaggtctccttcccaccttcgaagtcctcagactctccgccatctctcccaggcccaggcgagatccctgagtaggattactagacagactgtcctctcccactgtcttggagtgtcccaaggccagagaggcaggatcctggcagtagaagagagggggaaaatgatgtcccagctctagaacaacagactcagtcttcaataaatatttgttcaatgga

SEQ ID NO: 485786 - DNA, 301 bp, Homo sapiens
gcatgagagtcacttgaactgggaggtggaggttgcagtgagccaagattgcaccactgcactcccgcctgggtgacacagggagactccctctcaaaaaaaaagaaaaaaaaaggaaaaaaaaaaaaaggtggggttggggcccgaaaatttttcctgaaacaaacttgagggagggaaaatttcccccaagcctatctaaagaaagctacacctgctgaaaaatgggaaccaaaggtttttttttcttcaacctttttccaataagggaaacattttttgaacatgacccactaaaaac

SEQ ID NO: 485787 - DNA, 1566 bp, Homo sapiens
taaaggtaggaaaaatcaaatgggatttaatggaaatggtttttaaataaccctcattttttctttattctcactcaggtatgtggggaaaattaggtgtgaaagagttaattaaaagagatagtagctccgtggagaagaagaagaaaagtgagaggtggtgaagagggaattcaagaaaacaccattttctccactcccgagaactcgtgccaactaacaccgagagctgcgtgggagaagagggcatttattgtgtgtgctcgcgtggcgccactcgagcgtgtgtgtagaagagtggaggtgtgggcgtggaaaaatctatagtgtgtgtggtgctgtggagagtctcacatatataacgcggctctctatacacacatctcttgtgagtgtgtgtctcatatatattctatatcccatatatgcgcgggagccccaatgtggctataaacgcgtgtataacattatatgcgtggaacacaatatatatatacgcgcagggataatcactctcacaaacacgtgtgacgacaaaagcggggaggacaacatatcataccaccaccactgtgaaggagtatcatcacgctgtggggaggagacaccactctctgctattataggggagaagacgagacaacaaaaggaggagaataacaaaaataatacacctttagaggtgtgctgatgcggctgtggcgattttataacaaaagaaaagatgttgcgccctattatcacgattgtgtggtaatcaaccaggtggggtctaataataatattatcaccaacaccacccataattaatatcttgatacggacaaattattaccacatcatttagcagcaaccagcaacaaaaccaacaagaatgctggtgggtggtagtaatgcatacccaatcattaaattattaaatacttcccgcaagccatcttggttctcatcccaaagcaagacaaaaaccaattatattttttctatcccccctactggttggttggtttccttcccccacaacggttgtgatgaaaagagaacaacacgcatcattcatagagtttggttgactaacgaaagcagacccgaacagattggctggctcggcagacaaacaaatgatagtgtgtgtggtattctaccgccccacaaacattgattacaatgcacggtgtagttataaacacaaccaccgacagaccgaatgtcaaacaaactaatatatccgttacccagtagagcgggcacattatattctagtcctcccgaccgaaaggccaaatattattaatcggtgcttacatcattaagtgatgggggggcaaagaaccaagacatcattaatctagtgatggggggggggaaaatatattatacaaagatacgccaggtagaggcaaaaacacatgaattagataatctataaatagtatagaaggaccgttaacaacaagcaaagcacagccaacaaagaaggatgtggtggtgatgggacaagacatatccaccggttgaggaaagacaaaccacttaagttgtgaggagatgcttacagagtgctat

SEQ ID NO: 485788 - DNA, 597 bp, Homo sapiens
  misc_feature (15)..(15): n is a, c, g, or t
ggcggtcggcccccncggggcggttcagtgacaaacaaagtttttcaggatgagtacttgctgcaggtcgcacagttatgactggattggaacttcatccggggtggggggggcttcagagaactttcattcaacttatatagattccatatgaaatgggaatgcaagaaggcatacatatttctggttgattcaatttcctgataattcccaattacgataaaaggagtggggtggtaaggactcacatgtttgagagggggggggggatataatatatgagcctgggatgaaaattgataataaaagagtgttgatgaagcgtaaattaaagaatatgtttctggcgttcttttcctaaaaaaaaaggagccggtcccagaccaggcttggtaaggagggcctattccgatgggttttatgattgggacaggggcaaggccctgtgaacggggggaaggtggaaccgctgtgggggttctgcttttccagggacaaagccacatgcctgaatgaggggcgtggcggtgtagccccgggcgctgtcaccactggggggtcggggaagaagaaaaagagggcgccggggcgggccag

SEQ ID NO: 485789 - DNA, 656 bp, Homo sapiens
caacagcaactggaagaacatagaaatttcagacatctggctgggcgctgtggctcacgcctgtaatcccagcactttgggaggccaaggcaggcggatcacctgaggtcaaggcgttcgagaccagcctggccaacatggttggaaaccctgtctttactaaaatacaacaaaaaaaaaaaaaaaaaaaaaaaaaaaacactttttcggcgccgcgctctcggcccctcggggaaaaacgtttttaaaaacccttcggtggggggggcgcgcggggccccatagtggtcgtggagacctctggggccaatggggctcccatggagaaaccccggggccatggacaataggggtgggggagttccccaccaaagagaaaaaacgcgcccggggggaccccaggacggcgtctcttggaccaaaccccagaagggagagctcgagagaggctccaagacccgggcgatccttcatacagcacggagagtccaaagcgaacagctgcgaaattacaaaaatacacggcccggacacggggggcgtagcaaagacaccgaagtagcagcagaacagcaacaacgaccaacagcacggcaacaccatagagacgaacagcaacaacacagtacagagcatccgagcgcgacacaggaggc

SEQ ID NO: 485790 - DNA, 928 bp, Homo sapiens
  misc_feature (570)..(570): n is a, c, g, or t
  misc_feature (603)..(603): n is a, c, g, or t
  misc_feature (791)..(791): n is a, c, g, or t
  misc_feature (796)..(796): n is a, c, g, or t
  misc_feature (803)..(803): n is a, c, g, or t
  misc_feature (808)..(808): n is a, c, g, or t
  misc_feature (810)..(811): n is a, c, g, or t
caggtgcgggctgaacaagtggcattggactcatcttcactgttcccacagtcattgtccccgtcgcagagccagcggttggggatgcaccggttgttctcgcacttgaatcggtccgaggggcaggtgtgctgatggcagagggctggggcctcatcactgttgtccaggcaatcgttgtctccgtcacacttccagcgctcctggatgcagcggctgttggcacaggcaaactcgcctggctggcactggggtggaggcacgtaggatgggttcgccaagcaagtgacgccgtctgcgtccaacacctggtcctcagcacaggcgcactggcggctcccaggggtggccaagcacaggctgctgcagccgccattgttcacccggcatttgttggtgccaacttgctgctgctgggcatcatacattcggatctcaaagatggggggccgctcactgcgcagaagggtcacagtggggggtgcgcctcctacaccccgttcccagcggtagacactgccactccgatactcagtccagaagaggtagttgccatggtgacacaggccnaaggcgtggttcagctcaggaccttcatacacnatcttccggtctgtgccattgagcagtatcgtctcgatgcggtcgtagaaggcatccacccagtagaggcgcccagccgggatgtccaggcttagcccattgggccaaagcactgtcttggaggtgacaaagatgtctcggtgtgagccatccatccacgccctctccagccgccagccaactgtccntgggntcctccncccancnntccatccatccacccatccacccatccacccatccatccatccatccacccatccatccatccatccgtccatccatccactcatcatccgtccatcatccacccccaaccgatcag

SEQ ID NO: 485791 - DNA, 453 bp, Homo sapiens
ggacagatggacttcaaatgctgtttgtattccagagactagtttggaccgaattctaatttttcttgactacaagtcttcaaaataatgttttcatttttttcttcttttttccatttttttccaatttggagtcactgaaaactaagctgtgctttcataaagccctgcaaactgattctagccaacttcagaagaaaaataacagcaacctatttacatacataagccactttcatacctgcctaccgatgtatggacttcagagtaatgtggcttatagcaattttccaggattgttcttttgtttgttgttgttctcccttcctccccctattttgtctttatgggacatgacacttcacaaccttctaaaaatgagttttcctaataactcaggacctactcgtctagaaataaaccatcctagccatgaaggattagataaaaaaa

SEQ ID NO: 485792 - DNA, 606 bp, Homo sapiens
  misc_feature (212)..(212): n is a, c, g, or t
agctgggtcactgtacccctttgtggtatctgtatctgggcacacattatggagctccataatgtgtgcccagtacatccacccattgagtggatccaccacaatagccctggggtgtgtcattttgccctcgattaaagtcttgcgggtctgagcagctttctccagcctggccacgctgattgtctttttgggcccatcgtccgtccagnacagattgtctcccatccagtccacggccacaccctccacattgtggatgccgtccttcaggatggtctcccgctcagtgccatcaatcttctggcggccaatgaggtagctggtggtgtcggcaaagtagatgaagccggtctcagcgtggaagtccagggctcgggggttcatgaggttttcatggggatcatgtgctcatccgggaccttggcccccatatccatgccccggatgatgcctggccggcccttgccatacacgaggaacagctcatgctccggcttcttgcatgacttcccgtcactgcccaggctgaagccggaacggcagcggcaggtccgcgccttgtggctgttggccagcaggcagatgtcaaccgcatcacccgtt

SEQ ID NO: 485793 - DNA, 1349 bp, Homo sapiens
  misc_feature (570)..(570): n is a, c, g, or t
  misc_feature (603)..(603): n is a, c, g, or t
  misc_feature (791)..(791): n is a, c, g, or t
  misc_feature (796)..(796): n is a, c, g, or t
  misc_feature (803)..(803): n is a, c, g, or t
  misc_feature (808)..(808): n is a, c, g, or t
  misc_feature (810)..(811): n is a, c, g, or t
  misc_feature (955)..(955): n is a, c, g, or t
caggtgcgggctgaacaagtggcattggactcatcttcactgttcccacagtcattgtccccgtcgcagagccagcggttggggatgcaccggttgttctcgcacttgaatcggtccgaggggcaggtgtgctgatggcagagggctggggcctcatcactgttgtccaggcaatcgttgtctccgtcacacttccagcgctcctggatgcagcggctgttggcacaggcaaactcgcctggctggcactggggtggaggcacgtaggatgggttcgccaagcaagtgacgccgtctgcgtccaacacctggtcctcagcacaggcgcactggcggctcccaggggtggccaagcacaggctgctgcagccgccattgttcacccggcatttgttggtgccaacttgctgctgctgggcatcatacattcggatctcaaagatggggggccgctcactgcgcagaagggtcacagtggggggtgcgcctcctacaccccgttcccagcggtagacactgccactccgatactcagtccagaagaggtagttgccatggtgacacaggccnaaggcgtggttcagctcaggaccttcatacacnatcttccggtctgtgccattgagcagtatcgtctcgatgcggtcgtagaaggcatccacccagtagaggcgcccagccgggatgtccaggcttagcccattgggccaaagcactgtcttggaggtgacaaagatgtctcggtgtgagccatccatccacgccctctccagccgccagccaactgtccntgggntcctccncccancnntccagtacatccacccattgagtggatccaccacaatagccctggggtgtgtcattttgccctcgattaaagtcttgcgggtctgagcagctttctccagcctggccacgctgattgtctttttgggcccatcgtccgtccagnacagattgtctcccatccagtccacggccacaccctccacattgtggatgccgtccttcaggatggtctcccgctcagtgccatcaatcttctggcggccaatgaggtagctggtggtgtcggcaaagtagatgaagccggtctcagcgtggaagtccagggctcgggggttcatgaggttttcatggggatcatgtgctcatccgggaccttggcccccatatccatgccccggatgatgcctggccggcccttgccatacacgaggaacagctcatgctccggcttcttgcatgacttcccgtcactgcccaggctgaagccggaacggcagcggcaggtccgcgccttgtggctgttggccagcaggcagatgtcaaccgcatcacccgtt

SEQ ID NO: 485794 - DNA, 372 bp, Homo sapiens
atagcgacaccgtacaccacaaaagcatgttcaagttttttttttgacatggaatttcactcttgttgcccaggctggagtgcaatgccacgatctcggctcacggcaacctctgcctcctgggttcaagtgatgctcctgcctcagcctcccaaatagctgggattacaggcatgcaccaccatgcccagcttatttttgtatttttagtagagacgaggtttcgccatgttggtcaggctggtcttgaactcctgaggcctcaagtgatctgcctgcctgggcctcccaaagtgctggaattacaggcatgagccaccatgcccagccatcacttgaatgattattaacaccggggaatgaaatgttttt

SEQ ID NO: 485795 - DNA, 667 bp, Homo sapiens
  misc_feature (9)..(9): n is a, c, g, or t
  misc_feature (61)..(61): n is a, c, g, or t
  misc_feature (83)..(83): n is a, c, g, or t
  misc_feature (85)..(86): n is a, c, g, or t
  misc_feature (115)..(116): n is a, c, g, or t
  misc_feature (132)..(132): n is a, c, g, or t
  misc_feature (138)..(138): n is a, c, g, or t
  misc_feature (152)..(152): n is a, c, g, or t
  misc_feature (154)..(155): n is a, c, g, or t
  misc_feature (158)..(158): n is a, c, g, or t
  misc_feature (160)..(162): n is a, c, g, or t
  misc_feature (164)..(165): n is a, c, g, or t
  misc_feature (167)..(167): n is a, c, g, or t
  misc_feature (172)..(173): n is a, c, g, or t
  misc_feature (178)..(178): n is a, c, g, or t
  misc_feature (188)..(188): n is a, c, g, or t
  misc_feature (192)..(192): n is a, c, g, or t
  misc_feature (194)..(194): n is a, c, g, or t
  misc_feature (201)..(201): n is a, c, g, or t
  misc_feature (204)..(204): n is a, c, g, or t
  misc_feature (214)..(214): n is a, c, g, or t
  misc_feature (236)..(237): n is a, c, g, or t
  misc_feature (259)..(259): n is a, c, g, or t
  misc_feature (268)..(268): n is a, c, g, or t
  misc_feature (270)..(270): n is a, c, g, or t
  misc_feature (307)..(307): n is a, c, g, or t
  misc_feature (311)..(311): n is a, c, g, or t
  misc_feature (339)..(339): n is a, c, g, or t
  misc_feature (341)..(341): n is a, c, g, or t
  misc_feature (613)..(613): n is a, c, g, or t
gacacccanattcacactttggctccttcagacaacttgatctttgggactagaatttgtncagagtcaaacaccacatagangnncgtgggggccacacacaacactccttttnngggagagggacaaganacctangtgtcatggtcaangnngtntnnngnngntaaannaaaangttaatttgntttntnctccagnggntctatttttnttttccaaatttgtttcaaggnntgtttttttcatgtggggccgntttaaacanangttgcctcattagagcagcctttcagtcctgcaagtntctntaatccatggtatgtacatgtaggtttntncaggcagggaacacacatgacagagaactactttggtggtactggacgggtggtgtttcttcactggattttggtgactgcttcatggatggaggtggccacgtaatctagatttttggtggttaagccactcacgttgattcgaccacttggcagcaggtagatgtgcttttcattgaccagatactcaacctgcttggggttcacccagtgaagctgaacatgccaatttgatcagtgatgtggttccaggtcccaggggttttgagggnttctagtcgtgccctgagttcagatctcatggtcagaatccggtcagctattgt

SEQ ID NO: 485796 - DNA, 162 bp, Homo sapiens
ttggggctccattcaggtctacatgaagaaagggtggttttcttttttttggtttccccaggagcaattctataaactagaaagaataggcttttcaataaatgatggcggggtcagtgtggatatccgatatagacaaaaattaaatggagatctctaatt

SEQ ID NO: 485797 - DNA, 591 bp, Homo sapiens
tctagttatgtgccctataatgatgttacagtcattgacagacctcatatatggcagtggtccataagattagcaatactgtttttgtactgtacctgtcttctatgtccaggatatgcaagtacattaccaattgtgtctgcagtgtcctcacgagtattcactacgaatcaatagtgcctgtacagcgtgttgtagccatagcgagcgaataggcgcatagtcttaggtgtaatagtagatcataccatcttaggtttgtgtaagtcacactcctgtgcatagtacaatctttaaaatctcctattatgagtgcatgcatttctcaagaatggtatcgccctttgctaagcaatgcatgactgcaatcctaattctcacatgttttggggaagaaatttgtaagtttctgaaaaaagtttaggaatagttcctaccaaatatacatgtataaagtttattaaaagtcataatgacccaggaatagctaatgacacagaagtagatcaaaatagaacacaatagagaacttcaaaataaaacaggtgtgagaatagtgtgtgtgaaaaagctgggttcaaataaggtggt

SEQ ID NO: 485798 - DNA, 1030 bp, Homo sapiens
taagcagtcgggcctggccgctatcgacatgtccccatggcccggaggaacgggtcgagcccaggagaagcgcacatcgttcgtcccagccccggaggctccttgtgggcaacgatcgtgagccaacgggttcctgaggccccgtcctggccaggcagggtttccccgcgcgtttccgaggagccctgcctggcctgtgtgctgctggacaaaacaggtcgtagcaccgaatcgcgcactgttatataagatagtttgtacatgtaacaggatttgagatctaatgatctatgaacacaaatcatgtaattaccgatttgataacaaaaaaaatatggtatttgcacgtagagagatcaccaaatacacagaaaggaagaatatggaacatgaaagattggacaaagacaactcataaaaacaataagatgtgatcctaaaattaatacacaatgtagagaatgtatacaatggaatcagtggttcaaaaaatcatacatataattaagaaatatgtaacattagaatttaaacaattagacaatcacatagtaaaaacatcatttcaaaacaagataataaaaaataagacatcgagatgaaaatagcaaagagtcaaaacattggaacaatgagaaaagattacaaaaaaattgataagaacctataaactacaaaaacaagaaagagatacaatgaaagaaaatacaaaaattaggaaacaatatcatcaaaaagaataaagataaactaaatgtaaagtaatataaaaaaaaaatgattaaaaatatgaataaaacaaaaaaaaaaataaaagaaacaaaacaaaaaagaaacaataaaaaatgcagaagaaaaaaaagaaaacagatacaaaaggcaaaaaaacaaaataaaaacaaacaaagaaattagaaaacaatagacaccatataaaaaaaaaaagaagaaacagaaagaaaaaacaaaagacaaatgagaaaaaaaaaactaaaacagataagaaaacaaaagatgaaataaaacagaa

SEQ ID NO: 485799 - DNA, 1516 bp, Homo sapiens
gaaggactcctacgtgggcgacgagggcggcagaacaagcgtggcatccgtgaccctgaaagtaccccagttgatcatggcatcggcaccaagttgggaacgatcagtggagaagatctggaccacgcggcacctttctataacgagcgtgccgcagtgggcccggatgggagcaccacaaggtagctagcatgagcggaagcgcaccctcgtgaaaccaactaaggccaacagagaagaagatgacatcagcagttatgtttcgagaccttatgggacatcgcactgggacatgatagcagtggcacggatccaaggcgccgtgcttgtcccctctaacgcacctcctggtggacgctaaccccacggttgccacactgttggtccaatgggacatccctgtggaaggaaagggggtgtctattgccacaaaaagtggggtgtggcacacatcttatagcaaagaggatatagcagccaatatcccacgaacagacgggcagaatcgtgtagacagtctggtgagaacacacgatgggatgaatgtgccgcagggaagaacctcgatgaagcgcagaacatcaaccgtacgagtgaaaatgaagtccgatcaacgtagaagtcgaatggacttaccatgggtaactaccacaaccaaacaggggcacgatgccggagacaaatcgggtgcggcgaaccagtctaacggcacgacacagctgatgacataacagttcgccccatgggaccgtttcagaagccacgagaaggactgaggcaaaccgacccggacattccccataccttccttttcgtacctggggaaggaaaagaaaggctaaacagaaggacctggctacgccgaattggggacccacgatggttcaatacaactacacatttggggagcacactcggaacagcagaggtatacacagggaatggtactcacggagaggggcagacatggttataaccacaatggcaccttttcaaccttttaccctttgtggggttacactgggaacattcgtttagtccggaggatattcaccaacgaaagaaacgcagcgccgttatcacgagcttccccaagtcaattgcacagggtggcatgagacagtggggcaacaagtgcgcgggcaaaaaggacaccattggaaaccggacgcaaaccaacagagattgacttagtccacgaggggactgggggcaaacacagagccaagatggataaattacccggggtggaccactatggacccggaagcagagggaaaatggcaagcaaaaccggaaagaaactcaacaccgagccgcattgtgcagaccaccaaaacgacccaatgtgaagagacacccacaggaatcaatttacggaagcacccgacaggaagacggcaaggataaccaacagggaggagggacaccagggggcgaattccaaataccgtaggggcacatacacgatggacacacacacattccacaacagagacacggatcggaagtcaac

SEQ ID NO: 485800 - DNA, 146 bp, Homo sapiens
atagacccttttactatctctaatcaactccaaggaccccatgtttcacacaatgcaataaaacagagagtatgcctgactgctgagagcatgagtattattttgcaatgctgatgaggaaaaatattgcagcacactgctagcta

SEQ ID NO: 485801 - DNA, 539 bp, Homo sapiens
  misc_feature (81)..(82): n is a, c, g, or t
  misc_feature (180)..(180): n is a, c, g, or t
tcggagtgtccttcgatgatgagatggggacggaacgaaaaagtgaccagcaagtgcaggtgtacgtacgtagggatgttnnaatggatatccaagcgggcattgtgtagatgtggcatcagaagctccactgcccggggtccttttgtatagatcactttgtatatatcggataaacanccaaatcctatgacctgctgaggggctattataacacattgtatggcagatactcaggccagaaaggttggtatcaaaatttctggcgtggtggctcatgcctgtaatcccagcactttgggagactgagccagaagatcacctgaggtcaggagttcgagaccagattgaccaacatggtgaaaccccgtctctactaaaaatacaaaaattagctgggcgcggtggcaggctcctgtaatcccagctactcaggaggctgaggcaggagaattgcttgaacatgggaggcagaggttgtagtgagccgaggtcgcaccatcgcactccagcctgggaaacagagtgagactctgtct

SEQ ID NO: 485802 - DNA, 1008 bp, Homo sapiens
  misc_feature (433)..(433): n is a, c, g, or t
gacattgcagcaattcagtgagatctttagagatccattttctaattctacttctcttgactatttctgaccacgatctgtagtgttactttactctactgatagtcttgataacgaccgtcaacaggtccatccaatgcaggcgatgagaatccaactttcttccgaatgctccatttactgttgtatcattttgcatcttccacactcgctaggaattctatgaacttgttgtgttcttgtctcttggtctgtttttgaagacagggtctccactctgtcacccatggctgcgagatgctagtggcgccgtctccacgtctcactgacagtccttacccactcccagagtattcaagctacagtatctcgctcaccgtctagccctcccatgtacgttaccctcgggcgactcatcaggatgtttgctatncgatccactaccacaggtgtaagttttctatacttattctagtgtattatatagggtcagcatgatgggttttctataccaatttcgaaccacggtctggtgtcgaatagtccttgacctcaagtgatccagcctgccgttggcctccctaagtgcttgacgtattacagctagtagagcctatgcacactctgggcgcatggaagtcactgaatggttctctaatgatacaccctaataatctaactcagatgcattttcctaccaaggatttttccaatgtatatttctgccctaggatcccatcaggaggtatcacttgtctaatggccagcctacagtccttcaaacagtgtttctttctgcaacattaccttacgactctgtaaacgatccacagactttaactcctttggattaggcgtgcgcgaagatacggtggttccctttttacaaagggcctttgaaacgttacgcgctttcaccctccttcacgtagggggttttcatcacgaagttcgtttggagctgtctacgagcctatcggtacgcggacccggcactagatcttggaa

SEQ ID NO: 485803 - DNA, 121 bp, Homo sapiens
cataaaatactactcctaccaccatctcagaaagtatttggtggaagaagacacctcgtctcctggcagtcccgtcagcttccggtagaagagctcggccacatcccggccgccactgtcc

SEQ ID NO: 485804 - DNA, 747 bp, Homo sapiens
  misc_feature (15)..(15): n is a, c, g, or t
  misc_feature (26)..(26): n is a, c, g, or t
  misc_feature (46)..(46): n is a, c, g, or t
  misc_feature (180)..(181): n is a, c, g, or t
  misc_feature (232)..(232): n is a, c, g, or t
  misc_feature (305)..(305): n is a, c, g, or t
  misc_feature (345)..(345): n is a, c, g, or t
  misc_feature (358)..(358): n is a, c, g, or t
  misc_feature (391)..(391): n is a, c, g, or t
  misc_feature (422)..(422): n is a, c, g, or t
gggggcggctgaganagcgcccaggncctcggagcaaggcgttggnagatctgaagacagcatgtacacagccattccccagagtggctctccattcccaggctcagtgcaggatccaggcctgcatgtgtggcgggtggagaagctgaagccggtgcctgtggcgcaagagaaccaggnngtcttcttctcgggggactcctacctagtgctgcacaatggcccagaagangtttcccatctgcacctgtggataggccagcagtcatcccggatgagcaggggctgtgcctgctggctgtgcncctcaacacgtgctgggagagcggctgtgcagcaccgcangtgagggcatganttgacctctcatgactattcccacgggcctcantaccagaagtggtgtgatcacattcacaganctccacaggagcccactgcatcaagaaaactctacctaggtgaagggggaagaagaagatccgtggccaccgagctgggcacgtgaacgtgggacagtcttcaagacctggggactgcttcatcgtggacctgggccagaacatcttcgccatggtgtggtggaaaagtccaccatcctggaacgcaactagaggcgagggaactggcccgggtcatccgggacagtgagcgacaggtcaaggcccaggtggacgatgtccctgatggggaaggagcctggtgagatgatccagggtcctgggccccaaggcctgctctgacagg

SEQ ID NO: 485805 - DNA, 1008 bp, Homo sapiens
gtccttttatatttaatcgattgaaacaatcatagttggctgggcgcggtagctcacacctgtaatcccagcaatttaggaggacgaggcaggcggatcacttgaagtcaggagtttgagaccagcctggccaatgtggcaaaacaccgtctctactaaaaatacaaaaattagctggacgtggtagtgcatgcctgtaattccagctacttgaaaggctgacgcatgcgaatggcctgaaccgaggaggcaggaagcagaggttgcagtgagctgagatcatcgcaccgctgcactcctgcctgggtgacacaatgagactgtctcaaaaaaaaaaaaaaaaaaaaaaaaaattcaaaagggcggggggcccccaaaggtgtgatgcatcaagaatgctggaaaaaagatacaaactacacaaccccccctttcggggcacagcagggttagaccttgaatctatgtgggccccttgaaaaaccaaaacacataaagcggtgtattgacccttccattgtagcagtggttggccacgcacaaatttgcttcaggctacactaggacactaataaggcgcacaccggggattgtggaccaatccaaaggaagtgtggaaaccggccataaagggtgagaaacacaggtaaaagagtgcaccactccatacaaggggagcaagaaaaccgcccggaacgttcagtgaggacaacagggcgtgaccaacagtggtgtgtaacaccccggctactacataagaggctgaacaagaggtaaccaaggcaggtgagcaaagggacgatgaaacgacgggacacaggagcgatagaggcaggaaaaaactgaaaccgagaagcgacgtctagcagacgcgagaaactcaacacaggagacaacgggagcaagaatagaacagggaacaaaagaaaacaaaatatggtagcacgagaacacagggagttctacgaagaatgcccgaaggataagacataaaaaccaggagccgca

SEQ ID NO: 485806 - DNA, 130 bp, Homo sapiens
cacgccatatcacaaggggggttgcatgtggcattggagggttagtctcagagtccaggactgggaggaaggtacttgatgggatggtcttgattctggaacttgagagcggaggtgttagaaaggggag

SEQ ID NO: 485807 - DNA, 631 bp, Homo sapiens
  misc_feature (15)..(15): n is a, c, g, or t
  misc_feature (216)..(216): n is a, c, g, or t
cgaaacaaaatcggncccgaaataggaatataaacaataaaaacagtactacatgcgatgaggacgaacgcggtgaacgaaccttaagcggcgccttgggtaacctcgccctctttcaccctccaacgggggacggtgtgaaagtgctagggcctagtgcgggccatgcgtcaacgggggaaattggataaaccacgaaaacggaaatggggaggncattggacacggcaaaccgcgggcgatggggacttggggggaaggacgcgggggcataatgggcgcgaattgccggaaatacccggggtaatgatggtgaccgcatatgaatggggaactgggtaagcgggcccggaaaataaattatgcatagaagtgtgcacgggacgcgcctaatggctaaaatgactaaatggcgggtagacacgggcgatgccacggccggcatagaacggcggtggtggggactatagatgttaaaatcggaataactgcgtgcaaatgacgcgaacatgaaaacgccgggaaataatgggttaaatgggtattacaacggggcgcggaaatcgttatgatacgccgcttaccgtaactcttacgggcggggtacatgtaacacaaaaacggtaactgt

SEQ ID NO: 485808 - DNA, 260 bp, Homo sapiens
  misc_feature (10)..(10): n is a, c, g, or t
  misc_feature (167)..(167): n is a, c, g, or t
  misc_feature (218)..(218): n is a, c, g, or t
  misc_feature (234)..(234): n is a, c, g, or t
gccccccgantacgtgtgggcgcccgcgaagcccccagaggaaacttcggaccacgctgacctgtaggtccgggggcgcggcggagctgggacctacctgcctgagtcctggagacagaatgaagcgctcagcatcccggggaatacttctcttgctgagagccggnactcggtccccgggccagcagggatggggttggggaggttctcccaacccnactttcttccttcccnagctccactaaattccctcctgcctt

SEQ ID NO: 485809 - DNA, 1415 bp, Homo sapiens
agcggttgtgtgaccagtctgggcagcatagtaagacctcgatctttacaaaaaaaaaaaaaaaaaaataatcccaaaataggccggggtgcgcgcgggtaacccgtgagggaccatgctactctgaggtaagcaacccgggcagggaaacgcaacctcgtgcaaccgagaaaactatcgagagggagacccaaaatgagaagagcatcagactgaatgacaccgcgcaaaggacaatggtggaacataataccccacatgtcgtcagaaaggggagtgacagggcacgtcacaaccgaggacgcaacggcacaaggacaaccgaatacctgcgccgcggaaaaggtatggccacaaacatgcccgagcacggcgctacagtgacacaccagcgacaacacgggccgagaccccggctgtgacgcgcccgcagcccatcacagagacccacccccccacaagaacgcccgtgaaccaagactaccacgcaacacaacgacgccacgatccagggacaagcagagaactccatcacgcgcgcagaaccgcacacacagacccgcgcatgcaaacaacccggcgaccggcccaaccgaccaaaacacagacagactgaccgggcgcccaaccaacagagcgccgcgagagccacccgccaagccacagtcgcgaagacaacacgcaccccaacccgcccgccaaccccactacaccgtcacaccacacccgcaacgtccgcgttcgcagccacgcgtccacaggtcaaccgcaggccaacacagcaaaaggacccacccacgatgcgcagcacggcgacgcgccacgtcaactataaacacaccctgcggtcgccgtaaacagcacaccaccggccattcatcaaatacgcgccaggcaggcacagatgaataacatagagaccgaggagacgcctcgaccacaaaacgctgccccacaacgaatcaatcacaacacacgcaacaccgtcacgcctgccgcgcagcaagcagtcaacacacccggtaggccacgccgcacagacaactcccaactcaacagtgcgcgcggcaaccaacacaacaactgcaagcaagcacatatgacacaccacatagcacggcggacagacacaacctaccaagacccacggccgcaacatacacttggcccaaaacaccgcaccccccaacgcctcgggacgagaaagcaccacgagccgagcgtccccccatccgcgcaggagcgcaatctacgcggcacaccaccgcccactcgatccctccaccaactaagaccgcaccaacagcggcactgcacataatactcgcccatagcaacacgaccacgtgctacgacagaaccgcaaactgctcaccgagagcgacccccaaccgccgcccccccgaccacaccgc

SEQ ID NO: 485810 - DNA, 318 bp, Homo sapiens
tggaggcagaggttgcagcgagtcgatttcgtgccactgtactccatcctgggtgacagagtgacgactctcacaaaaaagacacaattcgacatattggatgggtttacaacttcgtgggacgtcaaccagtaccgatggggtctctgtaggctcgcatcaaggtgtccgcatagctggttccttcgggaggctctcagggagaaattttcctcgctttctccagctttaagaggctgccacatccttggtgcacggcctcttccgtccatcttccaaggcaaccaatagccggtcaagtcttcctctatgaacccg

SEQ ID NO: 485811 - DNA, 696 bp, Homo sapiens
  misc_feature (519)..(519): n is a, c, g, or t
gaggcaggaggattgcttgaggttgggaattggagaccagcctgggcaacataatgatgcagaaatacaaaaagttagccaggcatggtggcgcgcacgtatagtcccagctactcgggaacctgaggtgggaggattgcttgagcccaggacttggaagctgcagtgagctacgattgcaccatggcactccagcctgggcaacagagtgagaccctaaaaaacaatataggccaggttcgatggctcatgcctataatcccagcactttgggaggccgaggtggatggatcacttgaggtcaggagttcaagagctgcctgcccaacacggtgaaaccccatctctactcaaaatacaaaaaaattagctggacgtggtggcagacacctataaccccagctacttgggaggctcaggcactagaatcgcttgaacccagaaggcaaaggttgcagtgagccaagatcgcgccactggactccaggctgggtgacagagcgagactccatctcatangagggacacatggggatgaggatacggtgttagcaatgcagggagggcagtaagagcaagatggccgttagaagtggccctgggcttgcttgggaagaagcttgacatttgggtcttgacaggtggcccttgacccagggatcaggaccttaatcctaaaggggactcaaacttaat

SEQ ID NO: 485812 - DNA, 169 bp, Homo sapiens
gtgtagtgagatcggtggggtggctaggtagaggaggaccagaagagatttatgatctctcggaaggctatgagctgcggctggccccatcataatcttttttagtttagcagaagtcaggaaacgaatacggggacacttggcatccagagacacttggcatccagag

SEQ ID NO: 485813 - DNA, 309 bp, Homo sapiens
ccaacctagggtcagttttgcatgtgtaaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 485814 - DNA, 256 bp, Homo sapiens
gcatggccataaaattttaaatgaaaatttgtacaagcagaaagttttattgaagtccagtttttgattctccctctgcccccttcattgctgttaggatggatgttaatgtctgaagggccatcttcagtcaggatgctggtgagcctgtgacatctggtcactccaagctctgctcgaaggcatttaaatttaataaaaagcatactcccatgggcctcaaaaaacacctctgggactgagacctcaccagctt

SEQ ID NO: 485815 - DNA, 268 bp, Homo sapiens
agcggatcccgtatcagaaaaattattatggtcttttacttggtacttagagtcagtaaatatcccttaacgtctacataatgggtctcctgccgtaacaagaaagtagtgctcgctaagtttaagccatttttgaatgtcagatattgttaatgaaattgcgcataggaatcatagttaagatatgtcataccatggatattgcaaaatgggtaattttgtggcagatagtcacttttatgaaaacacggtcaacttgtctggagta

SEQ ID NO: 485816 - DNA, 238 bp, Homo sapiens
ggccggctgaggcagatccctgctctgctgctgactggctgtagtctgaggcaggtccctcagtctgagttgttttttcacctgtgagacaggatgatgatgtggtggtgacttttttttttttggagacagatttccccctctgtcgcccaggctgttgtgcagtggtgtgatctcggctcattgccacctctgcctccgtgattacaagcggttctgtggcctcgtgcgagggaac

SEQ ID NO: 485817 - DNA, 811 bp, Homo sapiens
agtcctgtcctttctctctccccggacagcatgagacttcaccacatcgctccaccttctccaccaactaccggtccctgggctctgtccaggcgcccagctacaggcgcccggacggtcagcagcgcggacagcgtctatgcaggcgctgggggctctggttcccggatctccgtgtcccgctccaccagcattcaggggcggcatggggtccgggggcctggaacaccgggatagccgggggtctggcaggaatgggcaggcatccagcacacgcagcacaggcagcacatgccacacagcctgacacgcaccgcctggcctcttcacctggcaccgcagtgaggagcctggagcacgagcaaccggcaggctggagcagcccaaatccgggcagcacttggcagcaagcacagggaccccaaggtcagcagcactggagcccattcacttccaagcatccatcagaggcacctgcagggctccacatcttcgccaaatcactgtgggacaatgcccgcatcagttctgcaagattgcacaatgcccacgtcttgctgcatgcatgaccttcagcagtcacagtcatgcaggacagcagctggcccatgcgccaggtctgatgcgagcaacgacatccatgggctccgccacaggtcatcggatgacaccaatcatcccccgcatggcagctgccgcacagcgcatcgcaggctctccaggaccgagctgctcttcatgaagaaccaaccacgaccggcacgtaacaggcctcaaagcccagaatggccaacctgggtgaccgggacgg

SEQ ID NO: 485818 - DNA, 212 bp, Homo sapiens
agtgtggacctggtggaagttgaggctgcctggtatttgattatatattatgtacaaactttttcattcttaacttaaaaatgcttttcaaaaaaaattaaaatttggtaaatgggattttaattaaaccttggaacaacgaatttggatgttccagaggttggacttgtattaggtaataaagctggacctgggactcgtgaaaaaaaaaa

SEQ ID NO: 485819 - DNA, 944 bp, Homo sapiens
gaacaagagactagtgacgttaagacactcaggaacactttcgaaaaccagaaacatcctgaatccatatcaaggtaagtatagaaaagaggcatatggaagccggaaacacctacagagactacatacaggtctacgctccatttaaaaccaaagaacacataccaactacgagaatcgggcaagatacaagcaaacattagagacgatggcaaacccagacggacctagccaagcaccaacaagcaggacataaacccaagaataactactagaaaagctaaaaagacactagataaaaagcacaggaagagtagggccataagaacaccataatacaatactggtacgacccaacaaggacagaggaaagacaatacagacggataccatggcaagaaaaaggaatgaatggaccaccatagagcaccacaaaagaacccaccggagaggaaagcactgtggcgagaacagctgacacaagggaatggaatagagcaagcgaaagaacaaggacaatccgacacacacacaaagacagaaacaaaagaaaggccccacgacaacaaaagcaccaagtgacacacacagcagcaagagtggagccaacacacatgaccaacagaggaacacgacagccagggagcatgaatatcaaaaagtgaaatggaagaaagaaggcagacaaacagcacagtcataaaaagacacagacaacgaaaccaccacagatgacccaagcacatgagagaaacgtgaccatgctaagcataggacgacacaccgaagaatacccaaacaacacagaccgagtacagtaagaagcaacaaacagtagaagcgagaacacgcaaaagaaaagaaagcccataagaaatgcccagacacgcgagacataaccatacaaagtgaaaacagcaaacgatcagacaacccacaagaaa

SEQ ID NO: 485820 - DNA, 410 bp, Homo sapiens
tgtatcacatcaatgtgttgctataggtttagtagtcagtaagcatataaatgtcggaaggatgacccaaaggggcttatcatcctctcttccattaagtcatcttcatcatctagcctgcaacatagctccataacatcactgtacccgtgtgatagaacaccacgcgacactagatccagagcgggaacagtatgcacaagatgaaaagtacgaaggtcccaaatctcaggtataaatgatcacctccagtccatttggatggacaaacaccactgatgttcaactattgaacttgtcaaactatgtggatggcctgtgcagagcggacatcccagaggacgccatacatttaagacaagaatcatctgtaaggattaaaggtggaccagtacctcttgtaagttgtt

SEQ ID NO: 485821 - DNA, 773 bp, Homo sapiens
tttttcctcattaaactttttaaatggggtctcaaaatcctggtgacaaattttgggtcaagtggttcccattaaaaagtactgattttaaaaacctaataatcttaaaattggccacacgcaaaaaagaaaaccaaaggggtccacaaaacattctcttttccttctgaaggttttacgatgctattggttaatcattaaccagtcttttactactaaatcttaaatgggccaatggaaacaaacagttctgagaccgtttcttccaccatctgattaagagtggggtggcaggtattagggataatatcatttagccttctgagtctttctggggcagacctgggtgaccttgccagctccagcagcctttcttggtccactggttttggatacacacccacccgaaactggtctggtctcatatcaccagaacaggcaaagcagacccaaagggtgggatagtctggaagaagctctcaacacacatggggcttgccagggaaccatatcaacaatgggcaggcatcaccagacttcaagagaatttaggggccatccttccagttttttaccaaaagggcgatcaatcttttccttcagctcagcaaatttgcttgcaatgtgagccgggtggcactccaatacggggcatagccgggctaaattgggcctggatggtccaggataatcacctgagcagtgagccagctgcttccattgggggtcattttgctggcacagaacgttgccccgagaactcttgcgacctt

SEQ ID NO: 485822 - DNA, 260 bp, Homo sapiens
atttttgaaggggccctttgttttgttttgatcctggtcccacagggtagtgcccctcctttccaggggtttttagtagcttacccgtttagcccttttgaatatgggttttggggtcagcctggtagctaaagggcccttgcatgttaactttttgagccccagcttccatgttttccccacaggggttccctttcccctcccccctagggttgtttagaggagcttagattaagcaaattaagtgcttgggcccgcca

SEQ ID NO: 485823 - DNA, 300 bp, Homo sapiens
gaaatcccggagtgagagtctctgtccactgacatgcaagactgtacatatccatctcttctctgagctcctgtaccataagtatgagtgacgattggaccttgagcacgtgacgctccgcctgtcacctggaagtgcgcggggctccgtgccgtcgcgcctcgtcggggccctggtactgaagcagcgtccgcgatgtccaagtggccgaggggcagcgtactgcggactcttgaaatagtaaaggtagcacggcgcgcgtcaaacacgaaccagcggctgcggtagccacgcagggcc

SEQ ID NO: 485824 - DNA, 355 bp, Homo sapiens
ctcaccaagccatccctctttgcctctccccatccctcgctggcctgctcctgctccccttctccacatacttaccattaggcctatttaggtagaatctatagataccgtttgtccaatagaggttgtaaaaggaccgcagtgcctagtataatacgactattactgtggaccacgtttgtataacgaaatgcttggcgtacgcgctaaatctttgttggccccctcgaaggtgataacttctaagaaagcggactggcccaccttatataaaatataaaggaaagaaaaataatatattttttaagatttataaatatttttaaaagaaaacaaaaaaaccacaaaaaaataa

SEQ ID NO: 485825 - DNA, 819 bp, Homo sapiens
agcggcttccctcactccccagccgggcgggagcatttattccccagattaattcccctttatgggggggggcgggatgtgtgtgtgtgtgtgtgtgtgtgtgtgtagtgtgggggggaagtgtcctctgaaatagtcaaatcattattagagctctttgtgcctctttgtcgtgtcggcgttgtgataaaatattccttttgagaggtgggaaaacgtggaaacaccacagtaggactgcgcgccgacagtcatacgccacagcgtacgaacaacaaaacgacaacggaagaaaaaaagacgcgacgagggagcagggacgaggaaaagacaggcaagaggagagataaaaaagagcggcgcggagacgaccctgatggcgcaagaagaaagagcaacggaacacggggcatacagaccaatacagccaccagccaacacgctcgatacaaacgagctgtgaggcaggagcgccaccagcagacagacgagaagactgcggagatcccagcgcgcacgagagaacagcgagacgaccaacacaggacgcgaagaagcaatcagcaagagtggggacgcgccaaggggagaaacgcaaagagcgggaagccgcgcagcggaacaaagagaggcaagacatggagacgcagccagaggagcgacagctcgacccggaaccacacgcgaggagccgagacgggcgacggaccaactggcaagaggcaagcgcgacaggaggcacgcacaagcgacagcaggacgagaaccacggaagagcggagaggaggacaaatgggagagcgcacgagaggagaacac

SEQ ID NO: 485826 - DNA, 570 bp, Homo sapiens
  misc_feature (336)..(336): n is a, c, g, or t
cttgaccaccttgcatttctgtaggagtgcttctcctgctactaccagggtttccccagagtttgcaggcacctccttctggtgttctatgggaaaatatggtttcttcctcggggaagttgtggcccccaaggatatttgcacccggggcggtggcaatatttcgagcgccttcccaaccccatcccctgctttatattctaggtgtgctcatactctagccgccttttttccccctgtggaacccccctgcaactcttcattaacccaccccttctggaaattttcttttgctacaggtataatttgtcttacaaataaaaacttgctaatctntccctcacctactatttaagcctcatcgatagattcttcccccgcacttctccaccctcttgtaaaaaaggttggtgaccaccccttgtacccaccgggagacattttttttatcttgatggtattgaagaaatatttttatagcagaacacacccagaggcacacgcgacatttttttctgtggtaaaatacaacaaagtgtcttttctttctggtcactacaaaaacaaaca

SEQ ID NO: 485827 - DNA, 252 bp, Homo sapiens
gttaacacagattttgttgtagtggtcaaaaatgatttaaaagattacttgttcaatgataagaaaacgactgtttcgcattatatttatctggctgattttgagtttcgattgactgatagttttaaaggcatttattttgaaaaaaattatattcccttttcatctgttaaaagctattgttctcaacatgaacttgaatattcaaatctcaaaaaagatgacctcaataaaatattaacttttaatagt

SEQ ID NO: 485828 - DNA, 649 bp, Homo sapiens
  misc_feature (517)..(517): n is a, c, g, or t
  misc_feature (610)..(610): n is a, c, g, or t
tatttgtagctattggaaataagattattttcttggtttattttctagattgtttgctcttggcatacagaaatgctgctgatttttatatgctgactttgcatcctgcaattttactaaacctcagttctaacagttttctggtagagtccttaggtttttctaaatttaagatactattgtctgcaaacaagggtaatctaaatttttccttccaatttggatgccttttcttttcttctcctgtttaattgctctggctaggacttccagtaccacgttgaagaaaggtggtgaaagtgggcttccttgccttcttccagatcttacaggaaaggcttttagattcccccctcatgatactagctgtgggtttatctgtctgtggcttttattgtgttgaggcatgttccttctacatccagttgagtttttatcatgaagggatgctgaattttactgaatacttttttggcatctatagaaatggacatatggttatgtccttcattctttngatgtgatgtatcgcatttacagatctgaatatgtttttaaggtggttctcacattgctataaagaaatacctgaaactgggcaatttatatnaaaaaaaaaattcattggctcactaattctgccaggctg

SEQ ID NO: 485829 - DNA, 372 bp, Homo sapiens
  misc_feature (96)..(96): n is a, c, g, or t
ccgggttcggtccacaggcagccgttctgcagcgtcgcgtcctccagggcgaaccagaaggtcgtcaccgtgatggggtcgctctcgaagaagctnggcgtcctggtgccagcgcacctcgccgccgatgccgggctgcttgaagatgaacatggactgccagacctgcggcttctcgaggcccaggctggccgccacgccgcgcaaggcctcgcccttggagaaggcgctgaagaccgggtcgaggtcatgcatggcatggccaatcttgttgatggcgagttccttgggcacgcgcagcttgccctgttcatcgaaggcctcctcctcgaagaagcagcgcacctggtcgccgctgtcgaggaagtggtc

SEQ ID NO: 485830 - DNA, 419 bp, Homo sapiens
  misc_feature (28)..(28): n is a, c, g, or t
  misc_feature (43)..(43): n is a, c, g, or t
  misc_feature (179)..(179): n is a, c, g, or t
  misc_feature (299)..(299): n is a, c, g, or t
  misc_feature (301)..(301): n is a, c, g, or t
  misc_feature (306)..(306): n is a, c, g, or t
  misc_feature (309)..(309): n is a, c, g, or t
  misc_feature (311)..(311): n is a, c, g, or t
  misc_feature (315)..(315): n is a, c, g, or t
  misc_feature (320)..(320): n is a, c, g, or t
  misc_feature (325)..(325): n is a, c, g, or t
  misc_feature (331)..(331): n is a, c, g, or t
  misc_feature (335)..(335): n is a, c, g, or t
  misc_feature (343)..(343): n is a, c, g, or t
  misc_feature (351)..(351): n is a, c, g, or t
  misc_feature (353)..(353): n is a, c, g, or t
  misc_feature (398)..(398): n is a, c, g, or t
gaaggtttgcccgcttacctttccccanctgttccttctgggnacctatgtttttagaagcgtcttggtcactggggattccctaaggttttcagcaatggggctgacctcttcggggtcacagaggaggcacccctgaagctcttccaggccgtgcataaggctgtgctgaccatcgncgagaaagggggtgaagctggtggggccctgtttttagaggccatacccctgtctatcccccccgaggtcaagttcaccaaaccctttgtttttttaatgattggcccaaataccaagtntnccctnttnangggnaaagnggtgnattccncccnaaaataantgcctctngntcctcaacccctcccctccatccctggccccctccctggatgacnttaaagaagggttgagctgga

SEQ ID NO: 485831 - DNA, 200 bp, Homo sapiens
  misc_feature (80)..(80): n is a, c, g, or t
  misc_feature (82)..(82): n is a, c, g, or t
  misc_feature (87)..(87): n is a, c, g, or t
  misc_feature (90)..(90): n is a, c, g, or t
  misc_feature (92)..(92): n is a, c, g, or t
  misc_feature (96)..(96): n is a, c, g, or t
  misc_feature (101)..(101): n is a, c, g, or t
  misc_feature (106)..(106): n is a, c, g, or t
  misc_feature (112)..(112): n is a, c, g, or t
  misc_feature (116)..(116): n is a, c, g, or t
  misc_feature (124)..(124): n is a, c, g, or t
  misc_feature (132)..(132): n is a, c, g, or t
  misc_feature (134)..(134): n is a, c, g, or t
  misc_feature (179)..(179): n is a, c, g, or t
aaaaagcccccccacatgctccatccggattaattattttttttttcggcaaaaaaaggtactgaacatatttccaagtntnccctnttnangggnaaagnggtgnattccncccnaaaataantgcctctngntcctcaacccctcccctccatccctggccccctccctggatgacnttaaagaagggttgagctgga

SEQ ID NO: 485832 - DNA, 431 bp, Homo sapiens
  misc_feature (74)..(74): n is a, c, g, or t
gaactctggaggcgggagtttgccagtgagctgagattgcaccattgcattccagcctgggtgacaaagtgagngactccacctcaaaaaaaaaaaaagggattccaaattccagcaaataaaaaactaataaagaatggaaggaaggacaaagtagacaaaaaaaataactaaacaatttcttgaaatgaaaaggatagtcattaaaatttttttaattcaatgaatgtaaggattatccacaggttttaaaaaccaccggtcaaaggttactgggaaacgagatctgcgcaccatttcagagttggcagctacagatcacctttgcctagtagagatcacccgaaccaagccacggacagactgacatcatgagcttcctgataggatgcagtgggaaggacacatcatcatctgtgcagtccttctgc

SEQ ID NO: 485833 - DNA, 343 bp, Homo sapiens
gagtgcaccggatgtcacttatgtcatttctagattgtgcatattcagatcttctctactaatctagtaaatctagctagcagtatatcaatcttttttttatcctttccaagaacaaacttctcatttagtatatcctttgtatagttgttatgggtctcaatttcatttaattctgttctgattttagttatttctttttttttctgctagctctaggtttagttattgttactatgtatatctttatttgttattttagggtgcgatttcaggtggtgaatttacaaatgtatcttgctatgatgtaaactttcggtgctagaaattttctttcttaagg

SEQ ID NO: 485834 - DNA, 194 bp, Homo sapiens
ttgtatctaaggatcctctttgggacggcggcacggactttgtcttcctctgggcataggtttctccagaggaccaggagaacaagggtattgatagcaacctgcacgtgccgaagacggggacgccaaagctgcggtacaggaggccggcgaccggtggtcccagagttcggagcagtggttgtacagaggcg

SEQ ID NO: 485835 - DNA, 901 bp, Homo sapiens
  misc_feature (335)..(335): n is a, c, g, or t
ctagccaggacaaactgaaattgctttcttctgtgacgaagattataggaactacaaagctaatcccatttcatcctggtgaagcatgggggagggcttcctttttgcatacctgtattaagctctttattccactgctgagtttttgaaattgacaaacaaatcttaaaaaattaatcccaggctatactctttgagctaaaatctggttatttctttctcttcaggtctttctttccttggggggggctttttctttgttgttgtaaaataatatattatgagaaaaacatttgatctttttaaaggggaataaattgttattaaaaattaanaacggagagggggacgcgagggggtgaggtagtctaccgcgtgtgatctcagtcagcgcccccaggtaggaagaaaccggggccccttgcgcctcaaggggggaatttttgcctctctcccttaaggggggggtacgagaagagagcgcgctaatacattgttcgacgcgacgccggggtggagcgaccgcttatacctctctcaagggggggtagcgggtccccaaggagaggggatatccccgggaaataacgggggcgcgggccgctatatggcgctgaccctgaaaagggcggtagggggcggttgccacaggccccgtcccccgtgacgtcccaaaacaaaaatctggacgtagggggggcaacgcacgcgggctcaagaaaccaagagggtcccgcggaaatgccagagagcccccgttgaacgagtgagcaggggaatctaacagttttttttaaggagagctcgctttctcaaagcacgtggttgttatgcggccggggcgaagccgaggggggagaacaaacccgtccagcggcgcgggccttaagcgagagctaga

SEQ ID NO: 485836 - DNA, 966 bp, Homo sapiens
tcgcggtggtggcggtgcaagagagctgaaggaggcgcgagggcgcggaggttccaggccgagcagttaggccgcgagcgactgcggcgccgagccgggcgcatcgagtccccggcaccatgttgggaagaggaaccacgcgggtggagatctccgcgccgtccaacttcgagcaccgcgtgcaccacggggcttcgaccagcaggagcagaagtcacggggctgccccgccgagtggcgagaagccgtgatcgaggagtcggctcgccggcccaagcccctcggtcggaccccgcctgcaataagcctccatccagcgcgggggcccccaaagaaccatcgtgcggggcgaagcaaaaggttgccgaaagcatgggggccctcaaccgcttgctgcttggaccgatgtttgagaaacattgtcggtgagaccgctaccaactccctgcggagagaacagcccgcagcggcgccggccgtgcccgcagggaaactgggatgccagaggagcccggccaccaaggggccagaggggggcccagggaaggcaggcaagccgagggcggctacgacggccacaaggagggggtgggggcaagtggttgacaggcggacggggcggggccagagagaagagcccaggtcctcgagggaagggtcaggggggccccacggagtcccgcgggaaaaaggcccccactcggggacgatgtgggaacccccgactgtgggtccgggcagtgggggaaaacggcgctgggcggccttaaaacccaacgaggtgtgaagacaccccctccccgggtccgagggaccaagagggggcccaggccaaaggggggcgagcaccaggaccacctggccccgagaggggacgccgctgtgtcaacacacgggcgcgaaagagcagacgaaggagcaacaagagcagacacatgaggacagaagacagacgatcctctgtca

SEQ ID NO: 485837 - DNA, 344 bp, Homo sapiens
  misc_feature (314)..(314): n is a, c, g, or t
atgccactcctcacagggctgtccacaggcgaaaagtcagtgctttttccgtccggcaatggtaccacgtgtttttccagatgtctgccacaggtatctcttcacctctttctccctgctactgcacgatcggtccacagtctgtgcctgctccttcataatatcatagtgctgttgcaggcacaaacgcataaacctgctcgagactgtggtgagagaagctgattcaggattgaattgctttcccgaggtctgcagagatgctcgacatgtgctgtccagccatgacgcgcagacggccatcctgtttcccncttcgccacagtccgtactaggcccggggc
